United States Patent 7,745,391 (HUMAN THROMBOSPONDIN POLYPEPTIDE) - sequence listing, part 246

SEQ ID NO: 687726 - DNA, 128 bp, Homo sapiens
atgtaacgtggccgtcgttttacactggcctgtcgttttacactggcctgtcgttttacacgtggccgtcgttttacactggccgtcgtatttacactggccgtcgttttaccctggccgtcgtttta

SEQ ID NO: 687727 - DNA, 253 bp, Homo sapiens
gggggggggggcccccaaattccctttggaaaaaaggactttccccccgggcccctccccggggtggggggttttggggccaaacccaaaaaaatttgttttgcccccccgaacttttcgggcaatttgggtttttccttttttttttttttttaaaaagggccaaatttttttaagcttgggcccctacccgggtttttttcccaataaaaaaagggggggggtgggggccttaaaaaccctttttccctca

SEQ ID NO: 687728 - DNA, 772 bp, Homo sapiens
  misc_feature (6)..(6): n is a, c, g, or t
  misc_feature (107)..(107): n is a, c, g, or t
  misc_feature (203)..(203): n is a, c, g, or t
  misc_feature (209)..(209): n is a, c, g, or t
  misc_feature (214)..(215): n is a, c, g, or t
  misc_feature (222)..(222): n is a, c, g, or t
  misc_feature (224)..(224): n is a, c, g, or t
  misc_feature (233)..(233): n is a, c, g, or t
  misc_feature (276)..(276): n is a, c, g, or t
  misc_feature (299)..(299): n is a, c, g, or t
  misc_feature (319)..(319): n is a, c, g, or t
  misc_feature (335)..(335): n is a, c, g, or t
  misc_feature (351)..(351): n is a, c, g, or t
  misc_feature (372)..(372): n is a, c, g, or t
  misc_feature (407)..(407): n is a, c, g, or t
  misc_feature (600)..(600): n is a, c, g, or t
  misc_feature (766)..(766): n is a, c, g, or t
ggaganaccccctccctccttttccctctccaggcccacagcctccccagagcccaggtagggaaggtccagatgtactataacaggattgctcatcccaggctatnggagaagtctggaaagcaggcctagaaggttgctgggctctttgaggccaggaaagaaaaaaaaaaaaaaaaaaaaaaaaaaaaaaaaaacctggnaaaggngttgnnttctcancnccccttccncctggccctagttggcccctgtggcagcagctgtggggctganaagggggaagaactgggtccaangccaggtcgtctattcttgntttgtgcagggaagcngaggaaagttggtggnctgtgacaggtggtgaggaanccttaaaaggcactgtgggagctgaggtctaagangggggggcatctaaactatctcagggacccctgaacgctcacaggtagagaggggtcaggcctagcaatggaaaaacagctcctgcaggcctgctgccccgccagtgcctcttgctgtactaccaccttcgccttcctgctggcggcctgcaaaaccagccaagctggaggccacagcagcagttggcaaggntggtccccatctggtgcccaccctccacgtcaaggcacttttgtccattttccaatcaagtgagttagtttctaatatctctggaagcagcaaaacatcaggggtcctcttccccctcccaatttttgtttccctccagatgaggcagaatttgaatgttggttcnaaaatt

SEQ ID NO: 687729 - DNA, 104 bp, Homo sapiens
ggtgactctaaggatcccgtacagggcgccgttcaccttgaattgagacttgccgcgtttgcagtgcgccacagctgtcgctgtcttcttgctgcctcaagtaa

SEQ ID NO: 687730 - DNA, 398 bp, Homo sapiens
  misc_feature (5)..(5): n is a, c, g, or t
gcganactccatctctaagaaaaaaaaaaagggggctgatctcattaccaatatggcttcggacagactacctatcaattcgaaataatacccaggaggtaaaagatgccggctcgtagaaaagtataccactgatcaaatcatttaaagatgcaattaattggaacaatatcccatgtccgtagatgggacgattattggtaaaaattcccataactccccaaagcaatctatagatccaatacatttcctgtcaaaattccttgggcctttgtcacagaattcggagaacacactcctaaaatccacgtggacccacagacagcttctattcgccaaaccagtcttgtgaaagaccaaggttgaagcatttgcagtccctgattcccaccttgcca

SEQ ID NO: 687731 - DNA, 198 bp, Homo sapiens
gggttcccccccggcccaaaaattgggggggttttttacaaaagggggcccgggtatttccccccccccccccgttgggggggggcccccccactttgggggggtttttttttttccccaatttggggggaagggggggggggggccccccccggggtttcttttttaaaaaaaaaatttgggggcctttttttttta

SEQ ID NO: 687732 - DNA, 267 bp, Homo sapiens
gtgtccgacgaggtacttcagcagctcgaactcggtgtaggtgaggtcaaggtccttgtccccgacactcgctgtgtacccgtcctcgtcgacggtgaacggtcctgccacgagttggttagtgacttggatcgtaaacagacagcgaagccgggtctcggcttctgacggggttgccgaatcgcacaggaagtcgtccattccccagtcggggctgatgaccgaaagagtgtcggagccgaccaacagcaggaccggcactcgtct

SEQ ID NO: 687733 - DNA, 462 bp, Homo sapiens
  misc_feature (5)..(5): n is a, c, g, or t
  misc_feature (26)..(26): n is a, c, g, or t
  misc_feature (38)..(38): n is a, c, g, or t
  misc_feature (52)..(52): n is a, c, g, or t
  misc_feature (64)..(64): n is a, c, g, or t
  misc_feature (100)..(100): n is a, c, g, or t
  misc_feature (132)..(132): n is a, c, g, or t
  misc_feature (303)..(303): n is a, c, g, or t
  misc_feature (450)..(451): n is a, c, g, or t
  misc_feature (453)..(454): n is a, c, g, or t
  misc_feature (459)..(459): n is a, c, g, or t
cgctngggccacacgggaaagataanggaagcttgcgncccacaagatattnccgtcaacagcngcccctattggaagcaaccgaactgactgctcgggnaactttgtttgttccggtcggaaacccaaggnccttctgttcagagatgacacagtatgtttggccaaacttcatgacagaaacacatatgaaaaatacttaggagaagaatatgtcaaggctgtggtaacctgagaaaatctccacctcataaccccctgaagcctgcacttcccggaaccttaaaacctaagggtaggctngccccccaagtaaaagatggaacccaaatgacccatgagtttgccctggtttcactggcccaagtggtttgtgctaaccacgtctgtcttcacagctctgtgttgccatgtgtgctgaacaaaaaataaaaattattattgatttanngnntcaanaaa

SEQ ID NO: 687734 - DNA, 120 bp, Homo sapiens
agatacaccacagcttgttgaaaatgtcgtgttgtggagatgtggtatagagtggtatagagtggtatacgaggtggtatagcgggtggtatggtgggtattatgctcgaggtaccgatg

SEQ ID NO: 687735 - DNA, 1078 bp, Homo sapiens
gacatggcctgttcctattgaatgatgattcgatacattatcatgaagaaatggacgacgtacatctgaagattgtacaaggtagtgcttttgagagtactgagtagtaggagataatcggcgttgtaatatatgcctcagcgtgacattcccttttcgcacttcagcactacagagtgatatatgcatgactctctagattacaggtcgcagttatcttatcattggtgaactgatcgcgagaattctctactgccgattgtaatacgactttgatgcactcgttctaacgatgggggcgtagtatagtctaaaggtcctaagcagtcacgtaagtgagtcgctcacattcgagatcatcgcccgaggcatcatcgcgtggtagctcgtctattgttctatgattaccatgtcattgccacttgaatagaagtcatgtcgctccttcattttatgactcccagtaatacatctgcccagatggagtctctctcaactaatactggcagtacaggacctgatgctcctgatagactgagttgaggaagagtttcgtaatagtgaacaacggactttgatccgcgctgaacgccagtttgacacataaaaaggcatagactatcacgctttgacggtaccatttgttcttgaaagatagtgcctgatcctgtcaattgatacaattgcagcaactctggatcgagatgtccttagattgtgcggacacttgcataaacgcaatgctcagctgctctgcaagataaaacccatggaatttgctccagtcctttgccaagcagctaatacattctggggacagcaattcttacaagttgcttcgatggaccagcagtggactgcacacattgagcctaagattaatagttcaagtaccgacacacttacattgagtgaaattactagtcagatcaaccagcaggtcaggataacattcaggtagtcagccagcgtcgacccatgacaggcaggacaatattgcaagtcgcccaagaggcccgagggagaaaccccccggtcccttgagggacggacctgtaccaaaagtctttcaaaagca

SEQ ID NO: 687736 - DNA, 328 bp, Homo sapiens
caataataccagggtaccaaccaattaaaaactggttaaccctcatggattaatagagatgaccttatttaccctaacaatcttaaaatagcctacaaacacatcataagttgatttgctccacagggcagcaacgccacctgaggtgtatactacttagggatccgtgcacgtaaacgattactaggactatgcagaaaccagagaatttaagaataccgcaatgaatacttattttcacactattctttcatttctctctttctctacattatttcttcttattccattaatccccaacccacccatcgcttcccattacattcaa

SEQ ID NO: 687737 - DNA, 162 bp, Homo sapiens
aatagcggtccgacttatcaacgccgtgactgcatcaacgccgctgacgatacaacgccgctccagccagcaggttaccctcctcagtgtcaaaccccgtaccccaccctggcagaacactgaggagggtaacctgctggctggtgcggcgttggatgcatt

SEQ ID NO: 687738 - DNA, 402 bp, Homo sapiens
  misc_feature (187)..(187): n is a, c, g, or t
ccctgaatctgttacaaatcataccaaaaatggccatgcactgtggctcaaacttgtaataccagcactttgggtgtaagtggtgtgtgcctgtggtctcagctactacggaagctgaggtgggaggatagcttgtgcctggaagatggagattgcagtgagccgagaccgcgctacctcatcccantctgggcaacaaagccagaccccatcccaaaaaaaaaaaaaagggaaagaaagaaagaaaaagaattaaagaatctcttccacaaaaagggacggctttaaaaattgtcctaccccatttctgaagaagaaaaaatttacaattttggagacggggtgcgggggcccacgccgttaaccccagcactcgtggaggccagggcttgtgtttggcaa

SEQ ID NO: 687739 - DNA, 669 bp, Homo sapiens
  misc_feature (419)..(419): n is a, c, g, or t
tccagtcagagatgaacccatctgccaacatgggaaccgttctctattgaatacccattaactgcgctgtggcgtgccccgtgatcttcaacactttgggaggccgagttctgtcggatcccctgagccagagagttcacagaccagcccggcccaacatagtgtaaccccccttctctcactgtgagaatatagcacaattagccgggcatgttggcgtgtacccgcaagtcccagctacttgggacggccgagccaaggagaattcacttgaaacccgggaggtgcgacggctccacgtaacgcacgagcatcgcgccagctgcaactccacgcctgggcacacagacgtgagaccctgtctccataaaactaaaataaactaaataaataaattaactaaaacagtaacaaaatanccaacaagttagctggggttggtggcgtgtgcctgtagtcccagctactcgggaggctgaggcagaagcatcacttgaaccccggcacggcggaagctgcacgctgacgcccagaccgcgcccctgcactcccagcctggtgactagagactctgtctcccaaacaagaaacaacattaaattaaacaactttcatgtaccccataattatatacacctactatgaacctgaaaaatctaaaaataaaaa

SEQ ID NO: 687740 - DNA, 520 bp, Homo sapiens
gtatgtccacacacagaaatagctgcccgatggtgaaattcacaaaatcatgtgacacatactagatagagtccacccaggagataaaggggtttgatgaagcccctgaattttgctcagtgtgtgactgccttgacccttagtactgtcagctctatcacagtcccacatgcctcatgtcttggtcttcctgtgagtctgtctaggagtgtaactggatatgttattgtaaaccagtggttctcaacttgtgggctgtgtccccacaaaggggtcacatatcagatatttacattataattcataacagtagcaatactacagttatgaagtagcaacagaataattttataattgttgggggggtcaccagaacagaagaaactattaaagggtcacagcataggaaggttgagaaccactactataaattatgattttttttttttttttgctttcagtctatatgccttgggtatccatccccaaagtaactggttatggaataaacaatgcaatg

SEQ ID NO: 687741 - DNA, 153 bp, Homo sapiens
atggtgttagcgtgcggctcccgagcggggagaggctgggcggagttgggggcctggcggctggggcctggttacttggttgacgtgcagagctctctactggggggctgcagctcatcttggggggcgctggactcagatgcccccgtagtg

SEQ ID NO: 687742 - DNA, 131 bp, Homo sapiens
ctaacttttatttttttttgcacttgtgcagataactttattaccataaacatatgaatactcctgaatagtttcccaattctggggcacttagggagcaaaagcaaatgtttcaattttcgtttacaaaa

SEQ ID NO: 687743 - DNA, 418 bp, Homo sapiens
aatcccccgtccttagtgcaacctggtggtcccccgtctcccgtggaggtcgaccatacttgatgccgattcttagtgcggacacccgatcggcatagcgcactacgagcccagaactcctgggctcaagcgatcctcccacctcagcctcccgagtagctgggactacaggcgcccaccactatgcctggctaatttttttgtatttttagtagagacagggtttcactgtgttagccaggatggtcttgatctcctgacctcgtgatctgcccatctcggcctcccaaagtgctgggattacaggcgtgagccaccgcgcctggccaggtcgtagtagtttttcaagtatccaagcagatttgtggacagcctctgccctgtgccaagcactggaatatgggggagccccggaggg

SEQ ID NO: 687744 - DNA, 784 bp, Homo sapiens
  misc_feature (545)..(545): n is a, c, g, or t
atgtgaatagacagcctttgttgcttacagcagaagcctgtatagagtggtcttctatacggacacgcgtgacacccaggcagcttcgagacgagttcatgggcagtcatatactgaggggaagaaaaaagccttccgtttcctgcggaaagtgcaggaagccacgcaagcggccgagagttcctccggagcccgcaaggaggcgcgatggcgtgcgcagagaggcgcgcttcccagcctggagagcctaggaacggctggggcgtggcggaggcgacagacgaggacccaaggctgggggttacctagcttggcatcaggacgtgctctgagggtattggagtcgctccactccgttggttgcgatgcttccagagacgctctcatgggacgtgctgcgcgctttttcgggcatgcggcctaggctcgactagagacatctggcaagctcggacgtcgtagctgtgcaatgactgctgtcctgcacactgcacctgccttcgacatggacaatatcagcgaggcgaaagctcagtgtacttggnccgtcacgtttttggctagaccatgtatgtcccgggactcggtgagcttcgtcagaacgtggcagagaagtttcccaaacaaagagggagtgggaccctgctggacccagctcagaggaatctctacagagacgtgatgctggaaaattctaggaacttgggcattcatagattggtgcaactccatgttaaaccaaagaggcaaaccctcagcggatatatctccaaaagaacatttc

SEQ ID NO: 687745 - DNA, 203 bp, Homo sapiens
tccccgtgggcctacgcccgtgctcaggagggacccccagccgatgtttcgtgagtttggtaaatgttcacagtttatccttctgtcattaactcttacttttgacctttgtattgctgattcttggatccccttggtctctgggctgctgatggtcagctctgagactgtggtttgagagcaggcagaacggtgcgttggcc

SEQ ID NO: 687746 - DNA, 161 bp, Homo sapiens
gaagcggggaatttcgaccccgacaccctacacatctggaaaaccaacaggtggcgggtgggggggcgtgtggacttcactgtgccactggggccccagtggcaggggttcagagtctagtcttctggcctcgcttgcttggggtcaagccctcctcagct

SEQ ID NO: 687747 - DNA, 1502 bp, Homo sapiens
  misc_feature (375)..(375): n is a, c, g, or t
atttgtgtactctccccgacatgtttgttgatgtaaccaaacaccgtacgatgggggcttcccggcgcgtgtggacataagccgctgtccctcttggtttgcgttggttaataggcggcgcttttatagatttggtaattttaatacaaaataatctttccccactagtcggaagaattgcgccccctgtgtttgtggcttgtgctatctgcacactgggtgatcaacctttcctggacgtccggatatttcctttggtcccacaggagggacgccagagacgtcttcttttgtgtcgagagaagtcgtgtttgtgcggtaaaaatgtgggttcccaccccggtttgaacgacgtcgttaattttgagcgggttncccccccaccgcgagtggagtctctgggcctgttttcaagtaatttaccctggtgcaaaggaattgggttgaaaatcaaactcgctttaaaaatgggtggggcaacacctgtttagtggggccgtgttttttaccatgtcgtcaaccccagagatttcgtaattttggggcataattataagcacttttctatgtggggcaaaacgtgaagtgggaagaactttttgatcctctcctcaccacagcggagccggtgtgttgggaaagtcctaaatggtgtctgaccccgcaccagagtgcgccccccgtgctgacacaaagtggggtttcggctccccacacatgttgaagccttggaagattttggcacacctcgaggtgctaatatcccccggtaccctcgcagacttcgaggtgtctctcgagaaataatatctctaccgaggtaatcttgtttcgtctgtggaccctcactatgccgtggacctctgttctctcttatttctctctcggggtgctacccctttattttttatccgtgaaacacttctttcctggtggtagaataatatgtcggtctatctcttttgtatgagactggatacacagtgggaatgtggggaaatacgcaaaaggggggtatttgctcacaaaggccacactgagtttactgtgggtgtgcagggaccctgcgtctgtgtaacacactttcttttgaaagatacatcggttctctccctgaaaataaatgctcttagaccacaacagtgtcttgggagatatagaagagtctctctcacggtggtgcccaccaaggagtttacgcacataaaagattataatgtcttgggatggagattatccactttttacaagaaggtttcagtaggtgtttcttgttgctcactaattatcttcttgcaccctaactctcccagaatacattgtaaatgcacaaaagtggcacgtaaatgagtttggtatgtatttaattttgtggtcacattgttctctcttcgagttaacttgtacttcttcagttatatagcttaattagaggggttctcgtaatgtttttcaaatatgtgaaatgtgaaactgctgtcttttatatttttagtaactta

SEQ ID NO: 687748 - DNA, 179 bp, Homo sapiens
gtactaactttcctattgctgctgtgacgaatgccacaaactcaggggctaagatacgagattcagcgtcctaaagtgtaggtgtcagtgtcccatgctcccacgggactgtgggggagtctgcgcttcctcaccgcttccagcttccagaggccactgtgttcctcggcttgttatgc

SEQ ID NO: 687749 - DNA, 509 bp, Homo sapiens
ctgcggaccctttatgtttgctggcgagcagacaggccgtgggaagccacacagacgaaaggcagggggaatcatcatccacaaaatccctgttgctcaacaccacactgaagaggaagctagagtgccaatttagagacaagagagatgggctgagacaggggatgagatgggacaggatggtggggatgaaggcaagagcacactttccagcagtggtcatcaccaggcccagctgacgagcaggaccaggggcaggaatggaatgagagaaaggaaggaggtcagagtaaagctgagaattctagattgagaaactatgtggaggtaacacctgtgcaggaaccatgaaaggaaaggctaaaaaaggaagaagactagagggaaaatcaggacttccatttgacactgagatcggaggtgacatccagacacactgcagtgaagccgtccagcaggcaggtgggcgcatctgtgtctgagcccaggcaaggggccaggcaaacatc

SEQ ID NO: 687750 - DNA, 312 bp, Homo sapiens
gtgtcgctctttggcccaggccggattgcaatggcgctattttagctcactgcaagctccgccttctgggttcatgccatactcctgcctcagcctcctgagtagctgggactacaggtgcccaccaccacgcccggctaatgttttgtatttttagtagagatggggtttaactgtgttagccaggatggtctcgatctcctgaccttgtgatccacccgccttggcctcccaaagtgctgggattacaggcgtgagccaccgcgcccagccgacttttcatatatctctacatcaagtctcacctcgtgc

SEQ ID NO: 687751 - DNA, 659 bp, Homo sapiens
gcccgtgaaaacagaagaacagcaaaaaaaagaacagaacagaagcaaaacagcaaaaaaaaagaacacaccaacaagaaaaaaaaaaaaaaacaaacaaagaaagaaagaaaaacaaccaagagacacgaaacaaaacaacaaagacggcaaacaaaaaaaaagcaacacgacaacacaaagaagaaagaaaacgaaacacaaaaaaaaaacagtacacaacaacaacagacaagaacgaacaacacacaaagaacagaaacgacgagaagaaaacaaacaaagagaaagaggacacagcacagcagaacgacggaagccaaagaagagaaagcagagaccaaagagaaagagagaagcacaaaagagaaagaagaaacggccgaggagacagacgagcgagacaaaaaaaaaagaaaacgagagaggaggacaaagagaggagggcagcggaatgaacggacaagaggaaaaagggacaggggaggagggagggagggaggtgacggggaggggggagaaagaaagaagagagagaagcagcagagacaggagagagagaggaggcgaggagagagaaagagaggaagagaggaggggaagagcaagaggagagggggagcagaaggagagagagagcgcgaagagcgggagggaag

SEQ ID NO: 687752 - DNA, 107 bp, Homo sapiens
aagacatcctaagctatgttgaggagggagaagatctgagactcaagttctgctgttaaccatgaggtgatttagtagctaagtacgccttagccttttagagtctt

SEQ ID NO: 687753 - DNA, 533 bp, Homo sapiens
  misc_feature (487)..(487): n is a, c, g, or t
aggatcactacactctggtgacgtggcagagactcaccagagacggtgaaacgatcagtcgagctaaaatatcgtgttgtatcacggtttgctccaaatgaagaatattcttcttgttatgttcccaatttttgctatatcatcctgttctggggacagtcaggtattaaaacactttaatatcgatccggtggtatggctgagaaaacaattgctttacttgtcgctggtactagtgatcactgtcattgtcgtagttggagccattctttacgtcccaggtgaatattcattagagaatgctactggccgtggtttaacagtgagttctacagggatattaatatgacttcactagtatgtgtttagtacagcgataggattaacctccttcgtcattgccatattggttattcaggtgatagcctatatcctcgctgtggttggactgagtctctgtattgcggcgtgtataccaatgcatggncctcttctgatttcaggtttgagtatcttagctctagcacaattac

SEQ ID NO: 687754 - DNA, 677 bp, Homo sapiens
  misc_feature (164)..(165): n is a, c, g, or t
agcggatggtctgagggtcagccgtgttttttcgtgctcgctagtcgccgccgccgctccgccatggggaagcgacagcaccaaaaggacaaaatgtacattacctgtgctgaatacactcacttttatggtggcaagaagccagatctcccacaaacaaattnncgacgtttacctttggaccactgcagtctctctctgcagccctttgtctacccagatctgcactcccgatggcatcgtcttgacgttacgtgaacattgttgccatggacttaagaagtacgggaccaacccagaaatggagagaagctggacgggaggtccctgatcaaagctgaacttttccaagaacagtgaggggaagtaccaatgaccagtgcttgtttaccagagttacaccgaacaacacccacaaacgtggactgtgagagacgaaacggcgaacgtctacagcctatgaggcagaggcaacagctaaatatcaagggcaagaacttccgggacctgctgaccgacgaggccttctaccggcaggacatcatcaaccatccaggaccccaccaattcgggacaagttcaaacgtctctaacttctatcatgtgacgaataccatgaaaatacatagaccccgatgacgagacggccacacaggaccggtcttcattatctgaca

SEQ ID NO: 687755 - DNA, 121 bp, Homo sapiens
ctaaagtaacccttttttcaggtatttggtgtcatgttttggagttaatatttagtgcttatatacttttgagttattacataattgcgattggtatatatttgataggtactaggtattg

SEQ ID NO: 687756 - DNA, 302 bp, Homo sapiens
  misc_feature (87)..(87): n is a, c, g, or t
cctcttagtgactgactataggaacacctagaattggctcttgagaaatagagatagttgtaaaaacctaaaaaaaaaatttttaanccagtgaaaaacaaatccagccaaaataaaattgagttatggccgggcatagtggctcagtcttgtaatcctagcattttggaaggctgaggtgggaggattgcttgagctcaggaatttgagaccagccagggcaacatagtgagaccctgccactacaaaagtaaaaaaaaatagccaggcatggtcgctcatgcgtgtagcgacagcaggca

SEQ ID NO: 687757 - DNA, 684 bp, Homo sapiens
gaattactgcagtgggcagtgccctccccagcctggctggcagaccagagcattgctgcctctttccattctgtccgtcttcagtccttcctcaaagcgcaatcaatccttggcctgaccaggtaccgtccgtgttgtgttccactatctgcccgtaaggaccccttctctctccatcgtacctggaatcagtaatggcagatgctggtcaatgacggactgtgcccagtatatggttggtggagggctgtgaggtcgcagctttagctcatggtaggaccggtgggtgcttcttgagcaggctgcagaggcagggaccccagagcgaatgtaaaggttgtccactaggagcacactcacgggacccagtcctctggtgcacctcggtgacggcagatcgcacgaatctcacatggaatccgaacaaccctcaagacgctctagagcgagagcctcggacgcgttgtggcgaaagtgatttgaagcttccaacttcttgaaaacgcgccccttaattggagagcaaccctccgaaaagagctggcagtgaccatcactctttacttgtgtgatccctcaggacggcaacttccctgcggccttctatatttcaccccatgggggttatacggcgcccttaggacgtggtttagtttgggggagaaggcaatttgcgggttcaag

SEQ ID NO: 687758 - DNA, 378 bp, Homo sapiens
ttcttcttccacatttcctggaaatgacatagaagtagtaagaaatagaataaatcttttctttttgtgagactctgcctcaaaaaaaaaaaagtaggccgggtacggtggctcatacctgtaatctcaacactttgggaggctgaggtgggcgggtcacctgaggttgggagttcgagaccggcctggccaacgtggaggaaccccatctccactaaaaatacaaaattagctgggcgtggtggtggatgcctgtaatcccagctactcaggaggctgaggcaggagaatcagttgaacccaggaggcggagtttgtggtgagccaagatcatgccattgcactccagcctgggcaataatagcaaaactccatctc

SEQ ID NO: 687759 - DNA, 323 bp, Homo sapiens
aattcctaggaaatataaccccatctgtgagcacgcattccacctggagtgtgtaattatttgcaacatttgccacatttagtccctctgggtattcacacccttttacaattcacgccctcttctaatacagaggtagactctattttccaactccttgaatatgggttgcctttatgacttgcttcagccaagcaaacatggcagaagtgaaggtgtactagttccaagcctaggcctcaagaagccttgtacaattctgttctctctctcagaaccatgcatgccatgtgagtaagcccaggctgacctgctgaatcatg

SEQ ID NO: 687760 - DNA, 801 bp, Homo sapiens
  misc_feature (5)..(7): n is a, c, g, or t
  misc_feature (12)..(12): n is a, c, g, or t
gaggnnnaccancaatcacttcaaccaaacaaaatacccgcccttaccacctttttcaacagcaaacaacccaacctaaataccacacttacaccaccacattgaaccacaataacatctacaacataactccctctacaaacattaaccaaaactatttattggggggccaccttaatactcacacacccccaataaataacaacgccaccatttaatcgaccgattaacagctactctacatcattcaccaacacccaatcacattatatccccaacaaaaaaacaaaatatattattaatgccaatcatacgattaccccaaccctcacccaaaattttcaaaaacatactcacgctcctttccacattttacaaatttcactcgcagtcctccccaccaattaatcatttccccaaaacaacacacaattttccctaaatatcccttatttaaacaacacacccctactaccccagaatcaataatacagggcggttaacaaacaagtctcaccttttccctaaaaaccgaactcttccaagtccccacatacccacaaaaaaaacacctcccttaaccccatattcattctacattcaaataaaccacccctctttacccagacattcctaatctaacccaaaaaactacctaccacactactctatatgtgatacaaccctcgtgaaagattcattattaaaaaaggtaattattttaaaactccttataatccacctcattatttttaggcaaaatatatacatactgctcatacgtcccctaataattataac

SEQ ID NO: 687761 - DNA, 625 bp, Homo sapiens
  misc_feature (86)..(86): n is a, c, g, or t
  misc_feature (199)..(199): n is a, c, g, or t
  misc_feature (201)..(203): n is a, c, g, or t
  misc_feature (234)..(235): n is a, c, g, or t
  misc_feature (243)..(243): n is a, c, g, or t
  misc_feature (266)..(270): n is a, c, g, or t
  misc_feature (300)..(300): n is a, c, g, or t
  misc_feature (322)..(322): n is a, c, g, or t
  misc_feature (326)..(330): n is a, c, g, or t
  misc_feature (334)..(334): n is a, c, g, or t
  misc_feature (336)..(336): n is a, c, g, or t
  misc_feature (342)..(343): n is a, c, g, or t
  misc_feature (349)..(349): n is a, c, g, or t
  misc_feature (351)..(351): n is a, c, g, or t
  misc_feature (360)..(360): n is a, c, g, or t
  misc_feature (382)..(382): n is a, c, g, or t
  misc_feature (397)..(398): n is a, c, g, or t
  misc_feature (401)..(401): n is a, c, g, or t
  misc_feature (409)..(409): n is a, c, g, or t
  misc_feature (411)..(411): n is a, c, g, or t
  misc_feature (413)..(413): n is a, c, g, or t
  misc_feature (415)..(415): n is a, c, g, or t
  misc_feature (421)..(423): n is a, c, g, or t
  misc_feature (430)..(431): n is a, c, g, or t
  misc_feature (434)..(434): n is a, c, g, or t
  misc_feature (456)..(458): n is a, c, g, or t
  misc_feature (463)..(463): n is a, c, g, or t
  misc_feature (472)..(472): n is a, c, g, or t
  misc_feature (475)..(475): n is a, c, g, or t
  misc_feature (545)..(545): n is a, c, g, or t
  misc_feature (611)..(611): n is a, c, g, or t
ggggacccgggggctgcgggcgcgcgtccctgcggcggcgtccccggggcccgcgtcccgtgcgcccccgcgcccgctgcgggcgnctgctccctccgccgagcggcgtctttgtgtgcgggggtgtgggaggcgagcgcgagtccgcgcagccgccgagtgcccgctccctcccagggcgggtgggggcctctccgcncnnnccgccgccgccgcctcgcgaggacgcccgtnncccgcgcngcccgcaccgcgccgggcgcgcnnnnncgcgcccgcggccgctcgcacatgcccganccgcagccccgcgagcaggcancgcnnnnncccncnccgcannccgggncnggctaaggngtcgtacctcctcccggccggnggccgcggccccggnncgncggggggngncntnggccgnnncgcctcnncangaaggggccgaggggaaagaannncggantacctcggnagnacaaccggcaccgcgagcaggagaaggagggccgcgcgggccaggcggacatcgagcagctggagtcccngcggccggacgccccctgcacctggccaccacgctgggggaccttgagtgtgcccgcgtgctcctngcgcacggccagac

SEQ ID NO: 687762 - DNA, 189 bp, Homo sapiens
  misc_feature (138)..(138): n is a, c, g, or t
gactatccacatactctcggtccctcgatgctcttagtgagtgtccgcggccgagcgttatttgaaaaatgagtgtcaagcaggccgagcgctgatacgagctagaataatgaataggaccgcgtctatttgtggttncggactgaggcatgattagagggacggcgtggctttcgtattgcgcgctag

SEQ ID NO: 687763 - DNA, 161 bp, Homo sapiens
ctactatgcttcaccaccctcaccatcacccatccttaacatctacattctacctacgccatatattacaccataccccataccaggacaaggatggattattagcaagttccaacctgagaaaggccatcggactttgtcaaggcatgtagccaacatct

SEQ ID NO: 687764 - DNA, 325 bp, Homo sapiens
ggaagcagttaaaaccttgaaagaaacaaaaccctttcctcaggatttttattaaggtgttatttaaggatggttccttaaagggtttaagaagcagtaagcaggcattctaaaggccacacatctatttatatatactataattccacctagatggtacacatctctcagggggtttcatacgtgtatatagctacatccacatcatagttgtaactacgtataacgcagatctgtaattgactgcttgcttgacatacacattctgccagccttacagagtctgcacatggagatatctcctgtgctccagtaatggtctcga

SEQ ID NO: 687765 - DNA, 491 bp, Homo sapiens
  misc_feature (107)..(108): n is a, c, g, or t
  misc_feature (118)..(119): n is a, c, g, or t
ggtgagggatcacagcttagcatgggtgagagatatttaaagcacagggagattcttgtcacattggggtctccaaagctagaatggatttcatgtgcttgaaaaanncccttttttnngccccaaggggttttaaaagaaatccaagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccaattaaattagtt

SEQ ID NO: 687766 - DNA, 292 bp, Homo sapiens
acgccgcatgcataagaaagcaggccaaaagctgcttacagaggcttgccctcaagcgatatgagggcactgccctccagcttctctgccaggctgcagcgtaccttgacctcctcgtagcagtttgcttgcaattcatgcttgatccctgtcagctccttcttgatggcgcccttggagctgtcataaatcattttgctcttaaggggcgcagactcggtgtcccaaaagataaacaccagatcctccttcttgctctccttgatctcataggttgcatcatagagggcat

SEQ ID NO: 687767 - DNA, 330 bp, Homo sapiens
tgtggcatgtacagcaaaactacctgggtgtagctgttgaactattaggaatatgtcatagatctggtccttgaatccacggcttaacattgcgtcagcttcatccagtacacacatctatgatgtactcagagggacaggtatctccggttaagcatatcaaacacacggccagagtgtacccacgatgatgtggggagcttccatctgcagttttctgcacctcagcacgcacgttggtgccccggatacaggcgtgacaggaggcgcccatgtagtctcctagtgccatgaccaccttctgtatctgctgagccaattctcgagtgg

SEQ ID NO: 687768 - DNA, 341 bp, Homo sapiens
ggccattatttgatttttgtacgaaaaaaagctttgttataaaaatcagcaaactatttttttaaatttggagagaaaatattttggtgactgaaagtatggtcgggtgtcaaaaataaatgggcaaaagccttcttgctgtcctgtcggtttcaggacgttccctttaaagctgctggcaaaatcgaaggttccttttttgtttgggtaaactctaatttctatcaaggggtcatggatttttaaaattagtatttcattacaaatgtttcagcattggttaactaatttttgccaggcccattattgatcaagcaaataaattccacacccctttggga

SEQ ID NO: 687769 - DNA, 229 bp, Homo sapiens
ttttgttgatacatagcttgtgagtgaatcagattactgtttagaacttgtccatttatttgaagtctactaatacgtttgaaggcactaaagtttcttctcagattcttcatttggaatcaggacctgccatggttgtctgtcatctcaacagttaatccttggaaacagttttatcgctttatttatttaaaaaaatatatatatagcctttcaaccaaaaaaaaaa

SEQ ID NO: 687770 - DNA, 1035 bp, Homo sapiens
atgatatgagccctcgtcgaggacaactccccctcctcgcggacgaggcggcgctggtggtagcaggagctcggaatcttcctcttcctccaccaccaccacctagagggggagacctcatgggctatgacagaagagggagacctggagaccgtgacgacggcatggttggtttcagtgctgatgagacttggcgactgctgcaagtagatacgtggagcccatcacgcaatggcatgatgggcttattgaaccacagggtggctccggatatgattattcctatgcagcggtggtcgtggtctcatatggtgatcttgggtggacctattattactacacaagtaactattcccaaagatttggctggatctattattggctgaacggtggtctagccggattaaacgaaatccgtcatgagtcgggagcttcgaatcaatcacttgatgagcctttaagaaggatccgaacgatcggatctagttaccattacaggaacacaggaccagatacagaatgcacagtatttgctgcataacacgtgtgaagcagtatgcagatgtcgaacggagttctaactgcaagatatgtttgctttcttatagtgtgcagcaggattctggcaagtttttctaagactagtgaagacctgaaggagccctgcctctttatgggatatctgccttgcgtgtaggacgccaagattcctccgcgtcataggagttccgcgatttgaagggtgcgcgccctgtttggctgtcccgcaccagttatggtttccgttcccttaccccagggtgggcggggggcaggctgccagctaccatggaaacttggagcccgcgagggatgcttactccggcatgggggggtaaaatcccccctgttttgtggaccgtgttgcggccgtcctcgtggggggccggccggcgatatccgttcggctccgcacggcctacgtctgcaagcgtcgacaaatccggggcgcgtgtggtgtgcccccccatcgtcttttgtctcgttgtcctctct

SEQ ID NO: 687771 - DNA, 351 bp, Homo sapiens
atctggttccgcaaagtgtttttgaggatcagattgttgaactgaactgacaatcagatttcactgccacttgctgtattgggatgattaagacacattcgtgtagcttcaaaggagaagcataagctttattagtcataacttaagatttacttccttccaaaagctaagcacttctcaccatgggcattttatttcatctctcatgctttattatgtacaaggcataggcacttaatctacttttaaaaggaaagatatttccaagtctgtgaagcaagttagaagcactagctctatcctaatttcaggcagggacaaagtcccaatttactggggttccatgtaatg

SEQ ID NO: 687772 - DNA, 345 bp, Homo sapiens
caactccagggaaagcagaggccaccagggtcctcccaaggcagtgcccggtgcaggctgagaaaagtcatggggctcccctggagtaagtcacggggctcccctggagtaagtcactgagcctttcctgcagaatgtttggttccaccctaaaaccacagggatgatcactgtcagagtgaataagacagcttcacagtttagacatggcctacctgtcctgcctcttcaagtgtggaatgtataccactgatagcccttgaaatgattttgggtagtgtgggacatgattttcagtaggacacatgcagtatttaaagaccattattctcagctgggcacatg

SEQ ID NO: 687773 - DNA, 194 bp, Homo sapiens
actacatacttccgagggcacgggattcaaagttaacctggttcggtgataggcaagcacagggaagacctgtcagagggcttagtaaggcccattgaggctccaagggtgagggcctggtttgccgttcgagctcccttgggtgaccatgcaagaacttcattgtgctgagggaaattgtaccctggctgacg

SEQ ID NO: 687774 - DNA, 1027 bp, Homo sapiens
  misc_feature (1027)..(1027): n is a, c, g, or t
tgcatgctgctctggcaatttaatggattttaaatgtttctcatttggatttttttttaggtaggcatgtatggattataatttggtatttcaatatagctgggctactttaaaaggtagttcgataggctgaaattacaaaagataatggaagcacttttcacaagtggttttatttctgcaacaatgaataaaaaggtaagaactctaatttatataaatgaactatatagcttatggggcactttagtgaatactggaaacaaaatactaaaatgaagagttaaggttcgttctcattacaaatcaagagttcagcgtgtgtgtgtgtgtgtgtgtgtgtgtgtgtgtgtgtactctagaggggctatagagaataataggccatggtctactgggcaaatagagataagagaacatctttaatatatgtgtgtgtgtacatagtgtgtaatgtagatatagagagagagagacacggagagacagacagcccagagagagacaccgagagaaagacggccccaaggaggaaggcctatgtccgggaaacagccacgggggaaccccaacggggccctgggaacaaacagcgggcgaggggacccacttacaagaagaagattcacacacatggcgagaagatataccaacgtgaggaaccccctaggggcgcgcaaaaaaccctgaaggggtgcaccacatgggcgaaaataggggcacacacccaaaacaacacgagtccgccagagacatcaacaagcagggaggaattgactgcaacaacaccacactggtgcacaccacaacaagcgagtacagaaccaccacacatactatacacctccactgagatttcttttgtgttctttgcatcacacacactcataaccagaagactcgtcatcatcacaacacacacacgcacacgacaccccccacccacacacaccccagcaaccacccaccaccccaccacacgccacgcacaccaacgcaccctcccacacccaccccaccggtggtn

SEQ ID NO: 687775 - DNA, 132 bp, Homo sapiens
  misc_feature (56)..(56): n is a, c, g, or t
  misc_feature (99)..(99): n is a, c, g, or t
agaccgtaggccaaggtgatctccctcttctattgggagaacctctaatttctttnccaccctctcaacaagcccaataccccctccaagttcttcttnctgctgagggctgtaggaccttattgaaagctt

SEQ ID NO: 687776 - DNA, 764 bp, Homo sapiens
gacaatgaaccgatatctcctctggccgtccattattttctgaagcagatggttcatcatgtcctgggctgttaatcaatgcgaggttatggttagactcttgggatactcagcatagatttatcatagcttattagggtgcagaaggagaaatgaatagggataaacctcgctagatatcagtttgtgagtgtaaacagttatgtattaggtaatcagattgatcgccgagaagggctgagaatagtgtttgacgtcatgtaatgagcgtgagaagagacagacgcatatctgtgtatttggaaaacatagattgtaacagtaatatgcggccgcaatttagacaggagcatcgtaattttggactctgtattactatctcgtaaatgcaattttatggaaacatttaagtgaggtttacattatttctcgtgacattgtatatcagttcttaatgtccatattcacgtgtagaccaggttcggctggtgattagggttagacaagaggtcctaagttactagggagaatgagatgcagtttcaagtgtagatgcagtaaagcagagtacgaactgagctgtggcctattctaggtagttccaaatgagtgattgttgtgtcgaactttatgaatgtgtacttaatttggaaatgttgtctctgagtaagactggagtttctggattatgatccggagtattgtcaatgtttgattacgagaaggtctttttcaaggtttcgggaagtgggtgttgaaccttt

SEQ ID NO: 687777 - DNA, 364 bp, Homo sapiens
catcatcaagcatccatatggtagccagcaagaattacggttgaactacaggtcctccccgggacatggaagctaccttctctagggggcagagataatccgaaaggacaatgtaccaagtacagcgagaacatgacatggcatgaagtgggacacaaagggcttgtgatggccacactacctccttgctgaggatgtaaaactgggactccacctactggagaaaacatgaaggaacctggcatgaacactgaacaggccaccgccgaacgtcatcccgcatcaagcctcggcacaggggcccgaaggtatatattccggcctcggccctatccagactcttgtggaacatctcaaagcctgt

SEQ ID NO: 687778 - DNA, 416 bp, Homo sapiens
catttatttatttatttatgttgagacaagggctgtactatcacccagagtagagtgcagtagcatgaacagtgggtgactggagcctcaagcacaggggactcaaggcatccttcctacctcagccttccatgtagctgggacaacaggtgtgtgccatcatgcccaggtaatttagcgatttgggtatcaatgaggtcttacttcgttgcctaggctggtcttgaactcctgaccgtcaggtgatcctcccgcgctggtctcccaaggtgtagggataatagacatgagccattgtgcctggctggagctgtgtggtattaaaagtttattgtagcaagaacaggcagaaggccagattagtgccggtaagtcatggcttatggacgcattttctagggcagcttccactaacg

SEQ ID NO: 687779 - DNA, 374 bp, Homo sapiens
cgacagagcattctgtgcctggcagacaggccaagtacctacctagggcttacatctacttgacattttgttgttcagtctgtggttgactcatctgtttgcttgttacagatgtggctttgtctaaatactttgccattttacttaaactggaatgtgtgttctggttttgttggatgtgatatgctgggtcaggtaacagtgaaccctcacctgtgacatctcatgtttaccctgtgcttgtgctgtcttggctcctggaggacttgcctgtgtagtgtcctcgaattgagcaataggagaactgataagagcagagtggcattgctcatggacacctgtccttcatctccatctaggcagggacccactcg

SEQ ID NO: 687780 - DNA, 283 bp, Homo sapiens
gagtaagagtgtcaaaaggagcatttgtgtaatctttcactccagagattttaatctccttaatagaaagtgttgtattgatgaatgattaacctttattaagaattttgtgtctcaggcactggattagtagctttacacatttcatttaaatctcacatttgatagcttctactatggttattattttacagaagaaactgaagttaagagaagttaagtagcttgttgaaaatagcctgcctggccaggcagggtggctcatgactgtaattccaacact

SEQ ID NO: 687781 - DNA, 259 bp, Homo sapiens
caattagcagggcactggccagagtttgtaccctgtgttttaccttaacaaccttctatttgctccttgtatatttaagtgtcgtaaggaaacgtgtttccatctaaactgcccatgagattaaggttatagctgtggcttctgtcatattttatcactaacacttatcgtatctctgtatcatggcgatgtatgtatgcatgtcagtggttttgtcctgatgttgctactcccctggcaaagcccaaaaaaaagaatg

SEQ ID NO: 687782 - DNA, 553 bp, Homo sapiens
ataagttgaccaaccagaggagaggaaagggtaggcagcaagggggtctgtccgtgaatctcgatcctgaaggatgttcaagcccaacggtgaactgcagtgtccacagataaagcctaatgggtgatcttagatgtgctcgagtgaccagaaaaaaaaaatcaaatccagcttattattcctttggtggggaggggagaggagctattgaccatgatagttccaatccatctgagtattaagtccttctccagtctgtaaggtaaatgcatctccatccagtcaaagtgtgaacagcatccggttccctcattgaaagttaggccacaggagattccagtcttagctctgctggtgtgtgcaagcaaactgcatgtcttggcttgcatggcacttccttcccctccagggcaggcctatacccaaaagccttggggaacagttccagcttcagctaggtaaggtatacatgtacctaacaggtagcccacttggtgccaggctgcaacagccaacacacagtgtcaggtggccatgtcccagagaggcccag

SEQ ID NO: 687783 - DNA, 604 bp, Homo sapiens
  misc_feature (14)..(14): n is a, c, g, or t
  misc_feature (176)..(176): n is a, c, g, or t
  misc_feature (215)..(216): n is a, c, g, or t
  misc_feature (236)..(236): n is a, c, g, or t
  misc_feature (317)..(317): n is a, c, g, or t
tcaggttatcccanttcatagaggcccacggacttaaggccagttcatgcaggaagccaaagatacagatcttcaatgagagaccaggaaaggaccctgagaagccagaggccagcatggaagtgaaggggcagaagctgatcatcaccaggggcttacagaaagactacagaacngatctagtgtttggaacggacgttacctgctggtttgtnnacaacagtggaaaaggattnattagactgggctattacaagagattactccggtggcctcgttgaattaatctaagaggccacgagaacagaattctacantaggttcatctctcgtgctttttttctagttcagattcaccccgtttggaaggccttatttaggtcaggcctgcttatggtactgtttataaattgggttcagattctgcgtggaagcatccatgtggttttaattaagtgcctcatgtgactccaaaatgaggctagaatcaagtataaaaggttcaagatacatacacaagagttaagttttacttggcactaaagggtggttacagggcctgtcctgtatgggtctggtagggacaggacagttgtggcccata

SEQ ID NO: 687784 - DNA, 760 bp, Homo sapiens
tacctttggaattcccccagaagagtcgtttgcaaagactagaacattccagaatgaatgtcgctcttcaataggaacgtctttattgtgctggaagtatgtcttctctgggtggtaattcttaaattgacagagtcattgtgaggctttctcccctcccgctagtatcgtttacaggagcagggaagagcagatagaggatgtataatttagggcgaagttggaattacaatttgatttgaggttattcctaaaccgtatttatttggtgtttaggaggagatcacatactaggagaacgttgattgcactcggtctatcgtgctggctggacacttgggtcacttgtgaagcatgttaataaatgtcactgattaaaacagctggagcatttccttccctttccagtgaaggagcagcatagtgaaatcctggcacccctcacctttgtgtgatgacaagatggctgacagtcacggagtccaggagcaaggtgctgctctccttgctttctgagtaaacagagtaatgtttcgatcttattttcccaaagaaagaaacagggggaacaatatatcggtatgtctagaccagccaaattctgtcattattttagtatcaaccttgctgtatattagagcaagtgaatatactatggaataaggtttgaccaggtcaagttgaggatatagttgaatttcttttaacaacgtttctatgtttatctaaaaatctttcttattatatctaaattagaatg

SEQ ID NO: 687785 - DNA, 213 bp, Homo sapiens
ctcggccctgtctctgacttaggctactatgggtgttaattttactctctctacaaggtttttcctagtgtccccgagctgtgcctctttggactaacagtgtggttttccacggggtttaagggttctgtgggcgaatttaaagttgaactaagattctatcttgggcaaccagctatcaccaggctcggtaggtttgtcgcctcgtgcggg

SEQ ID NO: 687786 - DNA, 165 bp, Homo sapiens
tggaaacaggtctggctggtgtggcccagttgggattgcaggggggggatttggactcatggtagcctcggccaccgggattcaagtgattctccggcctcaaggtcctgagcagcggggttaacaggcacgcaccattacaccgggctaatttgggtatggtaa

SEQ ID NO: 687787 - DNA, 152 bp, Homo sapiens
attaccggtttttgggggggccccccccccccgggcccgggttttctttttttttacccccccccctggggccccgggcccccggccttttgggttttaaaaaaaaaaaattagaccccttttttcccccttttgtttttttttttttttta

SEQ ID NO: 687788 - DNA, 296 bp, Homo sapiens
acttattttacaagatacaggcttggggtctaatcagagctacagctgccagcatacaccagagccacagcaacaccagatccaagccatgtttgcaacctacaccatagcccatggcaaccctggatccttaacccacggatacccccggggatcaaactcgtatcctcatgaatactagtcgggttcattaccgctgagccacatcaggaactcccagaaacccttctatagtcacccagaacaagctttggaactagatgaccttgggtttcaggtatcttgtaaaataaata

SEQ ID NO: 687789 - DNA, 211 bp, Homo sapiens
  misc_feature (133)..(133): n is a, c, g, or t
catgatttataattatttaaattacttattataaaataagacacagaagtgctgttgggttttctggcatgagccctttggattctgtgtttagcattcagatcattctctgggccactttattcttacacanaccttttttttttttttttttttttaaaatactccaggtcctagggtcccgtgtgcccaacgcgcgggtttggtcctt

SEQ ID NO: 687790 - DNA, 781 bp, Homo sapiens
gaggtgcccgcgatcacacccaggtaatttaactatcttgttagtcactgcctgggtaatcttcggtattttctgaagtagagatggggtttcaccgggtgaggccaggaatggtcttccaatcttccttagcctcgacaatccggacgcgaactcagaccatcccaaaggtgtggggattagcaggcgatgagccagcgtggcccgggactatagaaagtcaatctttttgacgtcttctcacttttatctcgccatgcccaaggttgttctgttccagttaacagtcactcccttcccccttgctaatcagaagccatgctcctctcagtgtcatgatctctgctcgtgtcagtacgatgattacagtcatggggtagagagtgcttgctaaattatgcagttaatcctatggtgctgtaaattttcaggccttcaaaaaacagttgtacagagatgtgcagattttaaacagttgaacttcctggtactacagtttttgtattgacagccaaattgtctttcattcttcagacttgtgaataaagtgatttttacagggcttccagacaaagttgataccctttcaatctaagggcttgtagaacctagcttatatagactgcttacatgagaaatgcaaaatctgtattcacaatgattagtaacaaaggtaacgtttttagttagtggccaggcaggaggacaacttggggggagaacaaagtttggccaaatggggttccggtgattggagggtcctccgggatggggttttaac

SEQ ID NO: 687791 - DNA, 101 bp, Homo sapiens
gacctagagtatcccaatcgcacgaacaaggagctgatacatcacctagggcagcaagctggggaagggaagtggctgtgcattgctgtgtgtcctttaag

SEQ ID NO: 687792 - DNA, 237 bp, Homo sapiens
atccggcgagtgcatggctacgaagtaaatggtggaccatcaaaggcaattgcaaccataaggatgtttcgttccctgatggaggtctgtcgggagaaatcagtgttcttttagtctacccatctcccttcagtttgataaatggtcttagaccggtacatgagaaccaaaaaaacaacccaaggcgttttggaggaataagatcaaggatctggcaggttccgaacagataatacc

SEQ ID NO: 687793 - DNA, 140 bp, Homo sapiens
agaccaagaaggcacgcaaagcgccaaaagctgcacgtgcagtgacccaggcagacttcgaggggtacgggctgcaagaccgaacggcccacgagagcgccaaaccaaagaaacatggcagcagggccatatgggaggcg

SEQ ID NO: 687794 - DNA, 105 bp, Homo sapiens
gaaaccctaataacggatagtctagaaagtgttgtggaaagaatgttatatttactcctacgaatataattacaaagtgaatttgggctcatgcttggttgagtg

SEQ ID NO: 687795 - DNA, 196 bp, Homo sapiens
acattgctgcccagtgaagaggcgggcatgacacagcaagacgagaagaccctatggagctttactatattaatgcaaacagtaccataacaaacccacaggtcctaacaataccaacacctgtcattcaaaaattatcggttaggggacgactcgagagcagaacccacacctccgacgcagtacatgctcaaga

SEQ ID NO: 687796 - DNA, 482 bp, Homo sapiens
tcgtgaccttgtcaccgaggctttcgcattttatcgccgatatcatgccctctgagggccactgttcttgatgcttagcctcacagtcgacgtagacctagtatgccgtactttgatagcagatagcctatgcacaatgcggcatccgaggatcactgtgagtgaatgcactggactatcctgactgagccgttcacgtagattaatcctgactcagacatccggaggttcattcacgctgactcggacctcttcacttactcttgcttgctgttgtgcatgatcattattcattctggtactataagaactgtgcaatttagagaacgcttggcttctccatagtactgcaattgtatttgagccccctaacgctctctgtcgattgtcacagatccttcgtctcatgtccgtcttcccacccatcagtcctgactccgcacctgtctggctttacatgtcctagaccgttatgccactcc

SEQ ID NO: 687797 - DNA, 975 bp, Homo sapiens
cacgcgtcgctcgtgctagaatgctcagtcagtagtgtgtataagcagcagccggaagtgactgcttacagtgtgtagtggtgagtgctagctggcacccctgcgcctggacttcccagacactgtaacgcaggtgcaggagaggcagcgagggctgggtccccacggtggccctggcatgccccgacatcacccatcccctgacactgtgctgctccctccatcatggatccctgaccctcagcacagctggagagagacccgctgggcaccttaccctgaaccgtacgacagatcaatcaaatgaaacacatgcagcagagataagatgagatgatagaaaggagagcacaagtgagactagagagacaataaaacaacaaaaatgtagcaaaaaaaaagaaggagagaagaaggtgatactaagataatgaaagagagcgaagagagagtaaccggagggaattagtgagtgtagataggcaagaaattgaataagaaaatagagtaaaagatgtatgagagaaaacgcagaaaaatcgagaaatgataatacaaagaagaataagatagatagaaatgataagagtagatagtaaaatagaggaataagaaaattaagataagaataaaataagagatgatagaagagtacttgagaatacgattaaggcatcgagacggggggaacgtgggggagcctaagacgaagaacagtagacgagcgagaagaaagagaggggaaacgagcaagagcagggagcgggagggactgcgataacgaagagaagagaggagcggcggaggagacagcgcgaggagggggtctcgagggcacaagaggactgaaggcgacggcgagtatacagaagagagagcgaaatgagagtgacgagacgtctacgatgacgcaagagaaatagagagggagcaggagagacagaaggcaatagcagagaggaggaggagagaggg

SEQ ID NO: 687798 - DNA, 677 bp, Homo sapiens
gggcacagtggctcacgcctttaatcccagcactttgggaggctgaggcagatggatcgcctgaggttgggagttcgagaccagcctggtcagcatggtgaacaccctgtttctactaatacatacaattaatttagccagttgtggtgtgcgggcctattatacctcgccataggctatatcgtcggatgagcgggatgaggtgcagaggaagatattcgtcttggacactcatcagatgagccgcagagcgaagtgcatgacgacgccagagtaggtcggctccgcatgtgacatcttacgatctgctggtgtatgagctgaactgatgatcttcccacgtcctctcaaacaaaaaaaagaaaacacatatttggtggaggagtatatttaccactcctgagtatggaaattgagctgacctaccgcccgagtgatttttgcgtaggacgaaaactgactcccaaccaggaaagtgtggggtgccgcacccttaaatttgttcgacccgcccaccgagggtggatcaccacccccgatgttggctcgcacacgtgggtggatcagtgaatctttccaggcagagagcctcatcacaccacagagtcagtcctcgcattgcgtggtccacgtatacatcggtgagcgtcccaagcgagtgggagtgggatactacg

SEQ ID NO: 687799 - DNA, 364 bp, Homo sapiens
tgggctccgcttgacgagagacgcgacaagatgcgtccgcgggtcacagtctcgcgcaacttgcgcgcgcgccggcccctgggagccagccgtgcgctgaaaccaggcgtcgggctgggagagggccgggagcgtcgcaggtggcgctggcccggatctcccgaccccaggaagggatcccggagcttcctggaggcggcgggcggcgtgtcgctccaggaaccgcgctgccgcggaaactccgcgcgcctccgcggatgcccctcgccctagcccccagcgcgcggggttcgggggccctgcgaggtccccccttcccccgcggtgcttcccaagctgggctaaggcgggcttctcttcctcc

SEQ ID NO: 687800 - DNA, 149 bp, Homo sapiens
gacagcgccttacgaaggcggcaaaaggagccaagagaagtggttatcatttctagaagattgtatatgtgaagcactctatgttcatataagaatattggaagacgttcgtcacaggaccaaggaccaaattgcatctgatggttcaa

SEQ ID NO: 687801 - DNA, 225 bp, Homo sapiens
  misc_feature (5)..(5): n is a, c, g, or t
tcggntccacctttagcttcggctccacttccaccttcaacctcagcttcagatccagcctcaacctcagctccacttgcagcaaccttaactccagtttcagcctcaacctcagtttagatgacagacagagaccgaagtgagttagtgaagtcatttagagtatgactggcctcttaaggggagcaacatactggagaatgtgagcagcgggctgaataacaa

SEQ ID NO: 687802 - DNA, 335 bp, Homo sapiens
aagcttgcggccgccttggccgagcgccggcgttgggcatttgcacagcaccctccgtaagggcaccgggagagcccggaagtgcgttccggggctttcggagcaacggtgtgaggaccagcagagagaagagattccatcttccagaggttgccactgtctgcctccccacttgtccccatccacagacatcttttttatatatataatgacacattagttgtctagctcttcataggtaatcgacgataacgtctggacggcataagatgagcaggaaacgtacgccttagggttattctcactgaaaattgcctttgagtttgataaactct

SEQ ID NO: 687803 - DNA, 261 bp, Homo sapiens
cttaaccacaaggagtaaactagtaatgattctacaacgtctatggtaggcattcgaactggtcctttacacttagagatacttatatcttttgcgcctcttatcaagtcagtacaaaccttttcccaggattttacgttgcggacttgttcgggtgattcgaattcggtgaatttgcaactccggctccacgggtgtttttccggtatccttcaaagccatggcttgttgcgcgcgggcttcagccatggagtaaattcg

SEQ ID NO: 687804 - DNA, 1614 bp, Homo sapiens
  misc_feature (1017)..(1017): n is a, c, g, or t
  misc_feature (1069)..(1069): n is a, c, g, or t
gttcacttagatggctagcggccgctagttgtttctcgccgctctggatcttgctgcttctcgatcttcgtttgcttcttgttgttgtgttgtctgtcgttggcgtctcttctgtggtccgccccttctggcctccgttgtgtgtgtgtgcgctcccctgtctcgtccgcgcgttgtgtcctgttgttttcttgtcctgggtgggcctgtcttcttgggccccgggctcacttgtgggttacttcttttttgcttcgccctttgttgctgcccttttaccccccgcattgtctccgtttgtagtgcgcccacgccggattccccggagtgtggcttcgatgtggcgcccttctaccctccctcaacagtgtcgtttcattgattcccagtcgatgctcttattgaattgtgcttctcctcctctgctccgttgttttggtcctgccttggagtctagtccgtggggtgtttcgtgtgaacgtcactatctcgacagaccgttgggtgggttcagccaccagtggagattgtcttcttttccgcccccgtagcacccaccctgtggtgatggttccccccggagaaattcctttgttgagtttcccacaaattattggttctccgtggtgttttgcattttggtgaacttgtttacgggattccccgctatggggtgcacccctctcgtgtattaccggggccacatgtttgtgccaactccacgagttcattcctttttattgtgttgaagaattgtgtttggggcattgtgttggtgattcttaccccacaggattttgccccccctctatttagaaattggggtgtgccccctcttataggcgctgtccgcttgtggggcactttgtacccacgaggcgccacccccaaattggcacaaagttggtgaatcctcgttccccacacacggtgggcacacttgtctgtcgcacacttgaacagacggatatagattggttccacgcgcaccgagtcacccacaatatataatacagnggtggggttccctctcttggctttgtaaatagacacagagacacttatatanacgtgtccacagccttgaacagagatgttctatatatttatagcgacactcgtgtatacacacacagacatcagagcgatatagagagatgaatagagatcgacacacccccacatgccactctgtgtctcacgggcacaccccaccctctttataaggagttttacgcactatgaccacacttcgctcattatagatctctgccaccttgaaatcttaatggggttgctatgtttaatcacacatgtacacgcttaatttatgttaatgcacctcctggtgttgctattgagatatttattctcccgttatgcccttggattatttctccgctggcccacactatgcacgaccactcttgtactgcctcacaccctcttttctccaagtatatgggcactttctactgactttagaccttccagggattcccactgactggcagattttaaggacaagtattttatattccaccacggtatattttgctgcatgtttctgtactcccgagctgttatgtaacccctgtatataaatggttgcca

SEQ ID NO: 687805 - DNA, 1049 bp, Homo sapiens
ggtaggtcatgaagtattctgaggcaggagagtaagaaaaataacttctgaaatacgtgtactggtcagaatttgcttaaagagagacacatctggcctatggtggctcacgcctgtggtcccagcactttgggaggctgaggctgggcgaatcatcagagttcacgagttcatgagcagcctgggcgaaccatggcgagaccccattctctactaataacatatatgaaacacacttggtcgtgcattgggtggtgcacgcctgtagttcctctgctacgatgggtggggggcctgtcgagcaaggagaattgacttgaaatctggagagggtggaggttgcatgatgggactaaagactggactccattgtaactaccaagtctggagtgaagaggacgcaagaccctgacctacagacaacataacggaacataactagacaattcaacaacaaatcctagctatatttcacaaattcgagagataattgtgagtaacctccctatggcgatagccccagacccagcttttcctgcagcgggccgacgaccagggcgagtcgcttgggggttaacacgcttggtgaggaatccaccctttggaccttatgtccaacaaacaatacttttacccaaaaggtcaacatgggcaaagccacataggattcacggcgaataatcttagattattaaaacacactgggcatttctaaacgttgttccactattgacccacataagatcacttcacagtaacagtgcttggggcgcagcaccaatttacttgaaaagcatatcgttgtgcgtcccacacttagagcgccaagtctccgctgcactgtagcacaaattatgacattgtgtactaaacccttttgtgttcacaacaatcgtaaacgaatacatattcctaactggcctatccatagataccactgcgcacgcagataggtccagagcgccgggtgcacgaggttccacccagaccataccagggctggggcaccccctgaagagcacagaggtttcaaaacaagacccggcaca

SEQ ID NO: 687806 - DNA, 378 bp, Homo sapiens
  misc_feature (1)..(1): n is a, c, g, or t
  misc_feature (364)..(364): n is a, c, g, or t
nttcagtcccattacttcttaaaatttgattgaaaaaattaagtcacatgtaaccccatgctgttttaggaatatgaaaccgataaatgcattttaatgatagtggtcccttcatatgagcttcttttaaaaagtggaaacaaaccaggtatctgctttctagttaatcactgttggctattccatagaggtgtgtctggaacagggagggggctctgcttccctttgggcataattagtcagtgcactaacaattatgtacattcaaacttgattattttaaatatgatcttcagctgtactgtaaatagagtactgcattgtagtctccatatgtttattatttcctataatatttaagaanttgcctaaacatat

SEQ ID NO: 687807 - DNA, 344 bp, Homo sapiens
tggaggtgtggggggtgcgttgcgcgcgccctgtggggtggtgggcgaggggcagaggagctgtgcttcttgctcgtactgctggtggtattaggccgagagaggtccgagtaaagacgggtctctgcgatccggggcagttctgggacgtgaggcccggctgctgtcttgtatcatcctgaggacgcccgctgacgtgtggttactggaggccttgtgggcagaagctcagagaactggggaattcgcaggggtggcttaccagctaaggttctctgaaccatccttggctcccctaacaggtcgaagcttcagcactcctccttgaaagagaccctcccctt

SEQ ID NO: 687808 - DNA, 446 bp, Homo sapiens
  misc_feature (125)..(125): n is a, c, g, or t
tatcccccatgcagctggtgtgattgaagaccactcgaatcgtaacacgtcttgctaaagcttcttaggttccagtcttctcatctatccaacatgatcattactagacctagacacagtatgtnggaaatgaatgaagcgaaaaacaagacataaatctacttcatggcgtgggtccagcatcaaaagaggctgaatcttctccatttgttgagcgacttctgaaatagggctatgaacgttatttacctcacataacctgtggatgattactgtcattcaggcccttcccgaatttgatgggaataggttccagaatgttgcccaagcaaggagtgatgctcgatgaaagtgagaaaactaaggagagtcttgaaactggtgacacgactttggagctctgctgaattggatgaaagataaagcccttaaggacaagattgaaa

SEQ ID NO: 687809 - DNA, 232 bp, Homo sapiens
ctaggcggcatcgacgaatccctagcgcaatgaaacagagagggatctcagatagagttccgaggaccctacgtccacagcgcatgctctgctcgatacgcgagtcactgcactcgtgcaccccgcgttggcatttgacctctcttgctagagacccatagtctaaccaagcctatgcatcagtgcagacgatagagcatcaggacgcatgcgtagcactgcatgcgcgcag

SEQ ID NO: 687810 - DNA, 113 bp, Homo sapiens
ctccctgggtcgtatacggttcgctcttacgccaatattgtgcctattgccatactagtctttgccgcctgcgacacagtggtgggcctagccctactagtctcaatctccaa

SEQ ID NO: 687811 - DNA, 731 bp, Homo sapiens
  misc_feature (152)..(152): n is a, c, g, or t
  misc_feature (664)..(664): n is a, c, g, or t
ggacctgacaataatcactagaatggcctactctgactctagtgtgtgatacatggaaagatggagaaccaggcacccgtgtggttgacttagtggatgggcgtgaagactggggtctgggacctttcaactcaacagccttcagatgggangatcatcaacgtattccgaagctaaccaatctggtatctctagggaccacaaatagcggttgtcctggagtgccacgccgagccgagacccatatgaactcgtgagagagccattacttgagcatagaggggctttgtggcaagctgtgcaacgagcaggcttacagaaaaagtctgtgatagaccgaagggaccccttcaaacaaatatacagtgctaagccttttctgtgataaatagatgagctgagaaggactgttcatagtaaaaagctctgttccggtggctcagatgaatgcctatccagtacaatagcaaacaattctttgcggcttgcaggtcctctagacgtttgggagttttgaactgcctgaagagcaccggatgtgcgcagctgcccttgagttggggtgcctctcatgatccgttgactgaggagagagagtcttgaatagagcgtgattatcaaggtgggggcccccttcgactggtgaaaatgtgcctctcgaacnatgggaatccaagctgttgcagtctccttcaagcatactgtggagcctggatgttgaagtggcagct

SEQ ID NO: 687812 - DNA, 222 bp, Homo sapiens
ctttctttctttctttctttctttctttctttctttctttctttctttctttcgtaagctctatgcccagggtgggccttgaacccacaaccctgagatcaatagtcaagagtcacatgctctacctactaagccacccaggtacctgaagggaagactttttaatgaaagatataaaaactacaaagcctagagggaaagactggtgaatctatctttttg

SEQ ID NO: 687813 - DNA, 582 bp, Homo sapiens
agagagagtgagagagagagagagagagagagagagagagagagagagagagagagagagagagagagagagagagagagagagcgcgtgcgctcgaccgagagagagagtgcgttagtgagcgttctcatttccactcatccctcctgttgcttgtgtttcaccactttttcttacccttgtgtcgtgcacactcctgtgattcctactttctctgcgctctcggtctcctcccgctctataccagatccttcgcttttgcttgggcgttccctccccagtctgctctccatatttcccttatccccccattcctttttacattcttcttagaggttgcctttttgtttctcctctgtatacccaccccatggccctttggaggtgtgtttctctctttacagtgtctccattcctccccctataaccctcccccctccgctaaacatttgttttttctttttttccacaccccctcaatttcccctttgtacattttctttttccccctccccgccaattgtttttttgcccttttgtcagccctctctcttttttattttattcatttcttgccccccc

SEQ ID NO: 687814 - DNA, 264 bp, Homo sapiens
ctggcctgcgttttacactgtccgcagtgttatactgtttgtcgttttacactggccgttgttttattattgttctttctgtttattctcttttctgtcttgttttcatctgtctcattatggtgcttctttgtttttcttgtttttattccctttttgcttctttttatattctattttgttttttcgtttttcattctgacgcttattattttatggtttccatctgttttttttttttaattgttcttttttttttctccg

SEQ ID NO: 687815 - DNA, 198 bp, Homo sapiens
ccccctccaaagtgctgggattacaggcttgagcctccactgcacctggctattaaaatttttttaacttttacttttggagactggggtctcaccttgttacccaggctggacttgaactcctgagctcaagtgatctgcagtagctgggactaagggcatgtgccactgtgcctggcttaaggaaacttaatcact

SEQ ID NO: 687816 - DNA, 178 bp, Homo sapiens
catcgtttaccttggttgtgggatagggacctgtaggttatggagatatggagagtgagaggcagagctacagggagctgagccactggaagggatatgttcatcccttgtgacttcatgtgctgtgaccacaacctggggtctgggaacagtgacccagtgaagtcccttcatcccc

SEQ ID NO: 687817 - DNA, 285 bp, Homo sapiens
gggagtctacacatttattaagtaaaaccaaactcagtgtcagacacgttatatttgattgggtctcaaatttggctaatgtccaaatccacgcagagaagaccggtggggcaaagggacacagtgttgctgccaaggtcacatgtgacacaacacagttctcctttaatgtgtaaaagcgggcttcgcacagttggtgtgagtcatattaccagaggcagagaggggactctatgtttcacgagcagagggaaccccagagtgcgcagagctctctcaagagag

SEQ ID NO: 687818 - DNA, 104 bp, Homo sapiens
ctccccaagtgctgggattacaggcctgagccaccatgcctgccacggaactggttcttagtaggccatagacagttgacaattttgagccattgcactcccgg

SEQ ID NO: 687819 - DNA, 1528 bp, Homo sapiens
gcctataatccacagtcggctagacgaagataggcaggaggtagcaggtacctaggtagctatgataggtacagaaggccaatactacctaggagaccagactaggaacgagccaatacgtaggcctaccaacacggtaactagctagggacacgcgcacgcgtgtgttgagtacgtacagcctagtagacacgcgcaatacacacatatatctaggacaactaatcatacagcacacaccaagctacgccagcctacccatggactaaaccataccgacaaacgcgcgcatagaaacaacccaaccaccctatacacaacagcagggacccacactaacaccaactaatcccgagcagacacaccacaagacacagacaaatactcatcactcgagacgcgcaccaccgctagcacggcacaggataaatagcctcgccacaccacacacaaaacccaaacagccggacggaccaccagaggacccacgacaacctaaggaaacaccccgggaactcaccagacgcgctcgcacgccggaaccagagacaatacacccaacacaggaccactaaacacgcgaaacaaaacaggaacaacaacagacgcgcgcaaaacaggaaggcatcaaccctaaggcctaagcaacccaacaaaaagcagaacggactaggcagagtactaagaacatgacaccctaaaccaccgggcagccaaggtacaagggcccatacaataccctagggcggcgacgggccctttagggcactagaacacacacgtcgccaacacgccttgcgcgacatgggaagaaaaatgcacgcgggcacaactgcactgacacagcccccacgcaacgaacacccacacagttacaaccggaggacatgcgaaagaggcaaccacacactagcgtcaccacacagaacgcagctacccgaagacacacacccacggcgccccagaccacgacagacaacacgacgggacaagcaacagccaaagcaacgctcggatccgaccttacagcaccaccacagaagaggctctccacccaacagcaaccccccaccaggaccaacccacacccgcatgacagcgaccactgacgacgcaccagcaaaacagaacagacaccatgccacaagcatatacacatccaaacctgcccggccaccctacccacattgaaccccaatcacaccaacaccgaccaacataggacaacactgatctcacccagtcgcaaacactttgtataaccaggcggaacacaccagcagaccgtagctcacgccgagcagtcaggccatcacaaacgagcatgctcacacaatagtgatgctagacccccgatagctagcagatacacaatacaacagaacagagccatgcgatgaactcaaacatggccaactgagccacataacaacctagccaagagccgaccaacgagaacagagccctagataagaagcagccccaacgcggaatgacacgatacgagacacaacaagacgatcaccac

SEQ ID NO: 687820 - DNA, 361 bp, Homo sapiens
acagaacatgacccacgtcccaaggaaatctctagagaagctggtgattggcccagatagatgcttgaaggagattataagccgtcaaccatttttgcacccgaacgggtagctctgtggatgagtaggcacgatgaggcttacgaagctactagacccacggctgagcagctggcaggcggctgcacaagtgagacccgcactctggtttcctggtcgtcctggacgcagctggagtgactacaagtgctaatgttgtcaagatctccacggaggcacttgaccagtgcccttaaccactgtcagggaatgccgacagatatgacacagggccacatgcagccaggcacgccggaccatg

SEQ ID NO: 687821 - DNA, 954 bp, Homo sapiens
aagcggtacctccatgacatgttcagtaagagtaagtgtgtgattgccctggtttggggggtgtaggcaaaaggttgggggggaactgtggcgggtcagttatgggctattcctgcggctgcgttaatagggggttgttcacggcagtcgggggtttcctgcccaacggggggttattttaaagggcgccttgtatttcggcgggtgctgtgctagggttacagcgtggtccttgcggttgggggcccgccctagctactgggcggcccccttcgtgtttaaccgtcggttttgttgccccccgtgccgcccctgttgggctgtcccccccacgggggggcacattcgtcctacgctccggggcccggagccgtccgtttttcaaagagccggttgcagcagagccaaaatctttggtgagctccactgttcggccgccaaaaacatggggaacacattcctcaggggacgcccccctctccgtgatctccggggtgtgccccaccaccccgcttcgcccgggggtttcttgtcgtgtgcgccacagtttcttaggcatcttagctgtgtgccgagcggggggccaccgagtggctgctgttaattacactgctctacgggcgtgatgcaaccccgccttgcaaataaagacctacatgtccctcctgacacctttttattcttccgggcgctatcccctgcatcttaacgtggtggtgacatcaacgtgtgatctacaaaacaatggtgttacaaaaaaaaggccgtttcaatattctcccactatttgaacagagtagttctcctttcttttctccctctttcgtgcgcaataaagagcgccccgttcatattttagttgtccctcgttgacaatgtaagcccggatacaccaatactgggtccccccaaccccgggatcttccttcagcggggtttcttccaaacaaaaca

SEQ ID NO: 687822 - DNA, 156 bp, Homo sapiens
cttgtgatccgcccgccttggcctcccactcctgaccttctgatctgcccgcctcagcctccaaagtgctgggattactggtgtgaaccactgcgactggctgggacttttcaattgtttgcgagattctggttttagaaggtgagctgaagctaa

SEQ ID NO: 687823 - DNA, 156 bp, Homo sapiens
gggactgaaggtcacaccacagcgcagtctcactctgtccttcaggcatgtgagtgcagtctcctgatcttggctcactgcaacctctgtctcctgggttcaagtgattcttgtgcctcagcctaccaagtagctgagatacaggattgacttcta

SEQ ID NO: 687824 - DNA, 306 bp, Homo sapiens
tcaatacgacggtttctttgtggggaaatatttttctttaagagcacacttaaaagtaacttgcatatacttccctgtaaagcatatccatattcacaatttagcaaaactaaagaggctatgtctcttacatgcattatatttttgggtcagaaaaaatgtccccatgggtgcttatcaagacccgattttaaacccattcatccaagctataactttaggccttctggtttgaccaacattggactaacaaaacatgaaatccaaaaaagggagttaaaggaaattttaaagcccaataaaggg

SEQ ID NO: 687825 - DNA, 215 bp, Homo sapiens
ggcgctggagtgcatggtcctcttggctcacgcaagctctgcctcccctgtagctgagattacaggcataccccaccacagccggctatttttgtctttttagtcgagacggggtttcaccatgttggtcagcctggtctcgcactcctgacctggtgatctgcccgcctccgcctcccaaagggctggggttaccggcgcgagccaccacaccc

SEQ ID NO: 687826 - DNA, 280 bp, Homo sapiens
gcccaagttgagaacaataatgaacaattattgtatgaacaagttgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 687827 - DNA, 1022 bp, Homo sapiens
gaccatgcaggagtatgcactcagcttttcatgttttcgtcaggatgcgggcatcaaattccagctcaaagatggggggagctctatcactgctcttgcgcgagtgaggctctgtacgcgaactctgagaaaccatacacgacaaatgccaatgagagcctacggccatacacgcagatccacctgcggataaagtgtagaccctttagataacacctgaatctagtgctgtgccttgactgtagcaagccagggtcgagaaagaagagacgcccgtgggtgccgacatgatcatggatgatgagagcgcgaaagtcaagacgcatactcaaggacaataggctcctctggaatttggattctgagatggtgggaaatggctccagaagttgggagcttgctctccaggttgcggagagaagccgtctggatctggaccaagactcgagtaatacgatccgcagaatccattgcactctagaccagcttcttactcgaggataagctgcccaggtattccacatccaacatctctgagtgcgctcctcggagctctaggtgacgaagggcaatcgtcttgcagcttgcttgcattcaaggaactgctcccctcatgtggctggggaggaccgatcccaagtttccacaaaggccccccatcttcttcctctgggaggcccagagcccttgcggtggaattccaaaggcttcccaaacttggcatgaccgattcagtaaaccaatgatgacgccaacgagagaaagagagatcggagcacgcagtgacgctcacaacacaaggactgttagttccgaggacggcatcaggcggggcaccagaaagaaaatcattgtcgggagaaccactgcggatggagacgcacgagagggcccgcggaggaaaacgacgaggacacgtctgtcagccaaagaggtgcagacagaagagaacattccggtgcatagccgaggggaggggagaacggagcacacagtgaagagcgcccacgggaagatacgcc

SEQ ID NO: 687828 - DNA, 153 bp, Homo sapiens
  misc_feature (40)..(40): n is a, c, g, or t
  misc_feature (81)..(81): n is a, c, g, or t
cgaaaccaaataattcaagcccggcttattacaattttantaggtttctattttaccctcctacaagcctcagagtacttngagtctcccttcaccatttccgagggcatttagggctcaacattttttgtagccacaggcttccccggactt

SEQ ID NO: 687829 - DNA, 101 bp, Homo sapiens
attactttagtgtggatgcagatgttgttttgacacatccgaggactttaaattttgattgaacaaacagagcgatcattgctcctcttgtaactcgtcat

SEQ ID NO: 687830 - DNA, 970 bp, Homo sapiens
gccagaggtgtaattgcgtggtcgcgctactggtcttctgagagcacgcgtccgtgcatgctccggcgtggcttatctgcctcacgtgaagtgcggtgtggtcggccgtatgtatgatacgagtgatgctggaatagtcagcccccgggagtggccttgggtgtaaacggatgatgctccgtggagcattatgggcgctgaatatctcgcatttgtgattttcaaagcgctaggaataattgatgagaggtggtaagcaggcaggtttggtcttgaaagaaaattgagctacgaaatgtgtactgtgtactgcatgcagttggtatgatctagctgcatgtgttgtacggcccgaagggaaggattggatgggtgtggctggattcatacttgaattattaagcagcttgggtgcctaaagtttatagtgtatgggacctcgccaatcgggatgtcctcttgggaggtagcgttatcgttattaaataccaatcgaagtagagtcggtaacgcgtatgcaggcagtaggtactacagcgctcaagggtctagtaggattggtatgatcgccatggaaattgaggctgagggccgcgtggagaatgcattacgttggggagtcattgccagaagagacggggcgtgacgggtagtaacgcgttaggggtagatcatcgaccgtgccgagagttgaccctgtgctggatgaggaggggttgctcagtgagcccggtatgaactgcacggccttgttctactacgtcgacagtttcttggaaaggggtgtgagtagagtgttgcgctaatggcttggaagagggaaggccgggaaattccataaaagcggaccaagtgtttgggctaatcctggagcccgggaaggttccttttgagttgcaacaccaaggaccgccatgtggctccgggccgaatgttatgaaggggagcttcaggcaagcgtttttcgaca

SEQ ID NO: 687831 - DNA, 420 bp, Homo sapiens
ctcttctcccgacacattgagaaagcaaatccagagaacacagagactaggaacaaaatgaggcaaacctgagaagaaagcttagggttccagctttgtttctgttgttcacttccagaaactgccaatttcgaaaaatcgtcctggtctcttgctgcaacttgattgtgtttttacttcatgtcctgtgcccttgttgctcagaatcccaagagagctgtttagaggctcagttacatgtttgctaagttttcgtcttctcctcccaagatgaatagtgttttgttttgaaatagcaggtgttttctgaatcccatgaagggccaacagctaaaagtgctgatcctgactctgatttcgctgcgtaactcccaggggcatcctgctctgatgtcaggggagaagagggtaccgagctcg

SEQ ID NO: 687832 - DNA, 424 bp, Homo sapiens
gtgctggggcgccgtctagcagagagggccgaaagatcaaagcgtgggcgcaattggctcatcgttgaaagggagacgtctgggtcagcgcttgagtgtatcaggaagcgaaatgtattctggtacactgccagcttgggaaactgaaatagaactatgctatgtgctaactgtgccatatacaggcaaaatattgaactggcacagatgcgaaaatactacaggggcacactgctatattgaccaggggacttgacatcattagaagcatgccagacagactgtgaaacgaaaccttttcacctacaaattcacctaaaccttaaacctgaatttcttataaatgctgtttaaactgatcactgctaattgattcacacttctcccttcacctctttatttctattattacatctttacacca

SEQ ID NO: 687833 - DNA, 154 bp, Homo sapiens
  misc_feature (12)..(12): n is a, c, g, or t
gtcgacggtacnaaacatataaaaccactgctagcattttgggtatttccacgtacttacttcttgcataaggtttttaaaaaatgttttactggccgggtgcggtggctcacacctgtactcccagcactttgggaggccgaggcaggtggat

SEQ ID NO: 687834 - DNA, 174 bp, Homo sapiens
gttatcggaagtttcccagacaaatcgctccaccagctacagaacgcgccagtgcatcaagcacccagtctgtacaaatctggtcggatcctctacgatatccgacctgtatgcaattcagcttgtcctcgagcacgtcgatccttacaagcgttgctgacttgtggaaacatg

SEQ ID NO: 687835 - DNA, 688 bp, Homo sapiens
  misc_feature (22)..(22): n is a, c, g, or t
tgggatgactatccccagtganagcattgcgaagtgagcagaggctggctgagtggactgcactttcttggtggccccccgtggagagtcagagtggcatgttaatgatgtggatcacatgtgccctggcttgtgtacttgtcactccccttcccactccctgctctcagcattctgtcacctccctacccctgtctgctggtgcccatgccatggccatgacctccctgtgccctggttctggtgtgttgtcccaaactggcactgagagtgcctgatgggcaatggagtacctggcttgcattctgctgcaagaaccgcctggcgggtgttttgggctgcttgacgctggccagtgctgctgcctgcctgtgtccatttgacactagccatgctacaatgatctttgtgtcctgggaatgagtggttgtgggcaagactggcgcttggtggccaatgctggctggcctggaggtgcctgtggtgcaccactgggaccacctggcatccatgaccacctgtggtatttttggccagccaagctgcaggccagcagccgtgtcgtcatgttcgtttagagttctgggactgtggagagtctgcactcaaaaagttcgatcatatgctgctggcttgcatggaggaacacaagatgccttcctcttccctcttctccttcactgaccgg

SEQ ID NO: 687836 - DNA, 118 bp, Homo sapiens
  misc_feature (57)..(57): n is a, c, g, or t
tatgtggtccagcttcacaggtgaatgtccagattataataggttcccaaagggcanttgacacacatacgccctctcagcactgagcctggtctgcagaagtacaacctgccggtgg

SEQ ID NO: 687837 - DNA, 227 bp, Homo sapiens
tgtcaatcataccagtcagcagtgtgtcagtgactcaagacaccaccccctccagcatctggggcccaggaacctctccctgctacagggtggtagggggtcctgctcaaacagaggtaagtagagtaggtaaaaaatgtactatagtacaccctacaatacagttggaacttgcctacatgaggagatataagagagtacttgtagactaaagtggaacgctggat

SEQ ID NO: 687838 - DNA, 919 bp, Homo sapiens
  misc_feature (102)..(102): n is a, c, g, or t
  misc_feature (105)..(105): n is a, c, g, or t
  misc_feature (108)..(108): n is a, c, g, or t
  misc_feature (122)..(122): n is a, c, g, or t
  misc_feature (146)..(146): n is a, c, g, or t
  misc_feature (152)..(152): n is a, c, g, or t
  misc_feature (155)..(155): n is a, c, g, or t
  misc_feature (167)..(167): n is a, c, g, or t
  misc_feature (185)..(185): n is a, c, g, or t
  misc_feature (190)..(191): n is a, c, g, or t
  misc_feature (208)..(209): n is a, c, g, or t
  misc_feature (220)..(220): n is a, c, g, or t
gggaaaagcgacggcgcagcacggtgcggcgcagctcctgctcgcctttcccttcgctgggcgagaggtgtctatggggcacccgctgccgccgcgtaccgncancgncactgccagcggcnactgtagatcatagccaaagaatntgtgangtntgggcttgcaanttggatgaagagatgaangaaannttcgtcaagttatccgnnaaaatataatnacgttgctatggacaccgagtttccaggtgtggttgcaagacccattggcacgcatattcaggagcaatgctgccctatcattaccatctatggcggtgtactgtcgacttgttgaaagataattcagcttagtgactgagccatttatgaatgagcaagggagatataccctccaggtaacttccaacttggctagtttaatttcaaatttacttgtgacggaggacatgtgatgcccaggactctatagagctactaacaattatctggtatccagtttaggaatacatgaggaggaaggacattgataccagtattttgcagaacttttatgacttttggagtggtcctctgtgaaaggggtcatctgtttcgtcatttcatagggttacgattgggtacttaatcaaaatcgtatacaaaatctaacttgcctgaagagacttgattcgttgagatccttcgatgtttgacctgtctgatgaggtgagtactccacgacaaggcggaaatctcaagaagttgatgggtttacagcggctgtcggcagtgtgctttagcgtgggggtgttaaccattagatcgggggtaagaaacaaacaaatgggggggaaaaaaaatgggggcgaaagaagttcgatgacatgggccaaaagggacattgtctcctcccagctgagcggaggaaaaacaggcga

SEQ ID NO: 687839 - DNA, 697 bp, Homo sapiens
ctcaccatcgctcttctactatgaacccccctccccatacccaacccctggtcaacctcaagctaggcctcctatttattctagccacctctagcctagccgtttactcaatcctctgatcagggtgagcatcaaaactcaagacatacgcaccatgatcggcgcactgggagcgagtagcaccaaacgaagtctcatatgaagtcaccctagccatacatatactactatcaacatgactaataagtggctcctttaacctctccacccttatcagaacacaagaacacctcgtgattactccgtgccatcaatgaccctttggccataatatgatatttatctccgacactagcagagaccaaccgaagccctcttcgacctggccgaaggggagtccgaactagtctacaggcttcaacatcgaatacgccgaaggcacccttcgccactattacgttcatagccgaatagcagcacacacattattataatcaacagcctcaccactaccaaacttccctaggaacaacatatgacgcagtcatccccgtgaactctacacaaccatatttagtcggcaagaccctagttctaactccctgttcgtatgaatcggacagaataccccgattccgtacggacaaattcatacctcctgtgaaaaattcataccatcacctagatactgtatgat

SEQ ID NO: 687840 - DNA, 1091 bp, Homo sapiens
  misc_feature (102)..(102): n is a, c, g, or t
  misc_feature (105)..(105): n is a, c, g, or t
  misc_feature (108)..(108): n is a, c, g, or t
  misc_feature (294)..(294): n is a, c, g, or t
  misc_feature (318)..(318): n is a, c, g, or t
  misc_feature (324)..(324): n is a, c, g, or t
  misc_feature (327)..(327): n is a, c, g, or t
  misc_feature (339)..(339): n is a, c, g, or t
  misc_feature (357)..(357): n is a, c, g, or t
  misc_feature (362)..(363): n is a, c, g, or t
  misc_feature (380)..(381): n is a, c, g, or t
  misc_feature (392)..(392): n is a, c, g, or t
gggaaaagcgacggcgcagcacggtgcggcgcagctcctgctcgcctttcccttcgctgggcgagaggtgtctatggggcacccgctgccgccgcgtaccgncancgncaccgccgagcgcgccgagtgctgtctctatggcgaggacggaggaggaggagcgctgagctcagcgacacaaggtacataacctaacggataaaatattttatgaaacaaaatcttcagatcaagtataacatttttgatgctttggcatctagactcccttgtgccctcactatgccagcggcnactgtagatcatagccaaagaatntgtgangtntgggcttgcaanttggatgaagagatgaangaaannttcgtcaagttatccgnnaaaatataatnacgttgctatggacaccgagtttccaggtgtggttgcaagacccattggcacgcatattcaggagcaatgctgccctatcattaccatctatggcggtgtactgtcgacttgttgaaagataattcagcttagtgactgagccatttatgaatgagcaagggagatataccctccaggtaacttccaacttggctagtttaatttcaaatttacttgtgacggaggacatgtgatgcccaggactctatagagctactaacaattatctggtatccagtttaggaatacatgaggaggaaggacattgataccagtattttgcagaacttttatgacttttggagtggtcctctgtgaaaggggtcatctgtttcgtcatttcatagggttacgattgggtacttaatcaaaatcgtatacaaaatctaacttgcctgaagagacttgattcgttgagatccttcgatgtttgacctgtctgatgaggtgagtactccacgacaaggcggaaatctcaagaagttgatgggtttacagcggctgtcggcagtgtgctttagcgtgggggtgttaaccattagatcgggggtaagaaacaaacaaatgggggggaaaaaaaatgggggcgaaagaagttcgatgacatgggccaaaagggacattgtctcctcccagctgagcggaggaaaaacaggcga

SEQ ID NO: 687841 - DNA, 891 bp, Homo sapiens
tggagacgtagatttgggtctcaggttgcagtgagccgagaatcggccatgtggattccagacgctcagcaagcaaggaccaagagataggtcgtcgaacccagaagaataataatacgctatacaaaaattagggaggagattgtggcacgataagccgcaataggcgcatggggacatagcctgtgccataggtggccgtgggtctattagtcgcccagggagtgaaacccatcagtttcccagaacactaactctgtggcgaaaaagcgtgggtttctcttcctgggcaatagttcttgggcagggatttaaattcacaggccctcgggtacggaatgtggggactcacgggacagaaggctgtcacacccccctgggaacgagaccgatttcgtggacgtgccgtggggtctggaccctaagaaaataaaccgggggggcggcgctaaaaaaaggcgtgtcacaaagcataagtcctacaagattctgggacaaggaaccgcccaagagttcctactacacatggggtggccctcttggggacaaacaggaattttgtaacccaaggggtggcgcatattttccggggggcacaaggtgggtgcacccaacagttcataactggtaaattcggcggggcgaatacacactaaaagagcaggccctcaaaaacacgcaaaagggccactttaaacagcccaaaaaagtgggtatatacaattaccgcggcgatcaccaaaaagagtgtgagagcacccgagggatgtgcgagaaccccagaaccacgggagggagctctccccagtcataagaaagtccctccgaagaaatcagcaaacccagaagtgggcaaccccggggcgagcgaaaggatcccatccaaagggc

SEQ ID NO: 687842 - DNA, 113 bp, Homo sapiens
cacaaatttccattgcgcgactatgcacaccaacacaacataccccctagcaggcgtgctccgcttactgatgctccgcttactgaactccgtactgatgctccgcttactga

SEQ ID NO: 687843 - DNA, 81 bp, Homo sapiens
tggatccacaatgaatttgcattttttgcgcactttttgctaaagtctttatacttgcaaaaaactactactactactcgt

SEQ ID NO: 687844 - DNA, 147 bp, Homo sapiens
cttttttatggggggtcctaaaggggggggccccgggggggggttggaaggtttgccccccctccccccaaggtttccccggggatttttttgttgggatgttttggaaaattttttccaggaaaaggggaaaagggtttccttcca

SEQ ID NO: 687845 - DNA, 401 bp, Homo sapiens
agaactggtgtatgaactttcatttgcctagtcaaactttactctcaaactaaaatggagctattttggagtagctcataatatcaagtatttgaggaaataatttctaattggatctagaaattgttatttaaatatctaagggttgccattggcattcactttttcttatttggagaaaagaagacactgcgaacgtggaaccaaccttcaattctttttttggtgattggcagggttgtaagaactcaataaaatgctgaatgacaacaaatcttgactaggattaaggaagacaaggctgggtgcattggctcacatctgtaatcccagcactttgggaggccgaggtgggaggattgcttgagcccaggagttccagaccagcgtgggaaccatgg

SEQ ID NO: 687846 - DNA, 139 bp, Homo sapiens
tccacttctgcggtatatatccttacaaagcagagcgaaaagtacaaccaaaacctgtcataagaaaatcctgtagcagtaagctgagatcgtgccactacactccagccggggtaacagcagtgggactccgtctcac

SEQ ID NO: 687847 - DNA, 236 bp, Homo sapiens
tccatcacatagatagtaaacactccagttgaacaaaatagaatacgaaagtagctataagagtatctgaacacacaatagcttatacccaaactgggattagataccccactatgcttggccctaaaccacatcagttacatcaacaataactgctcgccataacactacgagccacagcttaaaactcacaggacctggcggtgcttcatatccctctagagaagcctcatgtg

SEQ ID NO: 687848 - DNA, 547 bp, Homo sapiens
  misc_feature (404)..(404): n is a, c, g, or t
ccgcgggctgcaggattccggaacggggccgatacgttttatctgcatgtacctggcgcgaacagcgatggagaccggaactgcatgctgcaagaatcgtcgagaatgcagaatttttgtggacttctctttgctaaagttttaccacactgctgtgcttggttttagaaggataatactggaggcagaaaaaatggaccgggcagcttcactcggctggcctcaatgcttgtagacgtgattctgctgcaacgcctgaggacactgggaagatattgtacctgaagaagcaaactgtccgttattattgaagacacactatgctaaattgttgttgtgttaaccagaaagatatcacaagggtcagagcaacccttcctccagaacatgttgactcttggggntgaccaaatgaggtcactttcattggcatatcataagccctcatatttttaaaaaacaaattgcgtttcttaaaactatggccaagaactttatcggcattaatttttcagcgccgttcgcagtttaaaaaaacgcctcctat

SEQ ID NO: 687849 - DNA, 212 bp, Homo sapiens
tatctccgtactgaacgcactactctggcctaggctggctccaggtgtgccatgcccagccaaaacaaacacagagctgcctcaggcgattactgtgaagtttctggtctgagggaggtgtctctcgaggatccttttgcctgtgtgaaatattgatcctgaattaagctgtcaactttaacagtctgcacagtttccaaagctttactact

SEQ ID NO: 687850 - DNA, 480 bp, Homo sapiens
  misc_feature (447)..(447): n is a, c, g, or t
ttgtaagaaccaagtaaattaataaagcactgagaacagtgttctgcatgtgcttagcgctgagtgagtgttaaccatgttggattagtatttgataactgccactaatataattttttgtaacattccaggttggagagaaagctttttcttacttttagaaattatttctcttttgtggacccaaagtatatctcatatatgcaaattgcacataggtagtataagttttgtggatataagtggaaaagaaattaaataatatgtgtctatctgcgcacattagaagtaactaatgtccacatctgcccttaagacatgtatccctaattgtgttaaagatagaatctagccgttccagttgagtggagcaaatgcacctagagttgattccctttgtcacaactaaatattgatccaaatttgtagatctaaaatggcaaatantaaactgtgcagagctaccaattttgactttta

SEQ ID NO: 687851 - DNA, 106 bp, Homo sapiens
atgtcgatctagaggatccttttgcggtgctttcaaggcctgccaatggtcctattctcaggtctggggtgggctcaaaaagtatggagatttttttgtaatgtta

SEQ ID NO: 687852 - DNA, 841 bp, Homo sapiens
ggaccagccgcccacagagccccgagcccgtggtcccggcgagaagaggcacgcgcggcacagtgccggcctcctgcttccctggtgaagacttgctgcagctccgtgtgccactggtgttcattgcttgctgcccaccctctgctccctgggatgggccccgaggcgagcagcttcagcacatggcctggccctgctccagtgtgcatggaatggagtgataatggccgggccgagaggcggcacacctggaccatcccatgggcctccgcccgcgcctgcccgaggatgagtggtgatgtcctctagccacccctagcagcgtcggctctccctgtgactgtgctggccgcggacttgggacttggctttctcctggataagctggctggcaccggcgtcagctgatgacctgtgcagagactcgtggcctgcggccgtgctggtggccctggtctcactcatcctcaacaacagttggcgtgccttcacctccaactgggtgtgccagacgctgggaggatgggcgcaggcgcagccgtggggctgatggagggtcctgctggctggtggacagtgacccggggagggccgagccctggggccagagccggccaggtggacgcacatgactgtgaggcgctgggctggggctccgaggcagccggcttccaggacgtccgaggcaccgtcaaactgcagtacgacatgatgcgcgcctgcaacctggtgggcaactggcgcgctcaccgacagggcaactcaccttcctcctgcgcctggtggccttgccctgctggcaccggagccccggctggaggaggcatggcagcgcatcaac

SEQ ID NO: 687853 - DNA, 460 bp, Homo sapiens
atagaggcaggtcgatcacctgacgtcaggagttcgagaccagcccggtcatcatggcgaaacgccgtctctaccaaaaatacaaaaattagccaggcgtggtggcggatgcctgcaatcccagccactcgggaggctgaggcaggagaatcgcctgaacccgggaggcagaggctctagtgagctgagatcgtgccactgcactccagcctgggcgacagagtgagactccgtcccaaaaaaaaaaaaaaaaaaagaaagaaacctgaaatgggggggggttttttatattaacccacctgtggccctggtattatttttaacattttttcctttggtaccaaacctgtataaatactcatagattcccttgaggaagaggcttgccagcacttcttatcttccccaaaggttaaggcaataaattgatgtgcggtattcccttaaccaaggagtgaga

SEQ ID NO: 687854 - DNA, 131 bp, Homo sapiens
tccccagtgccagtcccctcagcctgtggtggccttgcatcctgactggatgttttcagccccttgttttgggcaaaaacccaaagctccccagtgtggatactaataaacctcttggagccccctctcca

SEQ ID NO: 687855 - DNA, 263 bp, Homo sapiens
  misc_feature (249)..(249): n is a, c, g, or t
gtcacacgccaccacatctggctaatttttgtattttaagtagagacggggcttaaccacgttggccaggccggtcttaaactcctgaccttaagtgatctacctgcctcggcctcccaaagtgctgggattacaagcttgagccacatgcctcgcctgggcttcggtttcctaatttgaaactcaggagggtttctggggctaaggtctgcctggccgggaactggagtagaggccggtgctcaccanagtctcaccaaagt

SEQ ID NO: 687856 - DNA, 876 bp, Homo sapiens
  misc_feature (138)..(138): n is a, c, g, or t
ccgagacgggtcgaccttcaaggcggtcgcgctatgcgcccggtgcgcagacattcccctcccccacgagagtggcccggggcccgcaaaaaaatgggggctgcaagcccaggataacgtcgtcgcgcgccgcgcgtngcaaacacagcagggggcgacacaacactgtgtggcggaacccaattctccgcggtaggggacgctccaccactggtcgcgaggcccgcgcagggcaacgccacgcctctgtccgggggtaggcccgcccccccaaaggcacccgcgccatgggcaaggccccacaatggggaaattcaagcgatctgggggccttgctggctgccatgatgcgcgcgtccccctgctgcacgggccccaccacaggtgggggcccactccccccggtaatggtattattctctccgcacgtcgtccccacgcggatacgcgggtttgtgcccccccctgcttgtgagggaagagacaaggtgttgtgcatagccgcgggtgtgtcgctgggcagcctcgggccgtcacttcgcacgcggggaatactttttccctgcgaccactggtacgacgagcacccccctgttatttgtcaccgcgggggtgtacacaggacctcgcaacgcgacttgctgggagcatcacatacttatgaatagcagggcttttctgacgcatgtccgagaatctccgtccgtgttagtaactaaagggcgtgagtcactgacacattctgcttttcccccctatgaagggcccactgggtacccctgccgcgctctggtagaaacgggtccaatctccctgatatttccgagggaagccgggctaatccccatgattattgggaccccaaaggaacataac

SEQ ID NO: 687857 - DNA, 388 bp, Homo sapiens
  misc_feature (64)..(64): n is a, c, g, or t
  misc_feature (102)..(102): n is a, c, g, or t
  misc_feature (127)..(127): n is a, c, g, or t
  misc_feature (131)..(131): n is a, c, g, or t
  misc_feature (133)..(133): n is a, c, g, or t
  misc_feature (136)..(136): n is a, c, g, or t
  misc_feature (148)..(148): n is a, c, g, or t
  misc_feature (153)..(153): n is a, c, g, or t
  misc_feature (158)..(158): n is a, c, g, or t
  misc_feature (165)..(165): n is a, c, g, or t
  misc_feature (168)..(168): n is a, c, g, or t
  misc_feature (183)..(183): n is a, c, g, or t
  misc_feature (194)..(194): n is a, c, g, or t
  misc_feature (197)..(197): n is a, c, g, or t
  misc_feature (227)..(228): n is a, c, g, or t
  misc_feature (238)..(238): n is a, c, g, or t
  misc_feature (241)..(241): n is a, c, g, or t
  misc_feature (251)..(251): n is a, c, g, or t
  misc_feature (306)..(306): n is a, c, g, or t
  misc_feature (311)..(311): n is a, c, g, or t
  misc_feature (345)..(345): n is a, c, g, or t
caccgcgctgctggaggccggcctggcgcgggtgctcttctacccgacgctgctctacaccctnttccgcgggaaggtgccgggtcgggcgcaccgggactngtaccaccgcatctaccccaccgtnctgntnggngcgctgccgttncggantttangcgccantgntacaggacgataacnttcgcggggtnatnaccattaacgaggattactatatgaggttnnttttcaactnttnacaggatttnaatatattattattttatcagctttggctcatcacattagatattactggtatcnccacnttttacaacttccagaatttatttcaattttctntcaattatcatttgctttttcattttttttactttcattttaa

SEQ ID NO: 687858 - DNA, 84 bp, Homo sapiens
cgccaccgtcacgatgatgcccggtacgcggtaaagaccgaaaggaagaggaatgatggcaccgggtggccatggtggctggat

SEQ ID NO: 687859 - DNA, 1186 bp, Homo sapiens
  misc_feature (904)..(904): n is a, c, g, or t
ggaggccccggtcttcctcctcgtcctgtgcgcagggatgagatccccatgacggtattcatgctgggcgtaaggtctggcctggtgccatctgtctccgacatacggccccaccaaggatacacacggctcagtgaccggaggagcatgctacatggaaggtcggtagctatgtagaagaaggagaagatcatcgaaaggacccaaactattcgggtgttgagagcaactatagagaaggagctaggcaaacagaagttgtatgcacaggctgtgcacataatctgggttaagacttggagtacaaggaaaaggtccactgctgagggttagagcacaggacggtgaagcgttgagataaggaacacttgagagaacggatggagtacgagtgaaatgagatcttcgaggaggctaaccagtggaggcttgttcacagatcgcgtgtgagtgtagcgtatgcgtccggacacagtagtgagattgtcatcatgggtagcagagatccgcgagaaggtcctgagttagcgtaatggtggcgaggtatcctttcgagatgcaagagggaccagggtggtacgtaaaaaggggaagagtaaggtggtaccagttcatccccatttgacgtttgaacctcgtgggacgagaaatagatggtgataaaaggcggaaaggctgttgtaccactgtgactgtggcatacgatgactgaaaggaacacgttgatgaacacgattactacttgggaataactttgggcactgaagaaaaaccacgtctggtagacgtacaggtagttcgaaacctatgcaaaggtcggcgggtggaaggtggctggaaaacaaggaataagaagagagaagaataacgttcgagagaatagttggtagctagatgctatttntaccagtgggaaaaggcttactttggagaaataacacaccaaaggttatggggcgtgggatttttgggggggtaattgccccttgggagcgggggggtggacatagttttggcattgttattcggtgcaactgccaggctttccggtccccgtggggattacgttagtacgaaaaaaacattaataaaaaagggacaacgtgcctagataataaaaaaaaaaaagcgggagagccacaaaacgtttgggggagaagaagacaaaaaaagtgttattggaatc

SEQ ID NO: 687860 - DNA, 140 bp, Homo sapiens
atgcagatcgaatcgagccggtaccgaaagtcctagatggcatcttcttccaatttaagaggtttgtcgtacactgaaaaaatctgtggtatagcacagctggctccataaactcatcttagctatatcttctggacttc

SEQ ID NO: 687861 - DNA, 870 bp, Homo sapiens
ccaaggttgaaatgaaggaaaaaatgttaagggaggccagaaaggtcaagttacccacaaagggaagcccatcagactaacagtggatatctctgcagaaaccctacaagccagaagagagtgggggccaacattcaacattcttaaagaatagaattttcaggggccaggcgcggtggctcacacctgtaagcccagcactttgggaggctgagacaggtggatcacgaggtcaggagatcgagaccatcctggctaacacggtgaaaccctgtctctactaaaaatacaaaaaattagccgggcatgatggagggcgcctgtagtcccagctactcgggcgacagagcgagactttgtttcaaaaaaaaaaaaaggattagaattttcaacccagaatttcatatccagccaaactaagcttcataagcgaaggagaaataaaatcctttacacacaaggcaaatggcggagagatttggtcaccaccaggcctgcctttcaaggggtcacaggtgaggtgaggctttgagaaatcacggtccttcagtacacctggtactaagaattggagcggggtaggaaaattcttggctaaggtcactcagtaaatggccaagcttagtatggttcccttaactgtttggagccacttcagaagaatcagggtctctgtgagaaagggctgtactcggagctaagtctttattcaataagtctgggggtccttggacacgagggtgtcacttccatggggggagctcgttgcgcacagtgcaacgccgaacaccagggtgcaagtgtcgtcccacaagttaacctacaaaggcttaatggagccttggaaggtaaggaggttcctttaaccaa

SEQ ID NO: 687862 - DNA, 668 bp, Homo sapiens
gaatcccctggtacgggagtggggtaggggtgggggtatgaagagaggctgattaatgggtacaaatatatattcagaaaaaagacctagtatcctatagatcagtagggtgactatagtttaccctactatagattatggattatagtataatctattgtacatttccaaatcgctagaaaggaataattagaatgcttctagcataaagaaagaaccaacatgcaaggtggtggctatcccagttacctggatttgatctctacacataatatgaatgtattaagttatcacaggtaccccgagtatatgtacatctatcatgtgtcaataaaaacaagcaagcaagcccatttcgggcgtgacgttgtttcactgggcttcgctttactgtacgtcacaggggctgcattttaaccaagtggaaggtctggggcagccctgtgtccagtgagtctacgggcgcctttttcaacagcctgtgcttggtgtgtgtctctgtgtcacattttgctcattcttggaatatttcaaactgtttcattaatattatatctgtgatggtgatttgtgattagagatctctgatgttactataattgttttggggtgctatgaactgcagtatatacaactgcaggctaatcaagaatgtgggtgtcctgacc

SEQ ID NO: 687863 - DNA, 123 bp, Homo sapiens
ctaattggttcttcgatgacgtctattgcctacccacagcatcttgggctctagacaccagcgccacatgttaagcgcttgacatgtgcaggctgaacgataccatatgccagggctttcagt

SEQ ID NO: 687864 - DNA, 138 bp, Homo sapiens
gtcccgattttctcctgcttctgtgcccggacattgcgacttcccgccctgtgaatccggaggtccccttgaaccatcgaagcctccagtcattgagtgctgagccccactgtttacaggaatccagagagtttcaag

SEQ ID NO: 687865 - DNA, 939 bp, Homo sapiens
gctgctccggagggcacgggctccgtaggcagcaactgcaaggacccctccccctgcgggcgctccgctatggcacagttacgcgttcgagagtgacctgcaatcgctgcttcagctggtatgcacccatccccaatgtaccccactgtcgcgctggcagcgcggagccaaggaagccggaggccctggaccttctcatcccagtgcgggcctggcaactcgatcactcacagagccgtgccaggacatccgagtggcctgaaacatccgtggcaagatccagttccaaggttcagaccactccatagtcaaagctggtggtgtaccgctatatcccccatcgcagtgctgcccagatggaggtggccaggctttcctcctgtagcaaggagaaccaggcctgaaagactagacatgaggtccaaccaagaaggaacctcagaaagcctgggctttgaacctgaacggttttgatgtacgaggaagccaagatccttcggctcagtggaaaaccacaaaatgcgccagagggttatcagaacagactgaaagtactctacagcacaaaaggccactcctggctccagccggaagaccatgcgttacattccttccctgccagaccgtatcctggatgcgcctgaaatccgaaatgactattacctgaaccttgtggataggcagttctgggactgtactggccgtggcacatggacaacagtgttgtacctgttggaggtgcaagctactaggtgacatcctgcacgcttttgcaaattggatgccgccctggggaccatatatattcctctgtggactggattccagaagggccaactacttggcttgttggcacagacagagctgcagttgcgctatgggatgtgcaaaaggagaaaggggttcgacatatgacaggcacactcccgagtggatccc

SEQ ID NO: 687866 - DNA, 444 bp, Homo sapiens
  misc_feature (35)..(35): n is a, c, g, or t
ggctgggtcgactccgaggatctctactaaatggncgttacccaaaggggcgttacctaaatggctgttacctaaagggctgtccatctgatcagcagcaactgattcatttctccttcttggacttttatgtttattttcacatttcatagcctgaggttattactaagggaaaggaagaaaactgtcttccacttccatgagaaagataaattatggtatcactttataacttggcaggaacactctgtacttacagtatcataatctatcccacaagatgattaattctagggaggaaaagtataaattgtatatagtacattcctgttcatcttggagtttagtttactagtttggaggtaacttatgcatcacattttctgaaactggagctagaagaggaagatagtctaatccagggaaattattcagagaccttct

SEQ ID NO: 687867 - DNA, 165 bp, Homo sapiens
cgacgccagtgagattcccatgcggggaagaggtggttttgacagaatgctcctggtcggggtgggctcccatgcctccatctagaagagattattgatgctatcgagccctcgtcagagaaacagcatcccctctcctcccggaacgagacggaccgggatggc

SEQ ID NO: 687868 - DNA, 894 bp, Homo sapiens
gggagtgatgggatgctccttagatgctatggtccttctctcatactacgaactctgactccttccccatgggtaaggtcatctatgctagtacaggtcccttatccctgtaatcgtcctcagagtgttgaccacgcacggactgaggacacatgccatgataatattgtctcgattacataggacgcacagagaagtatgtcatcgatataagcaaagatgtgttcacgaatactggttgtgacgtattgtaccgtactgatattctggctacatgtaaagagatcgcgcaacgtggcatggttgtgataggtcccagtaacagggcaccactaactttgagattaatgctgggtgagtctgtgaacaaatagttcggtgacaaaagtgatgcgttccccgcattctcgcagaggtctactcaatgtggtgcactccaggtatctcgactttcacaagttttgttgtccttctctcacattttgctcactcgatacctgacagcacgaaccgagagactagcatcatgaagagatctggaaatacatgtcgcacggtgtcgggaggaagatgagaatcgagctgtcttgccaactttctgtattgtcgtccttattcagaattagctgggactatgtctggcaacgaggttggtgtgacggatcaagattgttgctcagtgtctgcagggttgcgtccagttactcgtcaaaaggcagtcccatttactacacaaaaggtctgggcctccaagtaaacgggttcacgcaatggagctacggcccgcggggatctcttttacccccaaatatttggccgccctcgccggacagggaacacaaactttcgggggccggaagcgaacttgctttgaccaaaacaggccaacgggtc

SEQ ID NO: 687869 - DNA, 347 bp, Homo sapiens
ggatccctctccgagtggcttcatttaaaagtctccttatagccagcatggtagctcatgctattatcctagcacattgggaggctgaggtgggcggatcatttgaggccatgagttggagacaagctgggccaacatcgtgaaatcttgtctctactaaaaatacaaaaaaatttagccgggagtgctggtgtcttcctgtaatctcagctactcgggaggctgaggcaggagaattgcttgaccctcggaggtggaggttgcagtgagccaagatcacgccactgcactccagcctgggcgagagagcaagactctgtctcaaaaaataaaaataaaaataaaaa

SEQ ID NO: 687870 - DNA, 265 bp, Homo sapiens
ttcataattcaaggcagcatttgtagggcagcactcagtcatagcagcaggtcagcagtttttcttcgtgcatcagtggttcagtggcataagtggcgttggcttgcccatgattgtgcaggggtcaggcagtcaggtcagttagtattcaggcaggggggttgttcagggggtcggcaggaacacaggttggggacacagctcaacataggttgttgttgcatttggttcacacacaaatagtcagggggcatgcatgctcaat

SEQ ID NO: 687871 - DNA, 277 bp, Homo sapiens
taccagaaacattagaaatcatgtgcaatttaatctttacacaaataaaggaaaactatcacaatgcctgaataatgaagactcccggagaaaaagaaaggcctgtccccgaggatgctcttcattttctctcctggactcagcgcggcgtgcacccggcgagattcactccgcgctgatacacgtattaatggtattctggctggaagagagtggatgttctccggtgattgcccgtgcagctgtgactcagttctccaactcataacaatacatt

SEQ ID NO: 687872 - DNA, 102 bp, Homo sapiens
cttctttaagcggacggtgcgcaatgactgacctacacctgctgcgaaacaaggactgctgattgacatgcggcagggaaccggtgcctgtactgccgctac

SEQ ID NO: 687873 - DNA, 139 bp, Homo sapiens
tcgtggtggtactcgctcccgtacagagcaggattaccatggcgacaacagcatcatcagtgaggtaaaatctaatctgtctcacgatggtctactaacagctcacgttcccgtattagtgggtgaacaatccaacgct

SEQ ID NO: 687874 - DNA, 226 bp, Homo sapiens
gagcgacgaaagtgcgctggagtggatcaactctaggctcgaactcattatgaaaagtgggaagtacgtcctggggtacaagcagactctgaagatgatcagagaaggcaaagtgatgttgttcattctcgctatcaactgcccagctttgaggaaatctgaattagagtactatgctatgttgtgtaaaactggtgtccatcactacagtggtatcgataaatat

SEQ ID NO: 687875 - DNA, 351 bp, Homo sapiens
agatctataacgagataagccatatgtgaaggataaccacagagaaaatccacaaggttgtctgctatatcctgctcctctaaaaccaggtccatatgccattaaaggcccttggtaacagaaaggaaagaaggtacccaaagcgggtaaggggaataaccctgcagaaaatggaaatgccaaaacagagcaggcactgaaagctgaagctgccggagataccaagtgaagtgtgtgcatttttgacaactgtggacctctggtgactgtacggtttgaaatactattttttatcaagtcttatataaatgcagaattttgttttcctttgcttattttttttaaaagcta

SEQ ID NO: 687876 - DNA, 1798 bp, Homo sapiens
  misc_feature (1003)..(1003): n is a, c, g, or t
  misc_feature (1335)..(1335): n is a, c, g, or t
tatttattcttgttgttattttagttgtatctctctcgagtttatcttgtttttgtatttatatatctttatttgttattaaccgatttatagcttgagtgttgctatcttctatctttatgtcatatttcgttgctacaaagtattgtgtatgttttttgatactcttaatttgttttattggtttttattatttatgtaatctacagaagcgacatcgactatttgtgagtattccttcgttttgtatgagtttattcatgtatgctacttctacccgttttttatatgtgtcatcttcatgatttggtagattaaaatgtttgatttgtcttaatttattaactataattattagtgtcttttgtgttggtttgtgttggtgtgtgggtgtggggtgggttatattagtttggtgtgttggttcgtccgcgctccggttgcttgtgtgatcgcccgacacccaggttgtgtaagtgttcactgtacccctcttattgtggggattgttaataaacaacgcaataatctcgacgatttttatttgggtggactcacccggcattatgtgggagatcctttcctcgtaatggggagttctcccccaacccacaaagtgtgtgtggtgagccaccacaataaataatcgtcatccggcgttgccgtttgtgtggtttatagatcttgctttccgtgcttccctctctcttggtgttactctgtgatcttaccacggggtgctttcttcttataagggtttttgttcctcggaaggcgcccccctttttgtggttgttgcccgaaataattttcttctggcccctctcgagttggcccaacagaagattccaaaagaggtggtgaaaaaaagtgtagtgattaccctcccccccattcctcgggggggaacattgtcttgtcgaattctcccgccgcgcatacaactcttggtgttgttgccaaaaaaaaaaatactgctttttttttggggggagagatattngtgaagaaacacacagaatctgttaattacctccgcagagtcaccaccccccacacaggtgtgtttttggggagacacacacctcttcacacacagggggcacagaaaccccccctcctgtggtgttttttgtccacacacagtcttttagatatatcacccctgtgtcacagagatctcctcttttttgggcacactctctcgtgagagagaatattgtgataaaagagatttgcgtctgtgtctcacactctgcacacacacgttttctcgagagaggcgcccacacagcgcacaagagatagaaatattctctgtgggagagaaagggntttttataaacagggtgttcgcgcgagagatatatgtagaggttaatatagagaaataacacacacacttttttcacaagatatacgtgtgagaaacatttttgtgtatttttgtggagataccacaggagaacacacacatcgcagatattcggggtatatcacacaatatatgagaccccacgccacatgtgtggattttatcggcctcggaacttttatattgtggtggctcgggtataggccacaggttttaagcacttgcacaacacacaagaaagcccacaggcacacaggctgcacattgtgggcgccaaacacacacagaaatcacaccacaaagaaggagggccacatgcgctgggtccccacagaaagatatgatggggtcataccttcctggccaaatataatttcccgttttatccccaaagagccacattaaaagagtttccaatggaaa

SEQ ID NO: 687877 - DNA, 672 bp, Homo sapiens
tttttttggagcgagggggaactttactattgcaaggctcttttattttacatgaagtatcataattttaactctaaggctgtgataagttaagaatgtatatcataattctcagaaacactgtgaagcaataatgcgaaaagatacagtttaagccaacagaggaatttagatgaaataccccaacattaattaacccaaaagaaagccggaagttaagaacaaaggaacacaaaactgaatgggacaaatcgaaaacaaatagcgaaatgatagacaaactcaactatctgttgtctataagagaagcgcatttaattaaaaaacacagggtggaagttaaaacatgggttaaaatataccagtaaacagtaagctaggaaggctgcagtggctatactaatatcggatgaattagacttcaagataaggagtattatcagcaataaagacattttataatgagtaaattgtcaattcatcacgaagacacacgaaccatatatgtttatatgcccaataacagagcctcatgcacaagaaagcttgcccttaagtaagtgcaatttacagccctaggtaaggttacactcctggtcaataattatagcacacttccattaacaatcattccatttaagatctgagacacttttcaccttataccttgct

SEQ ID NO: 687878 - DNA, 796 bp, Homo sapiens
cctggtgggcgcggccccttggattgcgcggtggctgcgggcccagggtgtgaccgaggcaccggggcggtgccaattccatatcgcggcttctatttttgccgcgccggggcccttggggggggcttctttaccccgcgacgtgctgacggctggtgggtggcccccgcccccgagaaggtggtttacaccccggcctcagtgtgaggtgtcttctcacgagcagttctttggcgggcgcacgaggcgctcgccctggggtggaccacgccccgcggtcccgagcgttgcccgtggttcccgcctggtggttgtgcagactctccccgggagttcacccctgccccgacgggcccttcccgcgggtaggccttgctgcttatctggtggcgacatgcctgatcccccctgctcagtaattggcctttcgccccccgtccagactgttcggcggagccattgggggtctcgccgattgtgcccactcctgtccaatggccgctctacatgacccctcccgtggcttccctcacccccctgccttttttcccccaaccggccctgtggcggttcccccccacggcttgcccctctgggtcccctctcccccatggctcctcctgggccggcgagctacctcggggccccttctgcccggagtgttgcatcgcgtgagactgaggcggtctgcaggcaaacactatttgcgggccgccgggccgactctttcattttggggcggggtgagcgttgtgggcccaaatttccctaattacaaacccgaactttcataaca

SEQ ID NO: 687879 - DNA, 734 bp, Homo sapiens
  misc_feature (40)..(40): n is a, c, g, or t
  misc_feature (103)..(103): n is a, c, g, or t
  misc_feature (117)..(117): n is a, c, g, or t
  misc_feature (136)..(136): n is a, c, g, or t
  misc_feature (155)..(155): n is a, c, g, or t
  misc_feature (186)..(186): n is a, c, g, or t
  misc_feature (214)..(214): n is a, c, g, or t
  misc_feature (295)..(295): n is a, c, g, or t
  misc_feature (366)..(366): n is a, c, g, or t
  misc_feature (424)..(424): n is a, c, g, or t
  misc_feature (431)..(431): n is a, c, g, or t
  misc_feature (439)..(439): n is a, c, g, or t
  misc_feature (453)..(453): n is a, c, g, or t
  misc_feature (460)..(460): n is a, c, g, or t
  misc_feature (462)..(463): n is a, c, g, or t
  misc_feature (479)..(479): n is a, c, g, or t
  misc_feature (489)..(489): n is a, c, g, or t
  misc_feature (519)..(519): n is a, c, g, or t
  misc_feature (710)..(710): n is a, c, g, or t
ggctcaccctgctctctgcgggccacgtgatgggaaaggngctgcctgtgttcctcccgggctgccggggtgggcactggtcagccactccttctcggtttcnggttgtggggcgangggggggggggtgcttgcngttgtgcggacaagggggngggtcctccctcctctttcagggtctctgtntcccccacagggcatattatgcccagcntggtcccacttgctggcacttgcctatcttaggctgcggccttcttttgctttggctgatgggggatcaagattctgtgantgactgctcttttcttgacacaaagcagccacagaacactttcctacatacagtatggcagcgggcaagcngaaggccctgctggctcggcttaaggcacttgatagagacacaaggtacatcctcctnccctgcngcccccanaggcctcaggggancctgtgngnncaccctttatcctcangtccccttanccctgcccctccctactgctgggcaatgangaggacaggagcgtgccttaaaggaccatggtttggtgggagtacagggtaggaggatgaggaaaacaagaagggagctggagatttggccaaggagcaacttcagaaggacaggagagcacgagcattaggaggaagccaaggcagcagcagagggaagccagttaagtcatgagagaccaacggcagtnatgtttgctggcgcagatgcagaa

SEQ ID NO: 687880 - DNA, 364 bp, Homo sapiens
gaattcccccccccccccccccccctggagaaaactaaattctcatgggaaagtggttataaatgggggattgttacaaggtcagggagggtggggagtatctactcgttcaggattgaggagtccatctgatgaagacctgtgaaggtcctgtatatgctgctccagtctctgtgattacatatttccttggatcctgttgactaagaaggcctggttacctgggggtcctccatcccctctagcttaggtgttattcccactgaatttcttgagctctgaggggagagatttaatggagacatcccgttgtagatctgagtgttacattaaagacgtgagccaccatgcccggttgcttatg

SEQ ID NO: 687881 - DNA, 630 bp, Homo sapiens
  misc_feature (13)..(13): n is a, c, g, or t
  misc_feature (15)..(15): n is a, c, g, or t
  misc_feature (27)..(28): n is a, c, g, or t
  misc_feature (127)..(129): n is a, c, g, or t
  misc_feature (143)..(143): n is a, c, g, or t
  misc_feature (165)..(165): n is a, c, g, or t
  misc_feature (167)..(167): n is a, c, g, or t
  misc_feature (169)..(171): n is a, c, g, or t
  misc_feature (182)..(182): n is a, c, g, or t
  misc_feature (184)..(184): n is a, c, g, or t
  misc_feature (195)..(195): n is a, c, g, or t
  misc_feature (203)..(203): n is a, c, g, or t
  misc_feature (209)..(209): n is a, c, g, or t
  misc_feature (228)..(228): n is a, c, g, or t
  misc_feature (248)..(248): n is a, c, g, or t
  misc_feature (258)..(258): n is a, c, g, or t
  misc_feature (264)..(264): n is a, c, g, or t
  misc_feature (274)..(274): n is a, c, g, or t
  misc_feature (276)..(276): n is a, c, g, or t
  misc_feature (286)..(286): n is a, c, g, or t
  misc_feature (294)..(294): n is a, c, g, or t
  misc_feature (296)..(298): n is a, c, g, or t
  misc_feature (309)..(310): n is a, c, g, or t
  misc_feature (320)..(322): n is a, c, g, or t
  misc_feature (325)..(326): n is a, c, g, or t
  misc_feature (328)..(328): n is a, c, g, or t
  misc_feature (335)..(335): n is a, c, g, or t
  misc_feature (338)..(338): n is a, c, g, or t
  misc_feature (341)..(341): n is a, c, g, or t
  misc_feature (343)..(343): n is a, c, g, or t
  misc_feature (345)..(345): n is a, c, g, or t
  misc_feature (350)..(350): n is a, c, g, or t
  misc_feature (356)..(356): n is a, c, g, or t
  misc_feature (362)..(363): n is a, c, g, or t
ggggaacaggatnanagacagagccanngcagggctgccccaccaggccccggtgggtttgtctgcacttggtgctcctgcccacaccagccactttggtgacaatgacccttccaagaatctttgnnncaaggagcaccagntccctcttcattcttgaagcangnannntttgaccgggngnttgtcgcccangaagtggngctcgnaacccataactaacacctnccacccttggaaaccatgtnttctgggggngagatnaccattctgngnctaagactgnttcaaagnannnctcatagactnnctggtccagnnnacnnanggtacancantgncntnacagngacagngtcatnnggagctcgccctacccaatcaaccctccttattctagacccctgtctgtttcttcatttcctcgacccctaagatcatcgattccccttccttaagataggcttttctctctctctatctcttttttccttccttatcttttatcttcccctttgaacactctaattctctttctcttctccgccccttgtttttcctcttccctcgcccctttttttcgccgtgtctttttttcctcccctccactccatattgaccctaaaccaa

SEQ ID NO: 687882 - DNA, 161 bp, Homo sapiens
  misc_feature (69)..(69): n is a, c, g, or t
  misc_feature (140)..(140): n is a, c, g, or t
agaagatggggctttcaaagcgttaaatgaaacacagaagccatggccaggcacggtggctcatgcctngtaatcccagctctcagggaggcaagaggcaggagcatagcttgagcccaggcgttcaagacctgcctggnaatatagcgagaccccgttct

SEQ ID NO: 687883 - DNA, 502 bp, Homo sapiens
cctggaagccggctgtgtacaggcagcttgctagacaggtcataagttaacgaatggcaggggccgggggcagggagagtcaggccagagccatggctctgagaaaccctggcacacgtataggccaggagccagggatgggctcttctgcaatgagtactgtatcagggccgactgcacacgggagaaaagccgtttacatgtacctggcccacgtgccattactcattcctcacaggctccgcgatgaaagaacactacaggacgcacacaggcgagaagtcgtatctgtgtgacctctgcggctttgccggcgggacccggcacgccctacacaagcatcgcagacaggacacaggagaaaaaacttatcaggtgcgatgagtgtaactttggctccacaactcagtcccatttgactcggcataaacgtgtacacactggagaaaaggcctacagataccccctgtgtagatacaggtccaactgttgtgaaaatatc

SEQ ID NO: 687884 - DNA, 622 bp, Homo sapiens
  misc_feature (13)..(13): n is a, c, g, or t
  misc_feature (15)..(15): n is a, c, g, or t
  misc_feature (27)..(28): n is a, c, g, or t
  misc_feature (127)..(129): n is a, c, g, or t
  misc_feature (143)..(143): n is a, c, g, or t
  misc_feature (165)..(165): n is a, c, g, or t
  misc_feature (167)..(167): n is a, c, g, or t
  misc_feature (169)..(171): n is a, c, g, or t
  misc_feature (182)..(182): n is a, c, g, or t
  misc_feature (184)..(184): n is a, c, g, or t
  misc_feature (195)..(195): n is a, c, g, or t
  misc_feature (203)..(203): n is a, c, g, or t
  misc_feature (209)..(209): n is a, c, g, or t
  misc_feature (228)..(228): n is a, c, g, or t
  misc_feature (248)..(248): n is a, c, g, or t
  misc_feature (258)..(258): n is a, c, g, or t
  misc_feature (264)..(264): n is a, c, g, or t
  misc_feature (274)..(274): n is a, c, g, or t
  misc_feature (276)..(276): n is a, c, g, or t
  misc_feature (286)..(286): n is a, c, g, or t
  misc_feature (294)..(294): n is a, c, g, or t
  misc_feature (296)..(298): n is a, c, g, or t
  misc_feature (309)..(310): n is a, c, g, or t
  misc_feature (320)..(322): n is a, c, g, or t
  misc_feature (325)..(326): n is a, c, g, or t
  misc_feature (328)..(328): n is a, c, g, or t
  misc_feature (335)..(335): n is a, c, g, or t
  misc_feature (338)..(338): n is a, c, g, or t
  misc_feature (341)..(341): n is a, c, g, or t
  misc_feature (343)..(343): n is a, c, g, or t
  misc_feature (345)..(345): n is a, c, g, or t
  misc_feature (350)..(350): n is a, c, g, or t
  misc_feature (356)..(356): n is a, c, g, or t
  misc_feature (362)..(363): n is a, c, g, or t
ggggaacaggatnanagacagagccanngcagggctgccccaccaggccccggtgggtttgtctgcacttggtgctcctgcccacaccagccactttggtgacaatgacccttccaagaatctttgnnncaaggagcaccagntccctcttcattcttgaagcangnannntttgaccgggngnttgtcgcccangaagtggngctcgnaacccataactaacacctnccacccttggaaaccatgtnttctgggggngagatnaccattctgngnctaagactgnttcaaagnannnctcatagactnnctggtccagnnnacnnanggtacancantgncntnacagngacagngtcatnnggagctggtcgtgcccagccaaaccctcctttttcctagagcccagcccgcacgcaggagttcctggaccctcaggacagtgaacttccataccccagggcaggcctttgacccacttcaggagatgagaccagccttctggcttcacctacgatttattcttggtctctgcctctcctggaattttgaacctttttatactcccttatgcacaaccacttttttaaccgatgcctttctctgcacttctaggcctaac

SEQ ID NO: 687885 - DNA, 654 bp, Homo sapiens
cagattatacacacacacaacaacaaacacacacacatattcatttttttgtttgagatgagtctcgctctgtaccaagctggagtgcagtggtgtggtctcagctcattgcaacctctgcttcctgggtccaagtgattctcctgcctcaccctcccgagtggccggtactacaggtgcacaccaccatgcccagataattttgtgttttagtagagacagggttcaccatgttggccaggatggtctcaatcccttgacctcttgttccacctgcctcagcctcccaaagtgctgggattacaggcatgagccaccattcctggcccaagttataggtatattaaaggccttattttttttttaatgggaccttgtttggctgaaaaaaaggattctcagtcgactgaattcttttctccatttggttttcccactttaatacatgcatgagaggccaataatctaataggagatggggaaccaaaacatcttatacgctacgggatcctttggcctatgtactatatatgcgacgatctatgtaatgtctattcatcaagctctaatgacctagaggaacataagtttgactcaaatatctgagggcacagcaccactgtggtcattgagtccctgactatctgggaatcc

SEQ ID NO: 687886 - DNA, 589 bp, Homo sapiens
cgtggtggcgggcgcctgtaatcccaaccactcaggaggctgaggcagaagaattgcttgaacctgggaggcagagactgcagtgagccgagattgtaacactgcactccagcctgggctacagagcaagactgtctaaaataataataataatagcgtactgtatacttggtcaggcatggtggctcatgcctgtaatcctaatactttgggaagctgaggctggaggattgcttgaagctgagttcaagaccagcctgggcaatacagcgattcttagactctacaaaaaatttgtttaaaaattagctgggcggctgggcatggtggctcacgcctgtaatcccagcactttgagaggctgagtgggtggatcacctgaggtcgggagcctcgagaccagcactgaccaacatggagaaactccacctctactaaaaatacaaaactagctgggcttggtggcgcatgactgtaatctcagctactcgggaggcttaggcacggagaaccagttgaacaccagcaggcagaggctgcagtgagctgagatcatgcactgcactccagcctgggcaacaagagtgaa

SEQ ID NO: 687887 - DNA, 344 bp, Homo sapiens
cacgcttgtgctaacaacaaatttctcagaacatatctggcatttctgaggacgtatctccattgttaagtgacacattaactgtataaaagaatcttcatcctctccaactgtggataatgtcacatttcttaatttttgccaatctcacgagagtagatggtcacttgtaatctttattttgaaattctgtgattactaatgatgtgaagtatcttttcatatttttttccaccatttatgcttcctcttctttgaaatactagttaatgctttttgcacatttttctttttcttttttttcttttttctttttcttttttttgttgtgggcaatcaagctt

SEQ ID NO: 687888 - DNA, 277 bp, Homo sapiens
ggagcatcaagacatacttcctgaaatcttacagacataatctctactcttatttatttatttagagacagagtctcactcttgtcaccaaggctgcagtccaactggcatgatctacagcctcacaacaacactccgcacatccgggatatcaagcaattctacctgacctcagcactccccaagctagctggcgcgtcacagcgtgcgcgccaccatgtcccggctaaattttagtgttttcagtaggagacggggttactccatgttagggggg

SEQ ID NO: 687889 - DNA, 285 bp, Homo sapiens
tgattcgactcgagctgagtaccctcataaggccaaaccgagattagtctcactctgttgcctaggctggagtgcaatggcgcgatctcggctcactgcaacctctgctcctcgaattcaagcgattcttctgttttgggctcctgagtagctgggattacagatgcctgacaccacacctggctaatttttgtattttttgtggagatggggttttgccgtgttggccaggccagtctcgaactcctgacctaaggtcatctgcctaccttggcccttatcgag

SEQ ID NO: 687890 - DNA, 457 bp, Homo sapiens
catgtaattggtaaagtataggcttgagtacgtgtccggccgcatgtgtaatgaaccctaaagctttcctaatttgtagttagcatcgtccctaagcggaacgatttcccgtgaaacaagatttgtacttttctacgagccgtacagtatacggagaagctgcacaggtcctcggcaaagcagatgcttttgccatacatcgtgcttaacaaagctgtagttgaagacggagcccagttagagaatgtggccttcaatatcaaaagatcacgctggacctagatgtatcttggagtcacccagtaaaaccatctggacgcaggaccgaagccccgaaaagcaaggagatgaagcaccagtgtctgtgaccaggagtcagagaggggaaccgacgtccactacacaaagtgaagagcggaagagattcctattatagtgggcttatgatcagccaacg

SEQ ID NO: 687891 - DNA, 245 bp, Homo sapiens
ctagctggtagcgggtgaactccacgtagttgaagttgcctttcttatcaagggggtgcctcccggtacatctcgtaccacttcctcatctgtgaaggcggacacccatggtgtgtgagcagctcccgtgaggtggtcctcatgtgatgaaacctagaggcttcctcgtacgaagcatggcaaatggcgtatgcgaattggcatcctacggggtcctgtgcctgttcagctttctccccaaaact

SEQ ID NO: 687892 - DNA, 1020 bp, Homo sapiens
  misc_feature (15)..(15): n is a, c, g, or t
  misc_feature (94)..(94): n is a, c, g, or t
  misc_feature (105)..(105): n is a, c, g, or t
  misc_feature (111)..(111): n is a, c, g, or t
  misc_feature (116)..(116): n is a, c, g, or t
  misc_feature (122)..(123): n is a, c, g, or t
  misc_feature (139)..(139): n is a, c, g, or t
  misc_feature (141)..(141): n is a, c, g, or t
  misc_feature (157)..(157): n is a, c, g, or t
  misc_feature (174)..(174): n is a, c, g, or t
  misc_feature (178)..(178): n is a, c, g, or t
  misc_feature (193)..(193): n is a, c, g, or t
  misc_feature (204)..(205): n is a, c, g, or t
  misc_feature (210)..(210): n is a, c, g, or t
  misc_feature (213)..(213): n is a, c, g, or t
  misc_feature (224)..(224): n is a, c, g, or t
  misc_feature (246)..(246): n is a, c, g, or t
  misc_feature (248)..(248): n is a, c, g, or t
  misc_feature (274)..(274): n is a, c, g, or t
  misc_feature (279)..(279): n is a, c, g, or t
  misc_feature (305)..(305): n is a, c, g, or t
  misc_feature (320)..(320): n is a, c, g, or t
  misc_feature (416)..(416): n is a, c, g, or t
  misc_feature (425)..(425): n is a, c, g, or t
  misc_feature (455)..(455): n is a, c, g, or t
  misc_feature (460)..(460): n is a, c, g, or t
  misc_feature (496)..(496): n is a, c, g, or t
  misc_feature (627)..(627): n is a, c, g, or t
  misc_feature (672)..(672): n is a, c, g, or t
  misc_feature (681)..(681): n is a, c, g, or t
  misc_feature (703)..(703): n is a, c, g, or t
  misc_feature (710)..(710): n is a, c, g, or t
  misc_feature (920)..(920): n is a, c, g, or t
  misc_feature (935)..(935): n is a, c, g, or t
  misc_feature (949)..(949): n is a, c, g, or t
  misc_feature (1007)..(1007): n is a, c, g, or t
ctgaatctgaatgcncccataggtggaacttcaaactctcaatgttcaaaacaacatcgctttttcttcacaaaatcttcattatgtttttttntggaacttatnttcttnatatnacatannttccaagctttaggtncntttgacgtttaggggnttatagatagggaacanttanttagatgctaagttnttttagttttnnttttnttnttttttttcanttctaattgcaagctatatatntngcaagttctgattaagttcttttggnatgtnttttctaatttctgaacctttccttntgctttcaaaaatgntgatagatgtttaagcttttggttgatagaagatttgaactgttgacttggatgttgggggacatttgaggactccacccctatttccaagcactnaggcaagcnaaaatattctaatataaagttatggctggnaagcnatattaagtttattcactcaataaatccagttcttntacaataaaagaaaggaagaaacacttggaacactcaaaggttagaggggggaaattactgacagtttcatgtacctctttgggcaaagggtcagttatggggatttgaggtgctcagaaaatagtctgtnttctggaagttataaaacggaatcaggtttatctaagttggagtnagggctctnacaaagtacccttgggcaaatnatctctntgggcttcagtgttctcattttacaaataatgcctaattctcagggctgtttctcgagaataaaacacatttcctagagttctgcagttacaacgatgactaaaatttattggtatgttttttacgcaccaagcacttttctttactcatttaatattcattattctgcaagagagttactagctcatttacagatgaggacacagaganattacgttatttgtncaaggacacaaggnttaaaagttgttacgtatacggaaaagccaacactgttttaatactgttacactgggnagggggaacagct

SEQ ID NO: 687893 - DNA, 112 bp, Homo sapiens
cctagtgttagaagtttcatagcatttcatctcaatatttaacaattattatgttcaagtatggaatagtaaaaagaagctaaactttatctcttggggtatggatttcagc

SEQ ID NO: 687894 - DNA, 896 bp, Homo sapiens
  misc_feature (1)..(1): n is a, c, g, or t
  misc_feature (65)..(65): n is a, c, g, or t
  misc_feature (212)..(212): n is a, c, g, or t
  misc_feature (232)..(232): n is a, c, g, or t
  misc_feature (236)..(236): n is a, c, g, or t
  misc_feature (238)..(238): n is a, c, g, or t
  misc_feature (260)..(260): n is a, c, g, or t
  misc_feature (561)..(561): n is a, c, g, or t
  misc_feature (567)..(567): n is a, c, g, or t
  misc_feature (598)..(598): n is a, c, g, or t
  misc_feature (631)..(631): n is a, c, g, or t
  misc_feature (646)..(646): n is a, c, g, or t
  misc_feature (730)..(730): n is a, c, g, or t
  misc_feature (732)..(732): n is a, c, g, or t
  misc_feature (748)..(748): n is a, c, g, or t
  misc_feature (752)..(753): n is a, c, g, or t
  misc_feature (792)..(792): n is a, c, g, or t
  misc_feature (836)..(836): n is a, c, g, or t
  misc_feature (891)..(891): n is a, c, g, or t
ncggaggtaaaggaagataaggggtttaaaaggaaaaagcgagtgaggatgtacgtgaagtggtnttgaaacaattatccgttggctacaaagatcagtaacgagaaggggatggccagtccaaggttggacaggcagtggctgctgcataatgtgccttgtaagcattgtgttttgtgtgagttttggtggccgttgtgtgcaaggttgtngtttgtggcaggtgcttttntgcnanttctttatatcaggcaattatnagtgagaactttcccatcacggctttccctgactccattctctgacagctttcacaatctagagtcagaatcccggaggagaggagtaccaaatagcttaagagtttttttttgtttttgttttttttcgttaaaaaaaaaccgctaaactctaccctgatcagtgaaaagaatttatgcttgaaagatgcagtttcttcttggcagattcagacaagaagtgcggcggaagcttacacctgcacgtggtgggacagaggcaatgaacggatggtctggctgaggctgagagaaccaagcnggattnggatcggcttgagggcccggcgtcgtcagtngtggacctctctgacctgaggcaagttagtcangctggactgagcgtntaaacgtcgggtgtttttcaatgtgacgcgctagaataatccctttatctttcccaacttttgtttgttgagtgtaggcaactntnatgaatggaaaggaancctnnttgtactttaaatccgagaacattctctactctccagancaagtgatctgcaggcgcggcatgtggaatccgtgaggccagcngtacggcgggccgccccggacccaggctttgctcctcactttccgctgtttttantgcgg

SEQ ID NO: 687895 - DNA, 241 bp, Homo sapiens
gctcctctatctcttcagagtctggtcatgtggaggtggggtttcttgggatgctggagaagagctgccaggaaatgtctattctgggtcagtaaataacaacggtcatagggagggaaattctcagtaatgccagtcaactctaggttacctttttaaatgaagagtagtcagtcttctagattgttcatataccacctctcaaccattactcaaacttccagcgcccaggtccaagtct

SEQ ID NO: 687896 - DNA, 123 bp, Homo sapiens
agaagatcacctctgtataaacgcagcatcttaaccagctgaccattagccataaggaacatgggaatcaagtcaacattccagtctcttcctctccccatagactcgggaggtgatcttctg

SEQ ID NO: 687897 - DNA, 165 bp, Homo sapiens
tcgcgcgtccgccggattcgtcgtcgtcgtatcgaattaccagacaaatcgctccaccaactaagacggcatgcacgagccgactaattcccggaagtcgtcgtcgtggttatcggaattaaccagacagatcgctccaccaactaagaacggccatgcaccacc

SEQ ID NO: 687898 - DNA, 369 bp, Homo sapiens
  misc_feature (182)..(182): n is a, c, g, or t
  misc_feature (185)..(185): n is a, c, g, or t
  misc_feature (196)..(196): n is a, c, g, or t
  misc_feature (198)..(198): n is a, c, g, or t
ccgcaggtccagcttggtgcccaccaggatgatgggaggactacgaccgtctccggccgctctcctatccacagacggacgtcttcctcatctgcttctccctcgtcatcccagcctcttatgagaacgtccgcgccaagtggttcccagaagtgcggcaccactgccccagcacaccatcntcngtgggcaccangntgacctgcgggacgacaaggacaccatcgagaaacttaaggagaagaagcttggctccatcaccttaccctcaggcccttggcacttggccaagaagattgactcggttgaattacctggagtgctcagttctcaccctatgatgaggtcctgaaaacccgtgttcgacga

SEQ ID NO: 687899 - DNA, 871 bp, Homo sapiens
  misc_feature (297)..(297): n is a, c, g, or t
cttctgaaaaagcttgcgtgttaaaggtcgtgtaaaagcagtcacggttggccacagcaattatttgggggaagccaagtgtcgcactggttcacgcgaaagaaagacaatttggtgcgcccaaccacatgcacaaatgtgtgtggacctcctcgcttttcttcccccagagtcttggttaggagggtgtcttgtgcatgaactcactgctcctcttttgtgtaaagggggacagaagtatgattttctctctgcacgcgtagcgcgccccctcctcgagaagatggtacactaacntgggggaatatatcccgagggttcatcaacacgtgtctgccccggggaagaagcataactctttgcggggtgttgtttgaccccgcccgtctgtcgagagcgagaggattggataaaaaaggggtataagagggagacactggcgccgacactccgtcggtgatgaaaaggtgtaccaagttggctttgccccctcccacgcaggtggttccacattttactgggcccgcgtgctagtttcggaagaagggaagactaatacatgagtgagatttctctcttgccggagaacacttgtcgagagtcgacctcttgtttatctagccccataaaattgtgggggtttcgagatcgccacctcgtggtgttgtcgccacaagaatgtttgtgggcacacccccgggggaaataagaaaagggaccgccggttgtctaggcgacagaattacttttatttgttgggggagatgccccggggctagattttgtttccagggggagaagacgaccaccctctcactctcgtagacctatggctaagaaacccggtaaaccacccaacggcaacaaaaca

SEQ ID NO: 687900 - DNA, 986 bp, Homo sapiens
taccgggatggctgagtccatgaccaggtgcccttcgacggcatgtggattgacatgaacgagcctgccaacttcatcagggctctgaggacggcatgccccaacaatgagctggagaacccaccctacgtagcctggggtggttaggggggaccctccaggcggccaccatctgtgcctccagccaccagtttctctccacacactacaagctgcacaatcctctacggcctgacctgaatgccatcgcctcccacagggcgctggtgaatgtgctcgtgggtgacacgcccattttgtgatctcccgctcgacctttgctggccacggcctgatacgcctggccactggactgggggacgtgtggagctcctgggagcagctcgcctcctccgtgccagaaatcctgcagtttaacctgctgggggtgcctctggtcgtgggccgacgtcttgcgtgttacctagagtgcaacacactcagagtgagctagtgtagtgcagctaggacaccagatagggagagcctatctacccctatcatgcatgaacacaacaaacaggcctgatacagtctatgccccagtgagccagtaacagctatccagcgagcactggtccaggcaggacattgaggaagtggcctcaacacctgcgctaagacactcactcttcgacaaaatctacaaaactgttcacaacccagggtctcaacgagtacgcgagcagcgacgaacatgctcgacccctggtcacccatataatttaccttggtgaagatgtaacacaccatacgttaaactacattagtgccgacctcatgtgacaccatggatttgaactgcaaacagaaagaataccaatgcttgcagagtgggtatagtgtccacatggttcatattataaaccacaatgattacatcccaagtgtccaggtagaataaggtgacgaaacagatgaaattcatccaacatatcacacacatg

SEQ ID NO: 687901 - DNA, 1018 bp, Homo sapiens
ctagtcccgggctggcgggagtgcagttctagagtccctggccctgtgcgttgctgcggagcggggcagccagcagcggagtgctgcggtgcgcagcacaccctggggaccatgggctccatgttcctggagcgaggagtgtggccctggtccagctctttctgcccacatgcgtgctgcctacacctgcgtgagtcggctgggcgagctgggcctcgtggagttcagagacctcaacgcctacggtgagcgccttccagagacgctattgtggtatgatgttctggcgctgtgaggagctggagaagaccttcaccttcctgcaggaggcaggtgcggcagggctgggctggtcctgcccccgccaaaggggaggctgaacgtgaacccaaaacaccgggacctgctgcgcatccaggatggagacggagcgcctggcccaggagctgcgggatgtgcggggacaaacagacaggccctgacgggacccaggcttgcaccagctgcaagatccacgacacgaccgtgcataaagccagtgaccatagaacctcagactggaaagccgagccacacaagaaggggcctcagaagaggacgccacttgaatccaaggcacccccggggggggccgacaaccaaggaccatgaagggtcaaacatttggttggacagggatgctcggatggagagccccaacaagggacccatgcccctaagagcgccactgcatctgggaaggggacctagcacagaggaaatatccatcatatgccaagcatattcaggggaaggctgggaagacaagccaggcagtgaaagcaacccgccgaagaaccgggacggaagagcaaagacaaacggtggaaagcaccagtatactacaatcatcacatacagggagaatgaagaccgcatacgaaaacacgaaagaatccagacaagaatacaagagaccagcaatacgaccaagacaagcgaaaaaacccagaaatgtgagacggcagaaggaaggaca

SEQ ID NO: 687902 - DNA, 161 bp, Homo sapiens
gctcggtaccctcattcagcataataccctccagttccatccacgtcgaagcaaatggtgggtatttgtcatttctaaaggctgagtaatactcccagttagatcatgctctcctatggcattctattttttttccctttcaaggatataacaggttagaa

SEQ ID NO: 687903 - DNA, 374 bp, Homo sapiens
attcatagtgcagctcaatactagcttcagtataaaaactgtacagattttagtatagctgcataagattctcgtgtagagaaaatacgttttaaaaaagtgcaggtcggtagctttcttgatggggctactcatagcaggttagattttacagctgtctgagtggttgaaatgtgtcctaaatatttaatggttgtttttaatgttcttgtggtgatggtaagcacagcaaaattggtaggaattagtatcaagtagtaaattttgggtttttgtaggatgttgctaatttcgctttgttgttagaagagagaagattttagtcaatgaataatataatgtcaatattcataagaaagagaaaaatagacagg

SEQ ID NO: 687904 - DNA, 648 bp, Homo sapiens
  misc_feature (210)..(210): n is a, c, g, or t
  misc_feature (511)..(511): n is a, c, g, or t
  misc_feature (552)..(552): n is a, c, g, or t
ggcacgagagagaactagtctcgagcatatgataccactctatgagatggaggctcgctgtgtccaggctgtgagtggacagtctcagctcactgcaacctacacgtcccaggttcagagagattatactgcctcagcctcccaagtagctgggactacaggtgtgtgccagcacacccagctgattgtcgtattagtagtagagacggngattgaccatgttgtgcagcatgcgatttatgtcttgacctcgtgagccacctgcctgagccccacgtgctgggatcacaggcatgagccagcatgcccgagcagcccggtgtctacagagtaaccgtatgcatgtcgctggcgtgatggagagcacctgcatgctcagctactcatgggctgagctgagaggactgttcgagcctgtgaggtgcaggatcgagaagtcatggcacaccactgaactcaccgtgacgactacaagatctgctaactgactagtgaactggagcggaccgangcactagctaatgagctgtacgatactgcagctttcacatngactggaacatgcgtacactagcgcttgtacatctctctcagtggtgctagatgcgtcgtgactcaagtgagcgatgaggaatgtgctttcgtttg

SEQ ID NO: 687905 - DNA, 142 bp, Homo sapiens
ccccagtttcaaacaaaatttttatgggcaaagggcagcaacctttttgtatgtttaacccccaggacgctttggacatttgtgataacgcctgttttatattcaaatgaacaaataaaagcttttatttttgttgctttga

SEQ ID NO: 687906 - DNA, 126 bp, Homo sapiens
cgactcgtggatgtagtgacgaaatacaactaatggactctttcgaggccctgtaattggaatgagtccactggatgaggtgcatgcgagtctgtggggaagatactgagtctgtggtgccacaaa

SEQ ID NO: 687907 - DNA, 231 bp, Homo sapiens
tctaccatctgctgcgagtattttcatattgcccacagtttacttagtgcactctgaatgactaacactcatgccaggaattgaggaaggtgaaagagagtgacactgtagttaattactagtctaagaaccctgttttaaagaataaccccagaaaacattaaattagaattcacagtccccgtcccacagttttccctggggctaaaatacttttaaataaaaatgtgg

SEQ ID NO: 687908 - DNA, 205 bp, Homo sapiens
cagtgacgtcggcattatgggaagaatcttcttcatccgaatcaactatgagaacgtcatcttgctcgtgacgctgtggaggtggagggctgagctccatcatcactgccatcggttatgcttttggcagcatcttcagcttgttagggccccactttttccggggcatcaccaacaaccttcaacattcaaccgtccatttcct

SEQ ID NO: 687909 - DNA, 190 bp, Homo sapiens
tcgttaccaatgtgcgactcggtcgcgaatctccgctctggtcaagcgaattctcctgcctcagccttcctgttcagattctgccccctctagtccattctccacgtgaagtcaggaggagctttggaaaatgcagattgcgtctgtgaaccctccccctccaccattacttcttcccgcttgcctcaga

SEQ ID NO: 687910 - DNA, 209 bp, Homo sapiens
tcatgggagggtccttcatcggagtgctaaagctttgagtagagtctccctggatcacataccaggtcagggaggagtctgtgtcttcctctacgtttatcctgggatgtgctagggtaaacgaaggcataataagccatggatgacctctggagcaccaggggccaggacttgtctccatgtgtatccatgcattatataccctggct

SEQ ID NO: 687911 - DNA, 755 bp, Homo sapiens
ataggcccccccaatgatggggccgtccggaaattgccaaccccatcgacaaatgcaggatcgagcgacggctcaaagcaaaagtatgttggatgataaattgaaatattagttgcggatgaagcagatagtgggaaagttgagccataatgacgtgaagtccgtggaagcattggctacaaaaaatgttaagcggtagatgccgtcggaaatggtgaaggtagactcgaaggactcttagggcttgtaggagcgtagaatagagccccagtacaattgtcataccgagtgcgtagattctgtggtctcggttgtggtctattagcctatggtgagctcaggtgcttgatactcctgatgcgagtaatacggatgtgttgggtagtgcggacttgtcggggatttagcgggctgatgcctgttggggaccagtggccccttagttgccgggtagggctgagtctggactggtaaaaggctcagaaacatcctgccaagacacaagcttctgaggtcatgtataggattctcccgtgccgaaggccttcttgcacaggtggtgtgtggtgtccttggtatgtgcttgctcgtgttacatcgcgccatcattggtatatggttagtgtgttggttagtaggcctagtatgaggagcgttatcgagtgtaagtgtagtcacatgcctaggccgtaggtaattagtcgggctgagaggccatctgctaggggtcatgggctgagacttgctctatgata

SEQ ID NO: 687912 - DNA, 468 bp, Homo sapiens
catgcggggggcaaagtggaggcagtgtgtggcccagtgcttagtactgtaatccccaagcttgttttcactaaccctgtttttagactctccctctttcctttaatcacctagccttggttccacctgaattgactctcccttagctaagagccagacagactccatctcggctctttcactggcagccccttcctcaaggatttaacttgtgcaagctgactcccagcacatccaagaatgcaattaattgataagatactgtggcgagcaatatccgcagttcccaagaatttgtcccattgataacgcccaacgacccgcgtctatcaccttgtaatcgtctttaagcccctgcacctagaactgtttactttcctgtaaccatttatccttttaacttttttgcctactttatttctgtaaaactgttttaactagacccccctgaatggggtaccgagctcg

SEQ ID NO: 687913 - DNA, 813 bp, Homo sapiens
gggattactatatgtcgatccacggcgctctgaagagacactgaggagacttcctggtatctcttcactgtgcagggtgcagactgaggccatcggcgatggtgcagctgtgatgcctgtccccacaggtcccaggcagaggatgtgccggaaccatggcggcatgttgtgtggctgtgtaccatgagggtgcctgtgaaggatactggcccgagctccgacaagagcgagtgatgctggtgagtgtcggacagaagctgtggtgctgcggtattacctcttccagggccagttgctatatctggatcgagacccagcaagccttctaccaggtcagtctcctggaccatggccgctcttgtgacgactgtctaggctggtcccgtcccatggcctcagcctccaggagcaagatggtgatggaatgtgccatttactggtgcccaactgtagatcagagatacctggtcaatgtccgtacgcctccgagcttgctggtgtacgatggccactgaacccctactatgggttccaggccgttcagggatcgctgcttgtggacttggcttgaccacttactactgggtatgcccttttgcgattcttacctcattagcctcacatctccagtctgccctgttcagctgtacgatgaccaggaacaagctaaggcccagacttctaatgggaaccatgggtcacagttgtccattgcgaggtgtgcggtgtgccggccagatgtggcgacggaagcattggggttggaccatcagttgaggctatgtgcccggaaaacttccatggtggtgaccc

SEQ ID NO: 687914 - DNA, 785 bp, Homo sapiens
  misc_feature (387)..(387): n is a, c, g, or t
ggcaggattgatatgatcgacgtcatcggggtgaccaagggcaaaaggctaccaaggggtcaccagtcgttggcacaccacagaagcatgccccgtcagagacccaccggaaggcctgcgcaatgtggtcggtattggggctatgggatcctagctcgtgtgagcctgtctcttgtggacaacgcagcatggggacatgaaagagcatacctagtcagccggcactgacagtccaccaaaaaaaagtttatatgaactctggacgaaggtctagccctctcaatcgagaaggacggacgaagtgctgaatcaagtaagcaaatgccgtccacatgtaactagtgaccttaatcatggagcgaagttgagtcaatcaaccctcctccntggggtggctgttagtctacacatactagtggtgacaggtgagcaaaactgagcattagtatatgcgtgaaaggctgtgtaggaagagagagcccaatgagaggctgagtgtagtctcatcactactcgctaagatctttgctggggcagacgaagcggccgggctctggcagaagattgagccttagacttcagtttgaaagctcaagcctcgcaagttttggccagtggccgcttccaggaccatggcacggaggaacgaaagcattcatgggaccactgaagagagaccgaattgcaaaaggacagacggaggcttaatgccaggaacagatgatgccagttggtgtggtctcaccaaagaagttattaccactgaggacacaaaatggcaccgt

SEQ ID NO: 687915 - DNA, 299 bp, Homo sapiens
agttgcatgttgtaagccatttaccaataattgttgtaggtaatgaagggcagatttattagagatattgtgaacatatgttgcagtgggcagctcatcgatagaaggggctacctgcaaagaggcaagtgctggatgatagttttatagggtcctggtgtaaggtgcgtatctcgtgaaatgaggtcattgtgcccgcaggttgtttgtgattagctgtctctaacaattgttcatacaataattgttcattattgttctcaacttggggctctccccaacctggggacccttcctta

SEQ ID NO: 687916 - DNA, 638 bp, Homo sapiens
ttttctttgtattgaacgaggatacaccaagatcttaattacatagacaacggactaagtatgtgaacagtagacagcgcccacgatgggcgcctagttgctggaatgcactggcaagagactacgcctgggagtggtcgtcgttgtattactcgaaaccacaagctactctgtgtcgtacagcgcgtgcataattgtgatcacatactatctattgatgtgactcgtacatagaagaattatatccaacgcactttgtatcatagagcgaacatctcataggcgtgggtcgatcttacttacatagcgagacaagatagaagaaagatagcgcgtggtacacggaccacctaagatacatatactcgcacgccagagggggccgctcccgcacttatccatttgcccaggcactttacacccacaaagcggctagccgacccattgggatagacatcacacctggggatgtgtcaccgcgcatacaaactggggtcgccacgatatgtgtctagtatatagtggaatctttggtccaaaggcaccgttacgcgcaaaaggagtgtccacatggggacctttagaaatacgagtgagggcacttgatacacgacgcggatgtggcgcagcttggaaca

SEQ ID NO: 687917 - DNA, 1202 bp, Homo sapiens
gtcggacgccgccgcggcgcgctctgcagactccgggtcgccgctccgccgggacgcgttggccggggcgcgcggtgcttggctgcggtgctcacactcatgaggagccggaagctcacaggtgcagtgcggtcttcagcgcgcttgaaagcacgaagttgttcggcagccaggttggcctctgcccaggaagttgctggttccacgtctgccaagacagcatgtctgacttcctcatcccacaaagccacagacaggcgaacgtccaagaagttcaaatgtgacaaaggacatcttgtgaagtcagaattacagaagcttgtccctaagaatgacagcgcttctttgccaaaagtgacacctgagaccccttgtgaaaatgagtttgctgaaggcagtgccttgcttccaggcagcgaggctggcgtttctgtgcagcagggggctgcaagtcttcctctcggtggctgcagagttgtgagtgactctcgcttagcaaagactagagatggcctgtccgtgccaaaacacagtgccgggtccggagcagaagaatccaacagcagctccactgtgcagaagcagaatgagccagggctacagacagaggatgtgcagaagccaccacttcagatggacaacagcgtctttctagatgacgacagcaatcagccaatgcccgtgagccggttctttggaaacgttgagctcatgcaggacctcccacctgcgtcttcatcttgtccttcaatgagcagacgagagttcagaaaaatgcatttcagagccaaagatgatgatgatgacgacgacgatgatgcagaaatgtaggggccatacaaaataatgtccttgagtatttagtaccattaacaatttgacaatttagcacattacaagatttatataaaatgtatctccaagagaatgtcttaatcaaacttcagaactgacccatctaagtcaatagtgcaaagcacccaatacctgtggaggatgtactcatgggaactaaaactcaaaccatctttgaggttgcaaagctgctgtactgtgccaatgtcctttctttttttttttttttttttcccttggagacagagtttctctcttgtcgcccaggctggagtgcaagggcgcaatctcggctcactgcaacctccacctcctgggtccaaggtgattctcctgcctcagcctcg

SEQ ID NO: 687918 - DNA, 1290 bp, Homo sapiens
tggtacgctcggattagggatatgtcgacccacgctgtctgctgaggagctgctgggtccagtggagcatgacctgtgcccctgcggacttccgaggccgtgaaaagccctgcgctgccggcccttcccagtgcccccgatggcctgttcgccgttcccgaagcccgactggggtgaacgagtccagcaccaaagctggcctggttctcggattccggagcgttctggagccccgacgagacgcccctgtgtggttctacgaagctcccacggggcgcccagttcccggcttcattcgggccgtcctccgaaacccactcgggtgcacgggtcgtcggcgagccgcggacctggggtccttgtgaccgcgcacacatgatccgttgtgcggacctccgatgttgccgcgcaggagctcaacggactaccttgcgggttctgccccggggcagggcgtctgggcgaattcgatgccccccgggagagtgagccaggacgcgcgacggagcccgggcctccgggcaggaggagccccttcgaaggggtccccatgtccgctccttcattccccacggtggcgacgcgaaaggttccctttctggaccgaagggggctcacttggaacaaggcccttccgaaggccaggacaatcctgtggtggccttggaacggggcaccttggaattgctccttcttgtgcgccgcatgtaagaaaccaaggctttggggacaagtctgtgctttgcatgcggcgcccgttgccaccccgcttgaacctttaccttttttagcccaggcgcgtttccttgtgacgtgccccttggcgcacattaacccgtgacacatgtgctttgccaacgccgcgggcaacttgtggctacccccatttgtggagccacaaagcgtatcccgttgggtgcacgccccaaacttacacacctttggcccgcattccacattgccgcgctttgccacgtcaccccccggtacaccatatattagtagatttgcgtgccgttttaaagcgcatttgggcataaggggtcgattacacgcacacagagttggtgcccggcaagcatttatcctttgacaaggaacattggtattggcgttgaccccctgttagaaagtgcgcagtttcactgagcggcccgttcccagacccaggtgggacaccgcaccgcgaagtgaaaggctgggagcgcaacacaccttcgaagtcgcgacggaccagtctgctcgacaacgtattcaggagattgagacgtcgcaagctacgggcccaag

SEQ ID NO: 687919 - DNA, 1144 bp, Homo sapiens
gtcggacgccgccgcggcgcgctctgcagactccgggtcgccgctccgccgggacgcgttggccggggcgcgcggtgcttggctgcggtgctcacactcatgaggagccggaagctcacaggtgcagtgcggtcttcagcgcgcttgaaagcacgaagttgttcggcagccaggttggcctctgcccaggaagttgctggttccacgtctgccaagacagcatgtctgacttcctcatcccacaaagccacagacaggcgaacgtccaagaagttcaaatgtgacaaaggacatcttgtgaagtcagaattacagaagcttgtccctaagaatgacagcgcttctttgccgtgacacctgagaccccttgtgctgtgcagcagggggctgcaagtcttcctctcggtggctgcagagttgtgagtgactctcgcttagcaaagactagagatggcctgtccgtgccaaaacacagtgccgggtccggagcagaagaatccaacagcagctccactgtgcagaagcagaatgagccagggctacagacagaggatgtgcagaagccaccacttcagatggacaacagcgtctttctagatgacgacagcaatcagccaatgcccgtgagccggttctttggaaacgttgagctcatgcaggacctcccacctgcgtcttcatcttgtccttcaatgagcagacgagagttcagaaaaatgcatttcagagccaaagatgatgatgatgacgacgacgatgatgcagaaatgtaggggccatacaaaataatgtccttgagtatttagtaccattaacaatttgacaatttagcacattacaagatttatataaaatgtatctccaagagaatgtcttaatcaaacttcagaactgacccatctaagtcaatagtgcaaagcacccaatacctgtggaggatgtactcatgggaactaaaactcaaaccatctttgaggttgcaaagctgctgtactgtgccaatgtcctttctttttttttttttttttttcccttggagacagagtttctctcttgtcgcccaggctggagtgcaagggcgcaatctcggctcactgcaacctccacctcctgggtccaaggtgattctcctgcctcagcctcg

SEQ ID NO: 687920 - DNA, 227 bp, Homo sapiens
agtgacagcactacgctgggattttccaaacaattttatttcctcagagtcttccttaatcctagggaacaggaggcggcacggaatagggcccagtagtgggggctggcttttctactccctccccccaatataaaaatatagacttttttttttttttttttttttttttttttttttttttttttttttttttttttacgaccgcgcggggggtcatagacagc

SEQ ID NO: 687921 - DNA, 126 bp, Homo sapiens
tgtaccacttggagaagtgcatgtattgaagctccaaaacaaaaacaagcaatctttgaaattgccccgtaatctacctacctacaatggtgtgtgcctgacccagtaccctttggatcctctagt

SEQ ID NO: 687922 - DNA, 612 bp, Homo sapiens
tatctcttcaggggaacactcacagtgctcaggaatcctggtttaccttatattcaactccggggaaactttctctaccagcctttactaagccttttctactttaaaagactaatttccatgccctgaatcctttatcctcagatcatctcataaaacaatctcagtgaagcaggatacaaggtaaatgtcatacatccccaacatcttaatttatacctctcaaaattttctctccacccatcttcccttaccttgtcctcagtctcaaatgagaagatggcctacctcctaaggctaaagcaatactttcggttcagcctccttacctcctctctacaacttcgctctatcaatggttctgtatttctcgtattttcaagggttaacgccaggttcctggctatggtttggttttaataaccctaaccttgctaccatcagaataataattatattactactaactgcaaaatcttataacattggtatatatacttcacactaccattcattagctattactctttaatctaacttcctatccatcactcatctgcaagtgcttcctctaaatctttataacccaatccagtggctatactcagactt

SEQ ID NO: 687923 - DNA, 170 bp, Homo sapiens
tgtagagtgctgacgggaggcagagtgctgggcctggaggggccaccaatgatgcagtgatgctgggcctggagagtgctgcaaagcaagcatgagcgtgggcctggatgagagtcaagcttgcagaagagttcagtggccgtgggagacgaagtgcttgggagtgcagt

SEQ ID NO: 687924 - DNA, 885 bp, Homo sapiens
  misc_feature (489)..(489): n is a, c, g, or t
  misc_feature (510)..(510): n is a, c, g, or t
  misc_feature (544)..(545): n is a, c, g, or t
  misc_feature (559)..(559): n is a, c, g, or t
  misc_feature (573)..(573): n is a, c, g, or t
  misc_feature (580)..(580): n is a, c, g, or t
  misc_feature (582)..(582): n is a, c, g, or t
  misc_feature (589)..(589): n is a, c, g, or t
  misc_feature (597)..(597): n is a, c, g, or t
  misc_feature (609)..(609): n is a, c, g, or t
  misc_feature (669)..(669): n is a, c, g, or t
  misc_feature (822)..(822): n is a, c, g, or t
  misc_feature (825)..(825): n is a, c, g, or t
  misc_feature (829)..(829): n is a, c, g, or t
  misc_feature (834)..(836): n is a, c, g, or t
  misc_feature (842)..(843): n is a, c, g, or t
  misc_feature (858)..(858): n is a, c, g, or t
gctggttgctgtgcgggctcttgtcaggatggtggaatgcatgtacatcgagaaaccatgccccggagaggctacagagcaggagattgcgcgtcagctcttcgagccagtatgtggaagggtgctggaatgtgacatcagttacagaattacgggctttgtgcacgatagaagacaatgactggtgagttgacggatgccgagtagcagcgaaggcatgtcatcgcatttacaacgcgttcagtggaggatgaaccgatcaagcgatggaagccgagcgaaagaataagagcaaaaccgtcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaancgaatgcacgtgcagttgtcnaccagccggcttaggactggcccgggatgggagnncagagcggctgctntcggtgcgggaaanaggggcncnggtccanagagtgtncgatagatcgtncaggccgcgtggcagacttgaccgagcaatataatgagcaatacggagcagtgcgtacgncttacaccatgagctatggggattcattgtattacaacaagcgtacggagcgctcgatgctactacaagcgctgcgtgctgccggtcctatgaggcagtggcagctgcagctgcctccgggtataattacgcagaagcagaccctgttccagntgncacnagtcnnnaatacnngcatggcagtcactnactccaactctctcaatcctacataaa

SEQ ID NO: 687925 - DNA, 544 bp, Homo sapiens
tggcatttacgccaatgtacttcgttggattagtgcattgtccagaaatggaaatgtcacgcgttgcttcggggttctggagatttggcttttaccaccttttgtgacatgcaccaactccacccttccactccctttcattatcctggatttcttctggtctttttcttccgacacatcattcttcagctggtggctggagggaaattctcacgaaggccacgtacgtgctgctttgcagttcactagctcctgcccttaatcagaggttctgatgaggcaagttctatattcccttttcttgattttccaccatcattcttgtcctcttgactattcggttccgttttctcagtggttgctgcgagctcttggggaacagggtttggcttctttatgttgatctcgatgctaccgttgtcttgtttcagctccagtggagacccgtgcactctggccacaccttcaaacatctgggatttggttaaggagtgggcaggtgccaccgtgggacactctctttccttctcctcctctctatgaa

SEQ ID NO: 687926 - DNA, 118 bp, Homo sapiens
gtcttggaaaatgggcaggagtcacatatactcgagcaggtaggaggagcattttctcttacaccatcaggttagcaaggctctagtgtgtacttagagttgggaagttggggtcttg

SEQ ID NO: 687927 - DNA, 453 bp, Homo sapiens
  misc_feature (57)..(57): n is a, c, g, or t
  misc_feature (78)..(78): n is a, c, g, or t
  misc_feature (112)..(113): n is a, c, g, or t
  misc_feature (127)..(127): n is a, c, g, or t
  misc_feature (141)..(141): n is a, c, g, or t
  misc_feature (148)..(148): n is a, c, g, or t
  misc_feature (150)..(150): n is a, c, g, or t
  misc_feature (157)..(157): n is a, c, g, or t
  misc_feature (165)..(165): n is a, c, g, or t
  misc_feature (177)..(177): n is a, c, g, or t
  misc_feature (237)..(237): n is a, c, g, or t
  misc_feature (390)..(390): n is a, c, g, or t
  misc_feature (393)..(393): n is a, c, g, or t
  misc_feature (397)..(397): n is a, c, g, or t
  misc_feature (402)..(404): n is a, c, g, or t
  misc_feature (410)..(411): n is a, c, g, or t
  misc_feature (426)..(426): n is a, c, g, or t
tgccgtgaacccatctacttgccgtatacctgtaccgtgataccgcgtaagggcaancgaatgcacgtgcagttgtcnaccagccggcttaggactggcccgggatgggagnncagagcggctgctntcggtgcgggaaanaggggcncnggtccanagagtgtncgatagatcgtncaggccgcgtggcagacttgaccgagcaatataatgagcaatacggagcagtgcgtacgncttacaccatgagctatggggattcattgtattacaacaagcgtacggagcgctcgatgctactacaagcgctgcgtgctgccggtcctatgaggcagtggcagctgcagctgcctccgggtataattacgcagaagcagaccctgttccagntgncacnagtcnnnaatacnngcatggcagtcactnactccaactctctcaatcctacataaa

SEQ ID NO: 687928 - DNA, 938 bp, Homo sapiens
  misc_feature (392)..(392): n is a, c, g, or t
aaaagctctcgagtgagcccctgcccgagtgccgcgggggagaggccgcgagcgggaccgagaagtgggctgggagcagaggtcgcggaggtggcgagctgaggcctggggcccaggctggggacctgtgcaggggcccttggagtggctgggcactgccagggtcagtggtgcctgggctgaggggagggtggccctgtgggttgggggaacgggtgcgcccggtggacgggagggtaaagcagcccttgcagtgcctcgtgtgtgcacctgtttgctggggctggctgcctggctgggcatttgtgcggatgtggccccggtcccggcgatctcgggggtgcccattcgccgcccatgacgccggagcggcttcttgttccttgagcaancgtagcatgtggctggcctgatccgtcgggactttcaatggtggcggccatcgtgagtggcacaactgccgcctggaacgcgtggtagactttgccttggacctttcgctggacgcgtggtgaccgcttgtgtacaacgcaacctgtatttcccgcgtttgggccgccttgggcattcgggttccccggtgttggcctgcgaggacgattccgttggatgctgctgtgccatgctgctggctgtccgcgggaccgttgcttgtttggcaactccgacgggggagtcttcgcctaggggtccctggggtgccatcgtcgtccaagcagcgcaacgggaccccttagagggcacccagtgcagaacagggcagaagccgtggagcccggcgactcaacggggaggcatttcaggagaggccggcattcaggacgacacacggcagcgccaggcccgcggaggcaaggtggccaagcccctagggcccgccttgaaaggcttcttgtagggcgcttcagccgcaaggttacggaccaagcgttgggaac

SEQ ID NO: 687929 - DNA, 138 bp, Homo sapiens
tcctattcgtgcacgagacgggacgagacaagccccctaggaaacacctaccatgccgacaagaataccttccacccttactacacaatcaaagacgctctcggcttacttctcttccttctctccttaatgacatta

SEQ ID NO: 687930 - DNA, 1641 bp, Homo sapiens
aggggcagacagcgaaggaacaacgcagcggggtgggagaagaacacttagtggcgcacacaatcaggtggggggctgtccccaccactcgcaggggggggccccccccaacaaggggggggagaatccaccaaggaagggggtcctcgcgcacgctgcgggtgtggtggagcatgcgcggggtggcacacaaacacaaggagtgccggcggggaggagacaggagagacgaccgctggagtaggaggatcggagggagaagcgatcgacatatgagggggtgtggtcacccaaaaaggtggggtgataaacatcatgcagtggttgtgctaaaagtgcggggaggatgggccgccccaacaccccctccctccccagtaagtgaatagtgtggtgtgtaagtgtgggagtggcgacacgacacacaagggtggtgcgtacagcacccccggggtggggaacaagacaggcgtggggtgagaacgagcatacacgcagcgaatgaaagtggggtgcgtattaaatagaagaatgacccgcggggggaaaaagggagcgtgggcgggcgcgagaagaaaacaccatggcgggtctgatcgtggcctcagctgtgctgagtgcgcaacagccaccgcccccccgatgtgagtggttgctgtgcggtgagagacgcgagcgggttgttgagtagtactcgcactcgactagtagagtgcgcgctaatagagagtgcgcccgaccgaagagagagagagagggcgctgcgcgggaggagcagcacaagagtagcagctgctggggggtgtgtggtgctgccccaccacgctgcggtgagagtgtgagagacacaacagttgtgttgggtgataatgaaagtagtggaggtgcgaggagagagagcacacacagagagagaaggagtagggagcgcccacagcagtgttgcctccctgcggggtgtagtagagtggtgagagagtagctctacaccctcagcagcatataccaccgcagcagcagaggggggcgtcagcggatgtaccacaccacagcaataagggcgccgctgcggtgatgagagaacaacacgcgcgtgcgtgttgggggagagatagagagtgcgatgagagagacgcgacaccaccacgcgcgccgcgagggaggtggcacacacacacatagagggtggcggcactcacacacgcgtgtgtgtgctcacgcgtctcacacgcgcgtgtgtgtgtgtgacacaccaccgctggtgggaagaaatcacacgcgctgcaccacggcgcgcgcgccctccacaaatgagagggggggcaccgctggagcactctatgtcacacaccaccacacccctctgggtgtgtgtgtgtggtgccatacaacacactgtgccaggcgcgcggctgactgtcctgtgtgagagtgagtgagtgacctgcgagaacaccaccacaaaaaagtgagaacacatgctccaacagagaaagagtggtgtaaggagatgaggtgttgagagagaggggcacaaacacgatgtcgctcgcatcacatgcggtccagccccgtggctgtgtcaccacaatgggtagattgtactactgagagagtgtgggttgactgtgtggtgaaata

SEQ ID NO: 687931 - DNA, 318 bp, Homo sapiens
gcgattcttctgcctcggtctcctaagcagctgggattacgggtgcgcgcgaacacgcctgggtgatttttttgtattttttaatagagatggggtttcaccacgttggtcaggctggtctcgaactcctgacctcatgatccacccacctcagcctcccaaagtgctgggatcacaggcttgagccaccacacccagccaaagcatttttgatatttagttcttcttgtaagactattgaggtaaacattctaagaaatacaggtttagagaacatctttctgctgagcttattatagagttgatatagttgacatg

SEQ ID NO: 687932 - DNA, 1090 bp, Homo sapiens
gaaaggcagcatcggcgggagctggaggatgaagaaggagcatgtgcttcactgaccacgattactcctggcgtgtgtacccgttgcttccgagtgacgttagccatcaaagagtgtcattcttccagcttcctcacgacatgtgacatgcgattattatacctcagactgcatgagttacactctcgtgtggtcttcacggaacggtgatgattcctatcctagagcacgattgctcagtccagcacagttcatgagtgaacgcaggtaaccaagatacgtgtggatactgagtagatgcatgaaatcgatcgagcgcaacgcgttacagtgcgaccagaaagtttccatgagattatggcactagcatagagagctctcagcgaacgcatactcaagtggttccgcgttcggagggtgcagttggtccttgtcgccgtaacgccttcacagtatgggaatgatgactccctaagggggcattcgcggtaattggggccatacgcaaatgcaagtaagtgtactgcttgcaaatagtggctacacacaaccccatgcaaagtcggaaccactgcatgtatacctggcctatttgttcgagacgacacgttcactgacttaatcactgcaagcgtcaggtgaactgttgccactcaagtcgcaggttctcactgtccaattgggtaactcgaaattgagatttctcgcaagactccagtggtaatacgacactatttgagagatcgtttcggtccgcataaattggcctgttgaactttggagtttccctcgggggggcttggagatattcagaggtggctttattggttccaaccgggagaaatagcagaggcgttgaagtcgcgtgatgttgcgttcataaaggcagcaacgttacgagcagcaaagttaccttaattgaattcaattactgtgcctaaaaagcgaagagacgggaaaggaaacattttcgcgcagattggcatatccaaagagcttttatctccaacgaaaaccaccagtaccaggtaccaacattttccttaagcaatgaagaacttttggggttccgatcattttccggagggca

SEQ ID NO: 687933 - DNA, 119 bp, Homo sapiens
agaagatgccagatgctgaagctcgacaaaggagaaccgcctttggatcgagctgagcaggcggaggccgacaaagaaggccgccgaagacaagagccaagcagcttgaagattgactt

SEQ ID NO: 687934 - DNA, 832 bp, Homo sapiens
  misc_feature (78)..(78): n is a, c, g, or t
  misc_feature (162)..(162): n is a, c, g, or t
  misc_feature (165)..(165): n is a, c, g, or t
  misc_feature (198)..(198): n is a, c, g, or t
  misc_feature (219)..(219): n is a, c, g, or t
  misc_feature (221)..(221): n is a, c, g, or t
  misc_feature (263)..(263): n is a, c, g, or t
  misc_feature (265)..(265): n is a, c, g, or t
  misc_feature (283)..(283): n is a, c, g, or t
  misc_feature (296)..(296): n is a, c, g, or t
  misc_feature (339)..(339): n is a, c, g, or t
  misc_feature (373)..(373): n is a, c, g, or t
  misc_feature (377)..(377): n is a, c, g, or t
  misc_feature (404)..(404): n is a, c, g, or t
  misc_feature (428)..(428): n is a, c, g, or t
  misc_feature (505)..(505): n is a, c, g, or t
  misc_feature (518)..(518): n is a, c, g, or t
  misc_feature (520)..(520): n is a, c, g, or t
  misc_feature (526)..(526): n is a, c, g, or t
  misc_feature (537)..(537): n is a, c, g, or t
  misc_feature (566)..(566): n is a, c, g, or t
  misc_feature (613)..(613): n is a, c, g, or t
  misc_feature (633)..(633): n is a, c, g, or t
  misc_feature (675)..(675): n is a, c, g, or t
  misc_feature (719)..(719): n is a, c, g, or t
  misc_feature (724)..(724): n is a, c, g, or t
  misc_feature (734)..(734): n is a, c, g, or t
  misc_feature (736)..(736): n is a, c, g, or t
  misc_feature (747)..(747): n is a, c, g, or t
  misc_feature (752)..(752): n is a, c, g, or t
  misc_feature (763)..(763): n is a, c, g, or t
  misc_feature (772)..(772): n is a, c, g, or t
  misc_feature (824)..(824): n is a, c, g, or t
ttcgctgccactgtctgcgcccccgggccgccgccgcctccccccgcagcccggggctctctccgctgggcccgcgcngctcgccccgagccaggagaacgagctcgaggaggatgcctgggcccgtcccgcgcggccccgggtgaggcacgcccgcgcgcncanggcccatgggaaggagcgggcgccgctgctgtnccccgccggcgcgcgcacgantngagaactgccacgggcagcccccggccgcgggtccccgagtnangctggcggcacctgaaantgtggcgcgggcncggggccacgcagcggagcccagtgtccagtaaagcgtctaangacccgccgcccgtgccgccgccatggtgatgtnccanggcacctacacgttcctcacgtgcttngccggcttctggctcaactagggnctcaacgtcctgctctgctgcttctgcactacctgcgccgccgcctcaaacggcgccaggaggagcgactacacganaaacctgcgcgcncnaaaacnggagcacctcnaactcgagggcagtatggccgggagcacnccgggcctggcgccgccgcagccaccaccacaccgtagccgcctggnggcgccggctcacgcgcacncgcatccgcacgtgcacgtcaccccgctgctgcaccacgggnccgcgcaccgcacgcgcacgccacccacacccgcaccaacacgngctcncgcacccgcngnctacgcacctnttggngccgccacggncctggagcnacccgcgccaaggggaatcggacatgtgcaaaccaccgtgttacgaaaaggnggtgctga

SEQ ID NO: 687935 - DNA, 117 bp, Homo sapiens
ctgacggaggagtcaccataggcactcgctttataactctcacaggtctttgtcggaggtgtcctgcctcctaccccagcgtggtgggagtgcgacgccaggcttctccctcctccc

SEQ ID NO: 687936 - DNA, 327 bp, Homo sapiens
  misc_feature (98)..(98): n is a, c, g, or t
  misc_feature (285)..(285): n is a, c, g, or t
aggcagagagagtataagactggcgcgtgaaattacgcggccgacgggcgcggataatattataatattaaagagaataataaagtggcttctgatanggggaaccggcagccgacttactctaaactgggattactgcacaaaacgaggagttcgcccatggactgagaaagttcacccctctctccttgctgcggagctcggcgctggatggcagattattaaaatgaattgccagataattactccggccgattattaatgatgagcaaaatgagcctatcnaatactatcttttaaaggacgcgaacaaagagaccccttaca

SEQ ID NO: 687937 - DNA, 306 bp, Homo sapiens
  misc_feature (77)..(78): n is a, c, g, or t
actagaggactctcttacgccccaaactcagactacctagtctagataatagagatgacatgtggaagattacaggnnacattgagtgttaactcaggggaaaacttctcagggagagaaaaactttttgggggaagtttcagtcgaacaacaggctactggaggtcctattaaaaccatttggtaggacacttctctcctgtcattcacaatgtattggcaaaagatgtcttcgtggtctccggaagacaaaattctgaaatcagccgtgatgacctggtttttttttttcctctccgtcggggg

SEQ ID NO: 687938 - DNA, 278 bp, Homo sapiens
cagcgtactggtcgaatcagcgggagtatacagccctatcccatttctattgctctgaccccgcctcctttctaaatgcagcgacctgtgtactacagccctgatccctttctattcctctgatcccgcatccttttctaaatgcagcgatctctgttcttcagccctatccctttctattcctctggaccccggctcctttctaaatgcagtcgagctctgttctgcaactcctggtccctttctattcctctgaacccgcatcctatataaatgca

SEQ ID NO: 687939 - DNA, 119 bp, Homo sapiens
ggactccaagatgagcaggttccaggatgtccagagattcctcctgtccaggcaaagtgactcgatgtttcttaataccgtcaccgcagagctccgacaccacctccggactccaacct

SEQ ID NO: 687940 - DNA, 538 bp, Homo sapiens
  misc_feature (46)..(46): n is a, c, g, or t
  misc_feature (231)..(231): n is a, c, g, or t
  misc_feature (269)..(269): n is a, c, g, or t
  misc_feature (271)..(271): n is a, c, g, or t
  misc_feature (294)..(294): n is a, c, g, or t
  misc_feature (314)..(314): n is a, c, g, or t
  misc_feature (354)..(354): n is a, c, g, or t
  misc_feature (415)..(415): n is a, c, g, or t
  misc_feature (483)..(483): n is a, c, g, or t
  misc_feature (498)..(498): n is a, c, g, or t
  misc_feature (509)..(509): n is a, c, g, or t
  misc_feature (522)..(523): n is a, c, g, or t
  misc_feature (528)..(529): n is a, c, g, or t
tttccattgaagactggttttgttgtttcagtgctttttctatggnaatttcttttctcaagtaacttgccttgaaatcagagacagcactttgtcaagctagtttacaaggtcaaagacacaatgctgccaatgccattagtatttgggaataattcgccgctgttagaaaaagtctgtggccaagtgggtaaaacagttgcagtgcactgcactgacatccagaacagnaaatagggggggcccagagattgcccttcctgccaaancnaagtccagtagttccccagcccnaagggttccccactgtctcnccggctctcttactcatgtgtacctgccccttcctcttgnaatctggcctttttatttccccaagcccctttcagcctcccgtgggggggctcccgccccncgccggtttttcgtcctgcttcccgtcgtctcctttctcccggtcatggcttaggttgggcgatgggncctgtggctttgggngtctttggtgnagcggctgggcgnntcccnnatttattcc

SEQ ID NO: 687941 - DNA, 620 bp, Homo sapiens
cgcaaacttgtaagcttatttaattgctctgtggtcataaagacaactaatgttagcataaaaacactgaacaattaatccacactcattattccccttccccggttaatctgaatttatgagcttgtaagttccatcagtcagatggcaccagagcactcttcccttgcaagggcaaaataggctcaatgggaagagatgaaacggaaccgctgactccgggtggatgtctcgtaggcgtgttcccaagagcatgcttccattttccacttttcccacatccattgttttataacacacaaacccgggaaatacagaaaagggctgaacaaaaaccaaaagtcacccagaatcccacagtcttagcactagcagtaattttttttttttaagtgtcatttcggctagtctcttctttctgtttaaaccccgtggtggttgaggcacggagctcacacctgctgaggaagatgcagctgccatgcaggggggtgagggggatccaagccaggtggtgggcagaagggtccacagacggctgcacgcagggttctgcacacacaaggacactcaggaacgggaatgggagctgggctctcactgtcagggaagttacaaat

SEQ ID NO: 687942 - DNA, 448 bp, Homo sapiens
ctactactactaaattcgcggccgcgtcgacgaaagaaagaaagaaagaaagacaaagaaacgaaggaaggaaaaaataaagagagagaaagaccgaaggaaggaaggaaagagaaagagagagaaagaaagagagagagggagaaaggaagaaaggaagaaagggagaaagaaaggaaggaagaaagaaagaaagaaagaaagaaagaaagaaagaaagaaaggaaggaaggaaggaaggaagagagagagagagagagagagagagagaaagaaagaaagaaagaaagaaagaaagaaagaaagaaagaaagaaagaaagaaagaaagaaagagcgaactgtgcagggatatcctacagaaatagtggggggtggggcgtcgattgcagctgttcatctggcaggagatgtcgacgcggccgcgaatttagtagtagtagtcgacc

SEQ ID NO: 687943 - DNA, 1711 bp, Homo sapiens
tactcaaaaaagtttcatttttttatttagctttctgactctgtgcttgtgccttacaaaactttcacaacgatttgtgctgagcaggcactcagaataggtccagcgtagtgacatgaccagaagtaggctatccctcaccataaccagcctctaaacagaactaaggactagacccgaaccccatagagggactaacacaatccacgctaccacactctccatccagccacagaacacgcgcacgagcgcaacagccacccccaacacaaaacacgcacaagccagcgccgctgagctgagccacaggacacaccactcaccagcagcggagcaccacgacagcaccacgccaacacaaccccacaacaaggacattcccctaggtgcagacgacaacacgactcacacacaaccaaccacacccaacacaccacgtcgcttcacagcaacacgacggcaacctcacatcgaagcctggagcacatcaccaccatgaccagcatggaccacgacaccatcagacgaacaccaacgaacacacgggcactacacaaccgcgcgccgagcaccaacaccccacagaacctccacgacaggacaacccatcaccagcacacgcacactacaccacaaggccacacaccatagacctcgccgcccgtaccacccgcgcgcacacaacgggcaccccacaccagatctcccagctaacactgacgcccactacaaactccacaccaaccaacacgctagcacacagccgccataccctccacgcagcatacaacccaacacacaaaccccatcctcacactcacacaacagcacgagcataccagatgcatccgaagaagagaaaacgagcaacgacgaggcggggcgagaccacatcacgcgcacaaccgaacacggctccatgccaccggcgcgtacgacgccgacaggcaaaccacaacgcaactgccggccactacccccacagtcacgcggacacgaaccaaacaacgagcaagcaaagaccaccccgccgacagcaccgtcacgtcaagcggacgacgcgcagaggccgagacaggacgcgccgagaggccgggcgcgagggcatccgagggcgagagtgtatcgagaaacatgcggcgtacgggcgcggggatgagagaaggatcagcgcggacggcgagaggagtcagagaacgggcagggcgggaggcgctgcggcgtgagggagggagcagaggggcggaggcaggcgggcgctagccgacgccgtgcgacacgacgacgcgaggatgatccgcgcacatagagagaataacccgaccggccgcagaccacgccagcgaccaggccagcgaagacggggaccagcgctcgatcgcagcaacgcagaccacacgcagcagcgacgacgcatagccatgccaagaccagagcggccagccggcctcgcgccggcgggcgagcgggcgacgcggcgagcggagccgcacgcacgcagcggaggcagagacgcagcaggcagcgccagtgaggagcgaggggagacgccgaagccagcaggcgaggacacagggcacagaccgcgaacagagccggcgatccagaaggcacgacccgaaggagcggcgagaggccgcggcggagggggccgccggcgggtgggcgaccggaggcgacgagcgcagacgcgggacgggcgcaggaggga

SEQ ID NO: 687944 - DNA, 558 bp, Homo sapiens
  misc_feature (71)..(71): n is a, c, g, or t
gaaggaaaagttggttccgtttttggtaaaaactggaaaatggccctaaattcttgaaggctggggaagcngccaatggttaatagggtcctggcaaggccatgtgtggtgagaggttttcaaaccatccccctttggggtgcttttctgtttgttatattaaacaaacagtttcggggggggttctcaaaacagtgggcaaaaagggtggtgggggtgggaagggtccccagtttgccccaaaaggtccgaagggttaatggatttttttcctaaaacctgccccccccctttttatcaggggggggagaacgggttccaaaccgtttggttccattggcccctttaggtttgggggaaaaggctgggttattgtaaccaatgcccgtgtaaaccttccgaagggaaggggaatgttttgggggcccccttgggttttttttttggggggggggggttttaggttttaggtttttaaaacagggcttttttatgggaacaacttggcccaaaatttgggccaggatttttgggcccctttaaaaaggttaatgggga

SEQ ID NO: 687945 - DNA, 272 bp, Homo sapiens
cagtagaggatatttcaaaagttaactcggaaggtgcccttcatgatgattgagctgatattattgaagcctgtgatgtgcgtctgaaggaggatgataaagatgttgaaagtgtgatgaacagtgtggtatccctactcttgatcctggaaccagacatgcaagaagctttgattgaaagcctatgtgaaaagctggtcaaattccgcgaaggtgaacgccccgctctgagactgcagttgctaagcaaccttttccacgagatggataag

SEQ ID NO: 687946 - DNA, 101 bp, Homo sapiens
gcaacacagcgagaccttatttccactaaaaagaaaaaaaaaatcagctaggtgtggtggcatgcacctgagttccagcaacttggaaggctgaagtggga

SEQ ID NO: 687947 - DNA, 599 bp, Homo sapiens
  misc_feature (234)..(234): n is a, c, g, or t
  misc_feature (283)..(283): n is a, c, g, or t
  misc_feature (351)..(351): n is a, c, g, or t
cccttctaaaagccatgaagaatcaccttcaatgtctactacttcagcagctgtagcccagccaaccttagtccgcttacgactggaacctggtctcggcaacggacgcgtcgggcaagcctcttgtggcgatgaacaaaggcatcgagcgcaagttgcgcgttgccttcggtgacaagaacctgagcatcagcggtggctgcaatcgtcagttcggcggctttcactatcagnacggagttctgaaggttcagccactggcctctacgctgatggcctgtgncaagagcctgatggaccttgatgcccaagtagggcggctgttcaagggtgatctgcgcgctgtgatcnccggcgataacgtggcgccgatgctgcaactgacgacagcggatggctcggtgctcaagctgcaaggcgaggccaccccgcagacccgctacggtagcgagggtgaggtcaagtttctggaagtggcggccaagacggtcaagtgcagccatcctttgatcccaggttatcagtgcctgcaactgcgcgagcgtcgctatgtcgacgcggaactgcgactggcgacccaagacaccgggtgtgctttc

SEQ ID NO: 687948 - DNA, 112 bp, Homo sapiens
aagatggccactgaggatcatacaacacaactgaaaatatgcactgggagtgtatccacctgtcttttcattggaaacctggtcagtttgtgttcaaggtgtgacttgagat

SEQ ID NO: 687949 - DNA, 134 bp, Homo sapiens
atccccaatctattgatccccaactccaaatatctcatcaacaaccgactaaatcaccactccaaacaatagactaactcaaactaaacctacaaaacaaatgatacaccactacacaacagctaaaaggacga

SEQ ID NO: 687950 - DNA, 180 bp, Homo sapiens
tccatctcagccttccaaagtgctaggattacaggtgtgagccaccacgcctgacctatgttaagactttgattggacacccccccccgccacacacacacacacacacacatacacacacacacacatctcgatcgtgctccttcgctgaggggaggggtgctctggacacatgtgcgt

SEQ ID NO: 687951 - DNA, 152 bp, Homo sapiens
agaccgagccggacctaatcacaggtcgtgggcactctcggcgcctctataggcgtcgacatcgtacggtttcagtcggtttccggaagattttcaatccaggcgcatccccggttttagcgtccgggcatggctatcgctcttgcggcagg

SEQ ID NO: 687952 - DNA, 104 bp, Homo sapiens
gtcaatagcatagattaaaaacaaaaaagaagtatacccaacatacctatgtaattttaccctatatctcttcctttgcatatactgtcttatttcctctgcct

SEQ ID NO: 687953 - DNA, 244 bp, Homo sapiens
  misc_feature (15)..(15): n is a, c, g, or t
  misc_feature (29)..(29): n is a, c, g, or t
  misc_feature (40)..(40): n is a, c, g, or t
  misc_feature (45)..(46): n is a, c, g, or t
  misc_feature (50)..(50): n is a, c, g, or t
  misc_feature (54)..(54): n is a, c, g, or t
  misc_feature (63)..(63): n is a, c, g, or t
  misc_feature (65)..(65): n is a, c, g, or t
  misc_feature (94)..(94): n is a, c, g, or t
  misc_feature (101)..(101): n is a, c, g, or t
  misc_feature (118)..(118): n is a, c, g, or t
  misc_feature (213)..(213): n is a, c, g, or t
ctgcttgcttaaatnacagcagtcacatnacagctccacngggcnncccncccnggcgctgcnantacaaacgccgccccagtcgtacgtgtcntagtgtntgttagcaagctgtgtncgcgcagcaagtgtgtagcgtgcagtgtgtgcgtgcgcccgtgtgtgcagtcaaagtcccgtgcgtgtgcaccgtcgcgtgcgtagtgcgtcgtnccgcccaaaaaacccgtgcgtgtgtcaaaaa

SEQ ID NO: 687954 - DNA, 137 bp, Homo sapiens
tatgcgcccagcggtcattctacatttcctccggaagctgtgtctggtgcagctgaggctctggtgtatccacgccgacgtgagcacctgtctgaagttgagtacccgcctttcgctgggcatgcatcgcatacatt

SEQ ID NO: 687955 - DNA, 230 bp, Homo sapiens
gagggtagagaatgagtgtgaggcgtcttataccatagccgcctagttttaaggagtactgcggaaagtactattgacccagacgatgggggcttcgacatgggcttaagaggcgctcataagtagagtccgtacaagaggatatctttactataaaagctatagtgtaaagcaagtcatataacgtagtaggctcagagagtatgatcgatacttgggcagtgagagta

SEQ ID NO: 687956 - DNA, 292 bp, Homo sapiens
  misc_feature (64)..(64): n is a, c, g, or t
  misc_feature (70)..(70): n is a, c, g, or t
  misc_feature (93)..(93): n is a, c, g, or t
  misc_feature (108)..(108): n is a, c, g, or t
  misc_feature (129)..(129): n is a, c, g, or t
  misc_feature (139)..(139): n is a, c, g, or t
  misc_feature (146)..(146): n is a, c, g, or t
  misc_feature (154)..(154): n is a, c, g, or t
  misc_feature (159)..(159): n is a, c, g, or t
  misc_feature (172)..(173): n is a, c, g, or t
  misc_feature (180)..(180): n is a, c, g, or t
ggaagaagcgcgaagagccgttagtcatgccggtgtggtggcggcggcggagactgcgggcccntagctnggctctgcgaggtgcaagaaagnctttgaggtgaaggngtattaaagtcatcataacanatgttttcanaaacttntaggaggntgttnaaaactactaggnnacggcgnatgtattgagggacctcaatttaattaatggaggatgtatggttctgacaataggttatagctggccaatgatacttattactttgccgtaccactaggttcttagggtatt

SEQ ID NO: 687957 - DNA, 274 bp, Homo sapiens
  misc_feature (5)..(5): n is a, c, g, or t
  misc_feature (13)..(15): n is a, c, g, or t
  misc_feature (40)..(40): n is a, c, g, or t
  misc_feature (42)..(42): n is a, c, g, or t
  misc_feature (63)..(63): n is a, c, g, or t
  misc_feature (65)..(65): n is a, c, g, or t
  misc_feature (110)..(110): n is a, c, g, or t
  misc_feature (142)..(142): n is a, c, g, or t
  misc_feature (196)..(196): n is a, c, g, or t
  misc_feature (234)..(234): n is a, c, g, or t
  misc_feature (268)..(268): n is a, c, g, or t
caaangtggagtnnngggtgcgccgttagaatagtggatnancgggtgaggaattggagaggnangggaatggtaatttattgaggatgtgtgtttgatttagtgtggtnagggttggttgagaattataaaggaattgttntgtaaacggtgttaatttcaaaatttggggatttttgtagggtaagatttgagntaaaattttgaaggcaaattaattttgtgcttttgctnggataatggagttttttttagaaaagtgaaagantgaaag

SEQ ID NO: 687958 - DNA, 233 bp, Homo sapiens
caggaatgagcactcgtaaacatggggtttcttttgtgagtaatgaaaatattgtggaactagacagcagtgatggttgcacaattctgaatatactgaaaacaactgaactgtatgctttttttttttttaagatagagtctcactctgtcgtccagggctggagtgcagtggcatgactcctcatgctcacgtgaacctccacggtccaaggtacaaggtatttctccagc

SEQ ID NO: 687959 - DNA, 284 bp, Homo sapiens
gggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctca

SEQ ID NO: 687960 - DNA, 874 bp, Homo sapiens
gccctggggccgtacgaggcgcagcgaggaggtagagggggcgggggtcgcacgtagaggggtccctagagaacgaggacgctgaaggcgggacactggggtgcgaccccgcgggcggaggccaggccattaacatcgagtcgcgcacttctgtggccgagacgactgaagctgggcgtctgtggacgggacagtcatcgtcatgaagtgcctctagaaatcatcccacgggcagactccatcagagatcctcgcactatccttggcgccctatgcacgtgacgttagaatccgagcagccgctctgtgcgaggttccgacggatcgttcgaaggtctggtggatcgaccgtgagaggtctgtccccgctgcgcgggcgtggctggcggcgctctgagggatgatggcctcgggttcgaggcacgctggacgccctgcagctggagctgggagaccctgggtgtcttctgccagccggtgcctgcgctgtgctgtgaggacgcgagaacgccagcatcctcaccgagcgtggcaggataagaaaggtgacagacgattccggaagctgggtcgagaccatgagactcgggagctccccccaaagcatgggaagcccaagaaggcagaaactggaagggaaggcgggacgatgggccgggacctggtgccaggacgggccaaatgctgaaagcttgcagcccaagatccaggcatatgaaaccgactggatgacccgtatcgacgtggcacggatccccaaacaagtgatgcctgccaacaggatactgggcgttcaagtggaggccgctactgtgcctggacatcaccagcgtaggatggtgcgcccacttgaggggaagttacctgaaggccc

SEQ ID NO: 687961 - DNA, 285 bp, Homo sapiens
agtgaattcgactcgggtactggaggactcctcagagatcgagccaggcgtccagtctaaagcgagtatttgggaggtcagctacggtgctcacgtgtcgacggaacttgtacagggaggcatgcaccgcgagtggtgaatacacgtcgaccaggctccatgtatgcgtgattgggaggtcagcacggagctcatgtgatcgacggaactggtatagggaggtatgcatcggcagtggtgaatacacgtcgagctggaggcatgcatgcatgatcgggtactgga

SEQ ID NO: 687962 - DNA, 125 bp, Homo sapiens
gtatactcctatttcccagcgccatgtgcttccatttcccagtactgtgaatgggacgcacatggcactgggaaataggagtatacagcactgggaaaggggagcacagtactgggaatggggag

SEQ ID NO: 687963 - DNA, 111 bp, Homo sapiens
attaacgacataaaacctcatcagacgagagaacaccctcatgtcagtacaccgtatcccccattctcctcctatccctcaaccccgacatcattaccgggttttcctctt

SEQ ID NO: 687964 - DNA, 122 bp, Homo sapiens
cgaagttacttaccgggaacgactgtatagagtatactaggaagtaaagaatcgcctggactatcatatatctgtacagaacatgatgcgtcgaaaggaacaagaacaaatgataaaactgg

SEQ ID NO: 687965 - DNA, 855 bp, Homo sapiens
gggggcttcgggcccggagttcgggggctgggtctggacccccacgcagactcgccggcctccctgccccagaggaggccgggatcagaagcgcatcgtcgatctcccacgcccggtcgcgcagtcctcctgcgttagcttgggtccccagcgtcttgggcttcagaccagcggcgtctcggcgtaccacgttgccaattcgggccgtcctgcggggtcggggtgaggcgtcgacctgggtgtggcagagtgcctcgctgggctcgaatggtgctgcacgccttgtctgggcgctggacgcacggggtatcctgacctacactgggttggactcgatgacgcgatcgggctttcctgcgtcgtggctcagcgcatgatacggactgcatgtgcctggcccagaggtcctgcgatcgactccgaccggcacgcgggcgccgcgcctcaggtccccgtttgcccgacggctgctcgacagcccctgggaggaaccggtcacagcgcagtctgaagaccagataaagccgtgacgaacccacggaggcaagagcagaagcgaggtgcccgggtcgtccttcatcgtagaagggcccgccatggtgtttgcgcgcaactcccgggaaagcagggagggcagccgcggactccagggcagggacgggggctgcgggggcgcctggagccgtttcttcgcgccacggcggggaacatacctgccgccggagcccacggggccccttctccccgtgcggggcacggcaggggtggttgagcgtcgtgcttgcgcgcgcttgaccactccacgcgtcgttggggggctccggcttggtggagtatcccggcatgaagggactg

SEQ ID NO: 687966 - DNA, 103 bp, Homo sapiens
ggcagtatagttgtttctgagtgtacaggacggccagtatagctgtttcctgattgtacccggagggccagtcctcgctgtttcctgattttaaccggctcgg

SEQ ID NO: 687967 - DNA, 282 bp, Homo sapiens
agctaaaaacccatttttaataacaattttaaaaacatgggtttaggccatccacatgctttaactcatgctcaggctcctgatattgatggggtgtcttttattttttttgaggccctcctttgggaatttacccgttttggaagaaaacccaattaagggtatttttcccaacaacccctatttccaatggggattccttccttttattcattttaagactcctctacccgctgagaaaacttttttcaagcacaggaattgtgtgcctgtttaacaaag

SEQ ID NO: 687968 - DNA, 290 bp, Homo sapiens
ctggggccagcgtttcttgtctggcatccagatccggtgtcccccagggtgagggagccccacggggccgcgttggagaagtgcgcctgggtgcgctcccaggtcgctcttctgtgatccccctgacggtgtccctggattgagtaagtgcacccgcgtttcactatccactcgtgcccacgttcatagtgtgagcgatgcccatagtcctacctattgactgccatagagtcaataatagagaacatcgaccacagtgcctcgcagagccataaagagagatgtaccag

SEQ ID NO: 687969 - DNA, 373 bp, Homo sapiens
tagacgatcccgatctgatctcggcgcatcccaatcgttgtgtttcgttaccacttcttcattgaatgccttaggttggatgttctctctgatttcgagtcctacttatctcccacagaacaatcctccaggtgtgctggccctgctggacgaggaatgctggttcccctaagccacgtgaccagtctttcagttgagaagctgtgtcacggagcacggcattcctcctacgttccagaagcccaagctgctcagtgactatactgagttctccatcatcctattatgctgggaagagtaccagccatcagggccttaccggtggactctgtctcacgggatccccaatgcctggtcatcgccgagattagat

SEQ ID NO: 687970 - DNA, 3255 bp, Homo sapiens
tcactttctacacaattagatggcacttgctgccgagtgaagaagatcctgcttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatccttgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacgtcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctggtaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattcctgattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaactggtccttagtcatttgtataattagaaatgaagtttgggaaaaaattttggaaaaaagacaagcaaaaaaaaaataacttattccttttttgcatatttgtatagccttctagaatcagaaataacctttttgcatattcttttattgttctgacttttcaagacctattatttttttacataggtcaataaacaaaaggtgtgctactga

SEQ ID NO: 687971 - DNA, 108 bp, Homo sapiens
  misc_feature (65)..(65): n is a, c, g, or t
  misc_feature (82)..(82): n is a, c, g, or t
gcgataagacacaggtgaggtccagcttgaagagaaagaaaacaaggaagttccctgtgtttaangggcggtgtcattcaangaagcaggttggtccgcggggaccaa

SEQ ID NO: 687972 - DNA, 3200 bp, Homo sapiens
tcactttctacacaattagatggcacttgctgccgagtgaagaagatcctgcttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatccttgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctggtaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattcctgattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaactggtccttagtcatttgtataattagaaatgaagtttgggaaaaaattttggaaaaaagacaagcaaaaaaaaaataacttattccttttttgcatatttgtatagccttctagaatcagaaataacctttttgcatattcttttattgttctgacttttcaagacctattatttttttacataggtcaataaacaaaaggtgtgctactga

SEQ ID NO: 687973 - DNA, 692 bp, Homo sapiens
  misc_feature (42)..(42): n is a, c, g, or t
  misc_feature (45)..(45): n is a, c, g, or t
  misc_feature (140)..(140): n is a, c, g, or t
  misc_feature (168)..(168): n is a, c, g, or t
  misc_feature (186)..(186): n is a, c, g, or t
  misc_feature (207)..(207): n is a, c, g, or t
cgggaccctctgaaccgagtcctggccaacctgttcctgctnatntcctccatcctggggtctcgcaccgctggcccccacacccagttcgtgcagtggttcatggaggagtgtgtggactgcctggagcagggtggccntggcagcgtcctgcagttcatgcccttnaccaccgtgtcggaactngtgaaggtgtcagccatgtcnagccccaaggtggttctggccatcacggacctcagcctgcccctgtggcctgccaggtggctgctaaagccattgctagcactctgagtgtggcttgtgcatggccgcagttggtgggctgggtgactggctgcagccccagtgcgcctccaatgggaagcatgtgatggaaagatgaggcatcgtgcctcacatcctgctccacatggtgcaatgagcctactagctggcttaccagttccccgcctcctgactacctgacctccaggatgtctcccggtttcttctttcaaaatttcctctccatctgctggcacctgaggagagtgagcaggctggaccacaaagcccagtggtcacccctgtgtgcgccctgccacagccaggagtagtcttacctctgaggaactattctagatgcaaggtgtgtatagtgtgagtgtgagtgtggtgtgtgtgtgattagagagtatagagcaatatga

SEQ ID NO: 687974 - DNA, 107 bp, Homo sapiens
acatgatgtgctcgatgcactccacacatgtagctggtggctggggcattactcctcacagctatgtgcatgcactgccagacaaatgtgcattggtcatgagaatg

SEQ ID NO: 687975 - DNA, 235 bp, Homo sapiens
gaattcgagctcggttcccctatcaactgaggcgattccgctatcaactgaggcgattccctatcaactgaggcgattccgctatcaactgaggcgattccgctgtcaactgaggcgattccgatcaaatatattctctagatcagcagttatatcaaatgtgataaatcccagatcacttctttctctaggtccagtgaaatcttctacattttttagcagatccgctatccgt

SEQ ID NO: 687976 - DNA, 1940 bp, Homo sapiens
atctttccagagaattaaataatcctttttatgggcctgttaaacaatgctccagtatgacattgaaagaacatgcagtcacccttctcctttcccttatctctacattttgggaaatttttcttaacagtgcttcctactaacttctttaaatgtagtagtctttgtgctgtggggacaaaaatatggccacaagtagtaacttttctggttttctttaatagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacgtcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctggtaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattcctgattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaactggtccttagtcatttgtataattagaaatgaagtttgggaaaaaattttggaaaaaagacaagcaaaaaaaaaataacttattccttttttgcatatttgtatagccttctagaatcagaaataacctttttgcatattcttttattgttctgacttttcaagacctattatttttttacataggtcaataaacaaaaggtgtgctactga

SEQ ID NO: 687977 - DNA, 175 bp, Homo sapiens
gtgatgacggcgtgcggctggtggcgacagtttcgtggccagatgctgttgctcggccttgagagctgcgtggggtactacaccttgcgctacggcatctcagtcggcgagcgctggcagatgttctgcttcctggtgctgggcttttccggcatcgtgctggtggcccaaccag

SEQ ID NO: 687978 - DNA, 384 bp, Homo sapiens
gaattttttatgcacctatctcagaaatcacttggccatatctattcatctgtattttgcgcttttctactctatttcatatatctagtgtttttccccgcaactgataatatattgtcttgattactcatagctatgtgaataagctttgcaaatacaggtacactgagtgatagcccctattattttctttttcaaaattgtttctggttattctagttcctttgtctattcagataaatttgagcatacacttttctgtatcttggaaaaaatcttgctgtcatttttataggaattgcatcaaatctttgggagaattgacatctttactgtgtagagtcttccaatctatgaacatcgtatgtctcaccatttgtttac

SEQ ID NO: 687979 - DNA, 339 bp, Homo sapiens
  misc_feature (61)..(61): n is a, c, g, or t
gacttccccgggctcgcagggtttttaaagtcagggccaaaatataaacacgaagagcacnaatggaacaataaagcgaaaatatatgtgaaaaacaatagaacgcaaatataaagccagggcagcatatatgaaaggggaagaagggagaggaagaagaagctcccatcaacgtgagcgaaagcacgatgagacagaactggatttcaaagcacacaccggcatttctccccacaagactctgggcaagatgaactcttgtcacccaggctggagtgcagtggcatgatcatagctcactgcagcctcaaccttctggactcaagtgatcctcctgct

SEQ ID NO: 687980 - DNA, 3528 bp, Homo sapiens
tcactttctacacaattagatggcacttgctgccgagtgaagaagatcctgcttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatccttgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacgtcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctggtaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattcctgattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaactggtccttagtcatttgtataattagaaatgaagtttgggaaaaaattttggaaaaaagacaagcaaaaaaaaaataacttattccttttttgcatatttgtatagccttctagaatcagaaataacctttttgcatattcttttattgttctgacttttcaagacctattatttttttacataggtcaataaacaaaaggtgtgctactgaaaatgtttacgttttcttccatttatgtcaggggttcatgtgaagcaggtcgcagtgctctacttcaagtaatcatattgggcaaggcttcggatttttatttatagtattaccgtattttattaattccgggatgtacatttttaaatatttacattaaaaacatagttcatctttttattgatggcatattctacttgaattggcagttttttcttaatagtacattaaaaataatgctgtgtcttacaataaagttgccttagaattgaa

SEQ ID NO: 687981 - DNA, 557 bp, Homo sapiens
  misc_feature (165)..(165): n is a, c, g, or t
  misc_feature (271)..(271): n is a, c, g, or t
aactttgtatgtgtgcatgtgtgtatattgagtattttccctgtgtagtgagtattttctcaagtctaaatatttttctatagaaatttttaaagatacaatagtattctcatatagaaataccataatttacccatttctctcttgttggaaacaggctgtttnttattttccactactataaataacaatgtgataaggattttcccaatacgtgtgtacgtttggtcattttagtacagcttgttctttacttcaaatgtccctttcntagtagggggccctcctgcctccctactgtatcacccatcccactcccacaggcgacccttcttctcctttcctgcttatttttctccacagatcttaccatgtttattcgatttttaactttgggggtagttttgtttgttttctttcttagtcaatcttcccttcactacaatttaagctctatgaaccagagatttcaacgtaattaattcactgctgtaactctggtacctcagatagtggctgtaacactgtttaagtatgcaataaacttctcattaata

SEQ ID NO: 687982 - DNA, 134 bp, Homo sapiens
gggcggactccgcggacaaggccaggcctagcattgagctccgtcgggcagggcgccgggattggtgtcggcagacgtgagccagcgcgtggagtcggcgagcgggagtgaaagaagaaaagctagagagcgaa

SEQ ID NO: 687983 - DNA, 420 bp, Homo sapiens
ccaactacatcagtcacctcacccaatgccatcagcggcctcatccaactccatcaacggcctcgtccaacgccatcagcggccccgtccaactccactccagccccagccgcattgctgggcttctgttgttttgaaccaagacactggctcccgaatttgccgaagttgccaaacatccactgggacttgagctctttgctgacctcctgtttctttccagtcacccccagggcagagaggtgccctccttctggacccaaaatgatcctcgtcactgcccacagctgcgggtgtttcggcgaggacgggaccttaaactccgccaccctgacgcacgcatttcccgatgacaggtacagagttggggcgtgtgcttagggagcatgcaagcgtgagatcctgctcacccttgagggc

SEQ ID NO: 687984 - DNA, 3063 bp, Homo sapiens
tcactttctacacaattagatggcacttgctgccgagtgaagaagatcctgcttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatccttgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacgtcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctggtaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattcctgattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaaaaaaaaaacctgcagcccggg

SEQ ID NO: 687985 - DNA, 218 bp, Homo sapiens
tactacaagaacaagatctggaggacatccccttgaattattacggaatcagcctcagtttcaacagatgagcaacctcattcagcagaatccttccttgcttcccagagtaactacagcagataggtcgagagaatcctcaaaaacttcagcaaataagacaacacacaggagcatataattcagatgtacaatgaaccaggtcaagcacagctgtt

SEQ ID NO: 687986 - DNA, 550 bp, Homo sapiens
  misc_feature (5)..(5): n is a, c, g, or t
  misc_feature (18)..(18): n is a, c, g, or t
  misc_feature (50)..(50): n is a, c, g, or t
aaaangaggcttctgacngggatgagcgcctcacccctctctgagagtgncagtcttgtagaaaattttaagatgcttgaatgtgattgacaacaaattatatccacaaagaccaatgaaatcataaggtgttagcttctcaaaatattctagaattttctttttgataactgattatgtaggtatagtgtgtgtttgtagttactgatttgagcatttctagaaataaagtcagggctgtaactatatttcatattttgaagacctaagaaaaaaattttcactggagaatggctataacatggcatagaaatcattaaaaatggatctttttgaatactgtttatattactctgtatatgatgcatcgagtaaaattaaacaagagatggataaaaatggcaagggaattttattctgttatcacaccaacagttgcttgtatagtttctgcatattagtctttagtagggcaagcagatctatttgttgttgcctgcaatttgtacacatcctacctatgctgatttaataaagtagtgatcatctc

SEQ ID NO: 687987 - DNA, 1287 bp, Homo sapiens
  misc_feature (535)..(535): n is a, c, g, or t
  misc_feature (571)..(571): n is a, c, g, or t
  misc_feature (578)..(578): n is a, c, g, or t
  misc_feature (592)..(592): n is a, c, g, or t
  misc_feature (739)..(739): n is a, c, g, or t
tcacttctacgatgagtccaaggctttcacctgcctggacgggttcggcacaccatcccatattgatcaggtcaacgatgactatagcgactgcaaagatggctctgacgagaccgagggcgacgggatgcctgtcctaatggcagcttccactgcacacaacactggctataagcccctgatagtatccccatccaaccagggtcaacagatggtgtcttgtgcacatgctgcgatggcaacaggaagagtacaacaagcggcgtcatctgtgagaacacctgcaaagagaagggccggtaaggagagagagtccctgacagcatgatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtggngaagagcagctggctgctgccaaggcccaacaggangcaggangctggcgtgctgantgccttcaaggagctggatgatgacattggacgggacggtctcgggtgactgagctgcagactcacccggagctggacacagatggggatggggcgttgtcatgaagcggaagctcaggccctcctcagtgggggacacacagacangactgccacctctttctaccgaccgcgtctggggccgccatccaggggacaagtccgtgtcctgaggctcttgcccggcgatcttccagcagcttcttgcccctgacttgacggagcccaaggagggagcagccgccagtgccctcgtcgcccacaagaggaggaggcggaggaaggaggacggggcaggagagagaggctgacgaagaggaggggggggcggatcccggaggagggcccaccgcgcagtgtttacccccgctagccggcagccctgtgagtggagacaaatggcgcctagaagaagcaggcgcagggctcatcgggtgctgccaggggggccgcaacagtgcgatgaggcgagcgggcgcttgaggctgtgcgggtcctcggacctggcgcggagatgttttgggtttgcccagggggtttgttccttccgcgtgtttggtctccccccgattttatggctttcctctttttttggaacccactgggtccccctttctggtgtttgcccccatttgcgatattggggggggcccccc

SEQ ID NO: 687988 - DNA, 913 bp, Homo sapiens
tgaggctgcgacaggagaatcatttgaactcgggaggcagaggttgcagtgagccgagatcacaccattgcactccagcctgggcgatgagcgaaatgtctcaaaaaaaaaaaaagtgggggtctcgctgtgtggaccaggctgtctcgaattctgtggcctcaagtgatcctcccatttggggcctcccaaagtgttgggtatacaggcgtgaggcaccaaccttgcttggtggtgtcctctttaaaatactaggtttcaatgtaaattgcggtttaagataccttggtaaaatacccttatcaaatgagttttctataaaaactttgcattgtgtctagactttaacatactacgcaaataattcaggctcacacgtgtgcggcttaagtaagttcctcattgtcttacatttaaattaccgtctgtacaaattgaaggcagttacctcccatttcccggggagggtgacgcatagggtgcctggccacaatgggttattaggcccagtaagttgagcactgcaggttagactaatcccttggaacattacaggttgggccgacacccaggctattggtcgggttgggccacctttggggtattaggggttcaccacattgtccccgtgacgggctcaccaattaacggtgtggccagatttctaaacctgatgggtaacaggacgttttcccggaaacgagtgttttgttcgtggcccggtggtcaaatagcgaggaagggcttgcaattatgtgcacggtggggccatgtgtgggggtggaggccacctggagaacatagtgctacgatcaccgttttgccgcacactcactaactctcttggcagaccagcgaacatgttgcgattactgtgacgtatactaccgcgcgtatgggtggatacatcaca

SEQ ID NO: 687989 - DNA, 184 bp, Homo sapiens
ctcggctcccaagcagctgcactcaagttttaaagccactagattatattcatctctagagtgtcttgtaattgtaagattaaacactttttctctatcttactcaccaaacacatataaaccagtcctcttctgagccccacagcacttctttagtgcctccttatgataccgcacattcttc

SEQ ID NO: 687990 - DNA, 381 bp, Homo sapiens
ccaaccattcagtctcttgttacttaggtctggtcacaggttttcatggatttagggttcggtgattgactttagactgtagctcctaaggtctggttgatccctctagtattccccatggggtctcctggtatcaccccagaggttggagccaccatgcatgctagggatgtttcccactgcgatgccttcttcggacaggttgctcagatccagcggtttcccacagatctctcctgttcataccttgttcttcattctggtgttgaacttctccggagttttctctcgcctgatgtggaatcgatgagctatcgaggcgtccacgccaactggaccaagtagttcttgctgactttgcactggggactgggtcacttc

SEQ ID NO: 687991 - DNA, 245 bp, Homo sapiens
  misc_feature (166)..(166): n is a, c, g, or t
  misc_feature (175)..(175): n is a, c, g, or t
  misc_feature (178)..(178): n is a, c, g, or t
gcttgggtggacccggtcaacttcaagctcctaagccactgcctgctggtgaccctggcgcccacctccccgccgagttcaccctgggtgacgcctccctggacaagttcctgctttctgtgagcaccgtgctacctccaaataccgtgaagctggacctcggtgncatgcttcnttncttggcctccccccagcccctcctccccttcctgcacccgtacccccgtggtctttgaataaagtct

SEQ ID NO: 687992 - DNA, 584 bp, Homo sapiens
atcacaaggatgctggatttcatacaggaagccatggttgggagctggtggtggccatgatatgggtgggactagcagctcaggacttttcacaaagcctgtggcattgttcttcctccctctttgctgcctgcagtaccaagtcttatggttgctgccaccgtagcagagacctgtcctccgtgttgcaggttctacctcccacaaggaacatgcatttagttggctgcctttgcagacttcttttttacagtttgacttttccaagagtcggggacatttaggcaatccgcaagagtggaagttacattcctttaacccctgccttttgaagtctccatgtgtgcttgctgtggtcgctgagactcaaagtttaggacccccttcatgtatctctcatttgcgggttcagttgcctgctgttttccaactgcattttgtgtgtgtgtgtgcccagccccagtgttcttcttccccatttgtgccagatccacccagccccagctatcctccaaacccctgttaatcgggcgtgccttgtaaggaaggaggtgcatgctcataggcacatagcctttatctgt

SEQ ID NO: 687993 - DNA, 614 bp, Homo sapiens
agttctacaaatgaggaacacccccaattccgtttcaatcctaaacaagggatctaggatatacacaaagttaactaagttatgagagctgaatttccaatctctccaggttgaaacttcttcattaggccaaatcggtatgcaagtcggcactgtttcagcacctcattgaaaccctcacagagcttgatgtcacactggttctgggcacactccatatactgtttgatctcatagaggcaagactgcttgatactgtgctgactgggtcccctgaggctcctggtaagtaatgtcagacctcgcaggctcagcattacttcctccactaaagccctcagtaatggcgtgacccaatgtgtgctccacaacagagcccacagccacgccagctgcagtggttgccatctgggccatcagacctggctctcggggcgcatcagcacaagacccacctgcagatgggggtgccactgctggtggctgagcgactggtactggcctgggtgcagctctcatctgaggggcccggctgaccggagggaccatgaggaggttcggcttcgacttagacgcgccctccatggcactctctctctctctctctctctctc

SEQ ID NO: 687994 - DNA, 170 bp, Homo sapiens
aatacaaatctcttttggtgtttgttccatggcaaccactgaagtggtagctatcatcatccatgatcttcgaaagaccaaaatctgtaatttttatctctccacacgctgtaccatttactaaaagaatattacctggtttgaggtcatagtgtatgataggagggggg

SEQ ID NO: 687995 - DNA, 933 bp, Homo sapiens
taccatgctggaatttaggctttaaaaataatgtctcagggccaggtgtggtgattcatgcctgaaatcccactactttgtgaaggctgagggtgagaattgctagaggctagtgagctgtgactccaactgcatgtccagctcggagaaatacagagcgagaccgttgttctaaggaataatagtaataaaacatataaaataacgtttaatgattatttattgcaaggtcagagttacagatctgttataaattgtggaggaaatcttgtgataaagagatatgaaggaaaaagctttgtggtaaaagtgacatgtgaaggggctatgaagtaaagtatgctgcagattaatgtatgctaagtcaaaagtacagcttagtatttgctttaaaataaactcttctttcttctttaagagtatactatctcaaaactcattatgtgtcagagccctagagctggttagtgtaacactgactatgagtaggtgggcccacacttgagttgaggtgataccatggtgtcttcaggctctggaataggggtgtcactgcattgcaaagccaatgaatctgtttgagagtcctctccatttttcccagataaaaacctaatacaacgagtgacgattatcactcagctttggatcaaactataaacgtggtgcttcagagtatgggcagataaggttcataagcttcatcagaccgattttgaccctaaaggcgtgcaatcgtaagccccgaaaacctggggagggattgctgaacctgtatgttaagacaacacaggtgggtcaacaaagcggaccgcattggtgtcacgaggccgagtatacacgcacatcaaaattcagaagagcgggaacaagacaccaatagctgttaacatctcctcccgtgtcagttgtcctgttaatttatatattggc

SEQ ID NO: 687996 - DNA, 518 bp, Homo sapiens
cacagagtgaaaaactcttacgttacgtaggacactggatccacaggaaaaagggctgacaaagaatgagaaccaaagtccagaagaagtcactgcttactacaagaaaccccttcgggtatgacctcatacctcgagaaccacatccaaagaccctgcccccacaagacgtcctcgcaccactcaggtccccaacagccaagaagctcaggcaggaaaggagcagctatgggagcaagctggccaaggcagtggcgagcatgccccgggaggtgcgacagtgtaccacgacacggctcctcaagccttctgcaacaaagggcccaacgacccgcgaccccaagaacacccgtaagaagcgaccatatctaacgaaccacttggagactacaaacaaccccctggacacggccgactggttaggaccggatagagtaacactggagcaagacaaagacgaatggatcgaagcggacactagacctggccacccagccgccccagacaccgccagagaa

SEQ ID NO: 687997 - DNA, 258 bp, Homo sapiens
gtgattatagctctacctgctcgcaataggaggtgtctggtgtatttgatgttggaactgtcgcctccatcagagatgagtgccaccctcaatggctctgccactgctggaactgtagccacctccaatgccaagaccactgccatacgagtagctgcttcctccaccccggcctaagctactgccgacaccactggcaccgccatcgccactgtagacggtggactgcaccactgagatgttgcctttcggagaaaa

SEQ ID NO: 687998 - DNA, 1494 bp, Homo sapiens
taatgggtctctctctctcttttctctcttttacgtggggggggagacttctctctctctctccccgccctcctccctcccgcggggggctatacggggggccgcaggcgggacgcaggggggcggggcggtgggggtagtccgacaggggggtacacaccgcagtgggccaacaaccactactctgcaggggcaacacgggggagaactctatgaggagacgagaaacaagagagagcgcgcacacacaacaccagagagaaaaaaaaaagagagagagagaggacggcacaagagagaaaccacagcaacacacacagaagggaggcgaaaaggcacacacacacaggagaggaaaacatatcacccgccgagcggagagcgcagtgagaaaataaagagacgccccacaaaaaacaccaaccgagggaggacgcataacataagaaaagagaggggcgacccaaagaaaaacgagccagaaaacacaccgtgtgagggaaaaagaaagaagagacccagaaaaacacggagagagccatcacacacagaaagaatactaactctcgagagagaagaaccaaacccaaccgaaacacaaacaaaacaaacaaagaagacgacacagagaagagaagacaggacggaaaaaacaaaagaggaagcaataaaccacaaaagacacagagagagagacaacaccgagagagagaggcgaacgaacccacgaagagagacgagaaggcacacccaagacgaagagagaaagaacaccaacgacaaagagaacaaaaaacagagagccaaccccaaaaaaaagaaaaacgcaccgcgacaaaacaaacaacaaagagaaccaacaagacaaacaaaaacaaccacaacacgaagaaaacaaacaacccaagcgaacacggaaacaaaacaccaaatacgaaagagacataccacgaaaaaagcaaaaaacaaactaaaaaacacaaacaaagaaactataactaaaccaacgacgcacacaaaaaaaaacaagaccaggagaagactacccaagaaacaaaagcacagagcgtgctcacaccccagcaaaaaaaccgatcacaccaccacaaaacacatgaacacaaacaccagacgggcaaaaccagcccccgtgggacacacgacagaagaaaaccaaaataagggagaggacacacacgagggggaggagcaacaacaaccccaaccgggacaaagtacacaccaccagggagacagaagagacaacaaacaaagacgacgcaaccgagcagacaaaaaccaaacaacacgaatgaccaaccacaaggtgatgacacaaccagtcacaccagagcaagcgacggaggagaacctcacacacacaacgacgcagcaacgaggaggaacaaaaaaagaacacaccttcgataaacacgacacaacaaaagacaaggaagacaagaccccccccaaacgagaaagaatcccccccac

SEQ ID NO: 687999 - DNA, 1766 bp, Homo sapiens
cccacccatcgtcctgcccagcgacggcttccagagtggacttggaagccaactgcctggacagacagcatctaccagcacctgctctacgatccgccacttatctgtgtgggatctgctggagacagagccagaccaccggacagacccatgtgcaggccatggacagattggggccatcccagaccatgatgtgaacccagaggagtatgacaccacagtaggtccattgacagtggcaaacctgtgatgggacccactgaaagactttgcccaccctgggcttcaccaggggaaccccttgtgacccaggcaagaccccggtggaaggttgggacaccacgtgaagacgttaaacctccttacaccatttagcagtggaggagtggcacatcccccagtgggagcacacaacgaggaccacaccccacaccttgtgaacacgaggcaaacaccaggagaaccagatagagagcagagacttccacccagaggcagttggaggacccacaacccgagaacgaaccgtgacacatacagatcaaccattgacacatttgggctccaacagacccatacacacaagacaaaacaacacaagctaagggggccaccttggacgcgcccatgggaagggaaacccccccgggaacgtgggggacccaggacagtacccggcgacggggaccccccctatgattcgcacacacacaacgaccggatgccccccaaggcgggaacgggccacagcacgagaaaaccaggggaacacgtccaagaacagcacaccatacccagaggagagactagggcaaagcaaatcccccggcggaaaaagcggcaaaacaacatccatgcaaaagcaccacatatgacaggagcagagagaagttacaccaccaatcccacaaagacacaccggggaacacaaagacacgaggaagccaatacacaaggacaacaggaaagaggaacgaatcacactggcaacccacgatcataaacaaacaggggacggcgaaagcacagtggacaccggcaaggcacgcaccacccagagacaatagagaggaacatgggagccaccaagaaacacccagaaagaggaacatgacaaacaacaagacaaccccaatggaaacggcaacacacgcgagacacccaatcaaaaaataacaaaggaaacagcatgagaaaccaccgaacagaacaagaacagcaccgaaaacgccgaaaccacggacaagcgtcgacgagacacagtagaacaacaacgaggacgaagaaaccgagaacaacacagtagagaaagagaatcgaacacgggacacaagcaacgcacaccacacagagggagagcaaccggcgtacatcacagcactggacagaagcactagatagaagacaacacggaaacaccggccgcacagtgacgcgagcaaaacaccacaacagtagcgaggcacacacgggaccgacgcagccacacccgcaacgagtggagacaccagcacgcacaagcacacgaaaacagcgacagcaggaagagcaccccactcacacaacagacggagcaagcagagagtagacccgaccacaaagacgcacgagacactccgcaacagcagcgcagtatacaacggtgcaacgtcacagcagcgagacacaccgacgagcagacgaacgatcagaagcagacgcagagcagacacacgcaacagagacaacacagacagacaactagaagagacaggaagcacgaacaa

SEQ ID NO: 688000 - DNA, 1100 bp, Homo sapiens
atagtttatctcttaaacatctacacagccgcttagatgtagaatttcttgttgcttgttttctgcaaaggcagatacatttacaatatattcctagctcctggggctgcacaaactgttcggctggctttttgtccccactgctttagactaagctgggataggcaccatgcatattcagcttactataactaatactgtgataggcattccgtcagtcttcttcacaactaataggacagtctgttgaactagcattcctcgcaactataacccctaacaaacgccagtacctttaacattagtcctggcttccttgctacattaatttgtgatttccttgcccaaggcagctttctgtacctctacctctcgtgaccattgcagcaacgcctggttacgcacgtctgtataacgttccgtctggagcaaggtgttatcgcgacatcaccccttgcatgccaaaacatacgtctactctctcattctatgttccaccttacatggaacgtgggcttaacttctaaacgccgctcctactaacccaaggagtccctggatggccccatcatgcgtggccaaaaccacaccgtctaaccttaacgccttcaacgcattacagcttactactacatggggcccattgggcatgggctggaccccatcccccccaagttttgctcaccaccccttctcaaacgacaccttgcacagccaccttcaccttaacattaaagttcatccctcaccgggccttggaccccatgcgaaacactacaccgaaccacttactcgttcaatagcctgacgacctttaccctccgaagaagcacaccaaccgactactccccctaaaacaggtacccccctttacactctttccataccacgccctcttccatcacccatctcctccctctttgagcctttctccccaacccagacccgaaaacacgcccattcccctctagcgcctcaacacctcaaacactttcactccaacgaccgggacaaccccccactcttccccattataacccttcaactacacaccccccgtcaaacgactgccccaacatcctcaaccaccttcccttccc

SEQ ID NO: 688001 - DNA, 306 bp, Homo sapiens
gtcgacatgaaaaaaattaaaaaaattattatacatagtaagtggttgctcttttctgattgtaaaagtaatctaaattcattatagaaattttagaaaatacaaagccaccaaaagaaaattaagaactataattctgttatccacatttccttactggggtcagataaccagtgttttccactttgcaatatactgtgcatggttccctcccctactgatatgctacaatttattagccagtttgctattactgggacactttggcgatgtcctgaatttcagggtgtgtgtctgtgtactaga

SEQ ID NO: 688002 - DNA, 192 bp, Homo sapiens
ccactactggtttattttaaacaagagtctaatcacctgtacttgagttattactactctatcatacttagctaatttcatagctgctagaaatcttaatcaggtcaatctttttcacacttcttcttgtttcaatctacttaacttgtcttctggcagaataggccggactgttggtcgccacccttcaat

SEQ ID NO: 688003 - DNA, 310 bp, Homo sapiens
cactacagttgctaggtatcataacctaagactgttagatataaggtcatatactttataagttctacgtaactctttttcccatccctgattcttttctgagtattctgcagacagggaggggggggcaaatgtgtacccggaaatacagtgacaggatggacctcatacctcatagcctgtgctactccgcccgcctgtgagacatgcctcagtggctctcaaataccaatcttctcagctcgtagatcttagagatcactctgcctgctcccttagtgattagggcagggaaccctccccgcactgt

SEQ ID NO: 688004 - DNA, 202 bp, Homo sapiens
tgagagaccgtgttgcatcgcaaaccatgactagatcaaacaacacttgttccacaatgaggaagaagcatttgcatatggagcctattgatataactgttaaagaaacaaaagccaagaggaagaggaagctaacttgttgacagtgtcaaacgacgttggatagcaagacacattagagccccaacttcagtgattattc

SEQ ID NO: 688005 - DNA, 401 bp, Homo sapiens
ttggttttctgtccttgctgtagtttgctcagaatggtggtttccagcttcatccatgtccctacaaaggacatgaactcatcctttttttatgactgcatagtattccatggtgtatatgccacattttcttaatccagtctatcattgatgggcatttgggttggttccaagtctttgctattttgaatagtgctgcagtaaacatatatgtgcatgtgtcttcagagcagcatgatttataatcctttgggtatatacccagtaatgggattgctcggtctggtatttctagttctagatccttgaggaatcgccccaatggttgaactagtttacagtcccaccaacagtgtttagtgattgccattctctggtgtgagagcgtgctcacttcggcg

SEQ ID NO: 688006 - DNA, 374 bp, Homo sapiens
cacatagtggatatctcattctaaagtctgtaccattagcagcactatggcacatcttatctatactttatatactattactccagtaatacatgtttactttaaaaatagttgcagtgaagaaaaacctttaactagagaaatcatggcaaaccgtcttcatttaccattggctatgatggacttcatattgtatattaaaaatgcatattgatcactataattctaaaacaattatttaaataacaccagcaggttgctaaaagaaggcattatatctaaagttatactaataggtggtatagcagatatataaaatttaagagttgcttttacagttaacaatggaatatgccttctctgctatgtctgaa

SEQ ID NO: 688007 - DNA, 261 bp, Homo sapiens
  misc_feature (8)..(8): n is a, c, g, or t
taggagtnggaggctgcagtgagacagattaacaccctgtctcaattaaaaaaacaaagaaatgtgcttaatgaaaagcgtagccctcttcagggtgtgctctctgcatctccagagagtggaatgggaattagcttatggtttttgcctgcttcttcccttcgggcaagtaacacgccctttcaagccttggtgtttctttttttgggcacagcagttaatgtgtagaaaccccaggcctgggttctgatacggtttgga

SEQ ID NO: 688008 - DNA, 348 bp, Homo sapiens
ctagagtatccccggcagtgcagagagaactgaaacatcatagcagagtgtgtaagactattctatgattgtacatcctagtataaagagaaagcacaatatatagtccgggtttcatgaaagtttgaccatgatgggtaacctattgagcttatatgttcacaaaaagaatattttctgaaacttggcgcttctagagcataatgtggctcttgctttccagcgagatttaaccattctcttgcaagtgggacgtttcaataaattgtggtacaatttatgtttattatgccgctttacaaagagagacgctcttacaaatttctggcccttcattctctctccagt

SEQ ID NO: 688009 - DNA, 641 bp, Homo sapiens
attactagattccataaccccggggttgaaaaattttttgcccctttttataattttttttgggggcaaatgggtgaaccccccaacaaaattccccgggggttgaaaatttggtgaaccttgaatggacattggtgtaaaattagcaaacccaaaaccccctggttgttctttggaaaaaagccctccaaagggttgaaaccaaataaaaaaaacattgggaattggtaaaaaaaaagaatgcctttgttatgcaaaactttttcccaaaaaaaaaaaaggcctttgtttaaggcccaaataagggtttaatttttttaaaaaaaaagccccaaaaaaattatttttgggaaaaaaagggtttctccctcccccctaattaaggggaaaccaagggggggaggttttttttaaacctggttttactttccccaaatttaaggagaggcccacccctatttaagggggcccagaaaaaaaaaaaaaggggggggttttttttaaaaaaaaaaaaaaggttaaaaaaggcgggggaaaaattttaataaagtttcgggctcctaatgggggggcctttgtggcccaaaggaaaacccacactttggaaaacccttgggcggaatttcttggagcccgggggg

SEQ ID NO: 688010 - DNA, 360 bp, Homo sapiens
aggaggtaccccacggccattcaggatgaaagctgcggtgctgacctaggccgtgctcttcctgacagtgagccaggctcggaattcctggcgacgggatgaacccccccagagcccctgggaacgagtgaatgacctggccactgtgtacatggatgtgctctaggaccgtggcagctactctgtgttctaggttgaaggctgctgcttgggcagctcaacctaaagctccttgacaactgggacagcgtgacctcgatcttcctcaagctgcgccagctcgggcctgtgacccatgagttctgggataacctgtaggccaatgcgcacgcctacgtgcacgacgtccagaagagtggc

SEQ ID NO: 688011 - DNA, 156 bp, Homo sapiens
  misc_feature (69)..(69): n is a, c, g, or t
gtcaaggctgagcccagtgtgtcaatagtttggtctctgtaacaccagaattcttcacccacttgcttnggaggacgaggaagatgctagactgtaatctgtctattccctgccatcaagacaataaatgaatcagaaccgagttcaatgattttc

SEQ ID NO: 688012 - DNA, 400 bp, Homo sapiens
tcctcggtggtcagacgcatgtctcatagcggtctcacttgcattgggcatgcttcggaacatatatacctatcttccagaatggtagcgggtctggggtaatgctagctcttgtaacagttgagccagtagtaaacagtggacgtaatctagctgagataaggatgacgtagtgctcttacaggtgtctgcgtcatgtgtccatcgcaggcggttcctaatggatcctatgcgtcttgtctgtatgtaaggatttccattccatctatagtattggtattcacagctgtcttcagttaagttctctgctccagtgtcagctatggaattcggcagtgggtaacgcaagctcgattacaggagaagagtggtctaatacaccattatctgtatatgacac

SEQ ID NO: 688013 - DNA, 246 bp, Homo sapiens
  misc_feature (12)..(12): n is a, c, g, or t
  misc_feature (76)..(76): n is a, c, g, or t
tcggcgtctgtnaagcagaagggatgtttgtcacttgttctgcaacttgggctgggagtggtggctcatgcctgtnatccctgcactttgggaggctaaggtgggagggttgcttaaggcgaggagttggagaccagcctgggcaacatagtgagaccccatctctacaattaaaaaaacaaattagttgggtgtggtggcgcacgctgtggtcccagctacgcaggaggctgaggtgggaggttc

SEQ ID NO: 688014 - DNA, 252 bp, Homo sapiens
gatactgaccactggaaatcgcagcgttttgctccatcaatgaaatacgctttcgcatttcttcacggggcgcgccctatgcttcttagcgtcgcttgtcaaaatatcagctcatctgtctctaatgaggtactctggcagctccgttcatgtcattgtgtataatacccgatatcatactgcgtgtttcctcgctaccgtccacttcgatcttacctgggtcataagctgtttcctgaatatagatagagg

SEQ ID NO: 688015 - DNA, 306 bp, Homo sapiens
atagaggctcagaagaaaccaaccctgctgataccttcatcttggactttcagcctgcagaaacatgagacaatcaatttatgttgtctaaaccacccagtccatggtactttgtttacagcagcctcagcaaacaaatgcactggtttagaacacaccagcagctgggcacggtggcgcacgactgtaatcccatcactttgggaggccaaggggggaggatcacttgaggttagaagatagggaccagcctggccaacatggtgaaaccacgtctctactaaaaatacaaaaaattagccaggc

SEQ ID NO: 688016 - DNA, 422 bp, Homo sapiens
atgggtacgctccgggatattccatgaacgccatcttgatatccgcgtaaaaatgctctttccaacggatcacgcttacagtcttctcatagggtgtatccctcacttgttgactgtctagattccttcggccttgtccaaggccgggcagagtttttctgccgttggtgggctcgatgccgacatagaaagccgatgtgtcggaaccgtcaaggacgccaacctgtgttgagttctaaccaataggacacatgtattcaaatgatcgtaaagtcataagcacgtaacgataacaatgctatagccatcagctgagatggttattcgccccttttatagggcaaagccagctatgatgtgccctgcacagagaaaaggtttaatccctaggagagaatgaccgcctgttgccgatattcaac

SEQ ID NO: 688017 - DNA, 214 bp, Homo sapiens
cggagacacttacggctacctccgcctcctctagaatattgatccatgatccagtatttctatattaacccactccgcttgtttcttctgacgcttcagcctagagatcaaaagtagtttctgacattctaagagaaaccagtcagaggaactaaatacactccaatattttgttcactgcgagtatacctgtactcaatttcgtatagttgtc

SEQ ID NO: 688018 - DNA, 306 bp, Homo sapiens
catcccccccttacacttccttacccttctctaagataccattcttcactttcctcaggctgtgtgtgtgtgtgtgtgtgtgtgtgtgtgtgtgtgtgtgtgcgcgcgcgcgtgtttagaggcacagtcttgcgtgtcgccccagttggagtgcagtggggtgcctgctaggtacaagtgattcttcgtgtctcagcctcccaaatatctgggactacaggcgcatgctaacaccaccgagctaattgttgtatttttagtcagatatggtgcattttgccatgctggccaaagatggtctttgaa

SEQ ID NO: 688019 - DNA, 366 bp, Homo sapiens
  misc_feature (154)..(154): n is a, c, g, or t
  misc_feature (268)..(269): n is a, c, g, or t
tgagtcgtagtccattatctgtgtacaccacatcttgtttatctattcatccatggatgggcatttcaggtgttcctacctttcggctattattgtaaataatgctgctatgaacattcacgtacaagttttttgtttaccttagtgtgggttnttaattttgtatttctcttttcaccatgtttaaaaaccatgtgcatttttaatttctctgcaaacttgctattcctgggcattgcataatgggttgggggggctcccttgggcnntttttttttttttttttttttataaagaaccaggatctaccctttggtgcacgcgggggggttttttggaaattttgggctcaaacccaccccctgg

SEQ ID NO: 688020 - DNA, 191 bp, Homo sapiens
taaaaaaaaattaaacccgggggggggggcccccccttataaccccaccttttgggggggtgggggcgggaaaaaatttgggggcaggggtttgaaacccccccggaaaaaatggggaaacccccgtttttaaaaaaaagcaaaaaataaccgggggggggggagcaaaccttggcccccaagttacaaag

SEQ ID NO: 688021 - DNA, 119 bp, Homo sapiens
aacggttgaggtacagctcgagatgtaaccaaagctttactgaaccctcgacccaaatcggtaactcaagtgcatcaatcataatgaacctccccaaactcagtatttatgattatttt

SEQ ID NO: 688022 - DNA, 124 bp, Homo sapiens
ttccgaatttgaatgaaaaacttaatgccatggattttttttttttgcaagacacctgtttatcattttgtttaaatgtaaatgtccccttaggcttttgaaataaatttccttttgtaatttt

SEQ ID NO: 688023 - DNA, 184 bp, Homo sapiens
aagcagttaatacagactcacaatgtagcttggattacagtgcgggtcgcatacacccagctaatttatctattttaagtagagatggggtttcaccatgttggccaggttggtcttgaactcccgacctcaggtgatctgcccggcttgggttcccaaatgtgctgggacttacacggcgtga

SEQ ID NO: 688024 - DNA, 540 bp, Homo sapiens
tgagatggagtcttgctctgttgcccaggctggagtgcagtggcatgatcgtggctcactgcaacctctacctcccgggttcaagcagttctcctgcctcagcctcccaagtagctgggactacaggcacttgccaccacaccgggctaatttttttgtatttttagtagagatggggtttcgccatgttggccaggctggtctcgaactcttgacctcaggtgatctgcccgccttggcctcccgaagtgcgggattacaggcacgagccactgcacccggcccatatttcttttaaagaaagattggaaaatacagaaagttagaaagaacaataaaaaggccaaaatctactaccatgttttttagtgcatgtccttcagtctttatatgtaaattgtttttaatagttatgtaattatatagttttacatggcctaatcttttcaccttatataaataataagcaatacacacgcacacacacattttggcaccttatataaataataagcaatacacacacacacacatttcgga

SEQ ID NO: 688025 - DNA, 409 bp, Homo sapiens
atagcgcaccgtaccccagataacttagaagggtcaattcgtgagggtctggtaagggacgggatcgatacatttgagcgcaccgtgcccaatcctgacatgcgagcggcaatttcagaggttgctcatcaatgttcttccgctcctgcgtggtttgaattgcaacctccgcgagtgaaagacggctatagcagcagcgttggcgaccggcagtacttcatcgactacaacccggcggtctcaaggagcaagtgcaacagtcagttaacttttctgcacctgctaagcgaacgcaatcccgcttccaaaacatcatcatcaatggacgtctgaccgaaccgagccgatctgcttgcacacgattttcactgccgaaagcttaccccatgacaagctcttccgtcgctga

SEQ ID NO: 688026 - DNA, 156 bp, Homo sapiens
agtaggtagctgcagataatgctagcggttaggcgtacggacagagactattgtgaatgaatgagtagagctgatggtttcgataataactagtatggggataaggggtgtaggtgtgcccatgtgtgtaagcaagtgggctagaggcatttataa

SEQ ID NO: 688027 - DNA, 189 bp, Homo sapiens
gagtggcagtgacgagagcctccagaggacgaggaggaagaggacggaagggagaaggagaatgtgacagttctggagcaaagacactgtgcagtagacagatgtggcatgctatgggcaggtttactagagaatcatggtgcattctctggcaacacgtattgacatgaagtatggaacaatagataa

SEQ ID NO: 688028 - DNA, 669 bp, Homo sapiens
atgtcagggaacgtttctcctcattgctgtcatggcaccctgtgtgtggctctgaccagacttagctatccgctttgatttctgtctttcaggggctaagtcctgcctacatcctcagtcagcatgctgcctaacacataacagatcctaagcaaatattgggtggatgaaaatcactaccattcaaggcttcattgtatttatcagtaaaactgaaataatatctaatggggtcgagaagatttactgaaaatatatatttgaaagggctttgcagttttaagtactgtacctatgtgcattgctgttacattcaggagatttctgagttttagacagtcccaagcttcagcttaaaatctgtagactgcagcccgtttctgaaacgtttgtactacgtgttgactaggaggaacaatgacagactctgtagtcaccggaaatacttaaggaatcatgaggtactatgtatttccttaaattatactgttttttaaagctgaagtatctaatagttaatgggttgtccaaatttgtcagaacatttgactgtaatttaatgtctcaccatttttcaaaaagatatattaataccaaatattaaaatgtgtcaagactaaatctgagttagtgtcttaacacacattttccaaaatctgtccgtgatca

SEQ ID NO: 688029 - DNA, 629 bp, Homo sapiens
gggatacaggtgtaagcattgcccccggcgggcacattgctttataactctatttaattccttgcttgcacgttgaatagatctaaatgactgggggaaaagtaaaaacatagtctttagtccctttcattgtggtaaattcactgaatgatagacggaaatttcagccttcttgggtctactgccaggttctgtagttatttgtatgtctcatggagaaatcctcattgattacactgtatggctaaactgacttaaaacagataactgagcctatttcaaaattgaaaattctttaaaatggaaagttagtactctattgttcccaaactgttggattgcatgccattttcccaaactcacagacgttgataagatttcaggcaaggggaacaaggaaggggtcacagtggaagcgaattcttcccctttttctgactgtgtttgcccacctgtcctttacccttcgcagttctattctgagaggtatgtgaggaagatgggagccactgctgctagatagttgccattaaacaggtttcatggcttttgtgggagcctccttttcattagtatttgcacatgttcaccagccaagaaccaccggggtacgagctcaaatcgtaata

SEQ ID NO: 688030 - DNA, 244 bp, Homo sapiens
tttagaagttcatagcagatttcgtgggccatggtgtcttgtacttgtggctcaccacttctttaatttcaggaactgatgtgcatgcctagttttagaagtttcaatagccattgccattcactttttcttatttggagaaaagaagacactgcgaacgtggaaccaaccttcaattctttttttggtgataggcagggttgtaagaactcaataaaatgctattgaaacttctaaaactatg

SEQ ID NO: 688031 - DNA, 176 bp, Homo sapiens
atcagctggtaccgtatgaattctatccagaagagataactgtactgaattactaataagaccataagctaccatatatagtttcttcttaaaaaacaaaaacaaatacaatttcctcaaccatgcaggaatgccaggacagggctataaagatgcaagatttgctgcctcctata

SEQ ID NO: 688032 - DNA, 313 bp, Homo sapiens
  misc_feature (76)..(77): n is a, c, g, or t
  misc_feature (86)..(86): n is a, c, g, or t
  misc_feature (105)..(105): n is a, c, g, or t
  misc_feature (222)..(222): n is a, c, g, or t
  misc_feature (245)..(245): n is a, c, g, or t
cggcggatgcatactttatttttgatttccctttttgatgtttattttcatgaaaaatggggtgaagggggtacannaagttggcngtgggagcgggggatctcngataaacctgttgccctctgagtgtttcccatagtaaacgtagcgacacttccccaggacacctgccttttcccacctctaacttccaagatcagtgacaagagggggttggcgaanaaaatgaggggggggcgtctcanggactctgaatcttctgctggggttttgggacaggggctatccacatgccaacatttccacgtctgca

SEQ ID NO: 688033 - DNA, 234 bp, Homo sapiens
gaagaaataccttagaccatgcaagtttccgcatctctgtgaactttcccaactttagtttcagaattccatctttctaccctccgcaaacgttgaaagtgatacggccagtcaagcctgattacttgaccaaactcctccatcttagttaataaaaattccggtcaaatggtttccttgtcactagagacctagtttgggattccccaggctgaaaaaaaaaacagtccacgc

SEQ ID NO: 688034 - DNA, 199 bp, Homo sapiens
aatattatcattgcccttcactgtctctggaaaattacttaaacttatagacagtttacctcaaaataaggtgggataataataacagttctctttcaacttctgggtacctcaggttataaaatgccatgacagcacagaactatccacagcagcaaagacatggactcaaactaggtgcccatcaatggtgcaatga

SEQ ID NO: 688035 - DNA, 793 bp, Homo sapiens
gcatcgcagagcgcagcgccggcgcggggccgcgagaacgcagcgcaggggagcagcccgaggcggacaccgcgagccgcccggcactcccgcagtccagccgtgctcctctagcccgtgccacggctccgctgcgggccacccaggattactcgcgtctggctccaggcgccgagaaggcgcgctgggcgcccgtggccgccgcgccagctcctcctcctccctgctgctcctgctccctggtggcgagcgcgcagcccctgagccctgccctgcgcctcccggagccctccccccctgctgctcccatgcgctgcgggtgggtcatgaggcacagctgccctcgcgtttctagcgcctaaggaatgcagtgtaaggcatcatgctgtgcgtgctgtgctgtgctggctggatggcgtgagtgctggctgggtgcatgactcctgtccttgtgaccatgctgctgctcctactggacaattagcgtcctgtgccccttgcccatggctctgtcccctggcctggcatgtaccaatgcctttttgtgcactgcctgtgccccccttctgacccccttgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaacatgttcgcgatcgggaaggccggacccctcgccctcctggacggccaccactttaccc

SEQ ID NO: 688036 - DNA, 122 bp, Homo sapiens
  misc_feature (89)..(89): n is a, c, g, or t
cagttcttgaaggtgacaacttagagactcctatcacactcatcagtatgtggccagagcactatgacccctcacaatctcctcaactntttcatgatgacacccattcaagaatagaacaa

SEQ ID NO: 688037 - DNA, 965 bp, Homo sapiens
cgctgtggttcaggcttgtaatcccagctctcagggagtctactaggcggaagagatagctggatcccaggagttcgacgagctgcctgggctgatatatgcttgggaccccgttgtcctgataaatgattaatcaaccaaatgttatgaagggaatcttggtgcgaacgagactctcaggaaagaggggatgaaattgcaagacgtttgggctggagatcttcaaagtaagcatcaagctgtgttccaggggttcccagaggacatgtgcggaatagccccatgtcgtatcaaattgttatagagaggatgcccgcgtgtaagcttgagagcgagtactagggagagaattgcaacaaggcgtagtttgtccgccaaaggtgggtctcagatagccaggagacacgtgggggactgttttcaaaacacagcgcctcgcggggggttaaatgtacattgggccgcaaaccataatgaagatgtgagcccttgttgatgtgggggaaccagggaagacgagatgtcactgtttaaattcatgttcaccccataagacattggttgttaacccactgcattggcagaaaactttgaatgtcactgcatgaattaattttcaggagagggacctatcccaaagtgtgggagttggatgctatgcaaagtcccttggaagaagggagtttcaaggtatagtgggggtcataaagattgaatcaagaatcaagctatgggaagtctaggcacaggttttgaaaggcttgcgacagttgaaaagtggctcatttaaggtttgcgtgaatgcttggcagtttgtacatttaacagtggtgaaggtattgggctgtcaggtaaaaagaattgaagtattcctttggggagcgtgtgtttgtatatacacaaaaaaaaaagatggggggcgagagaaagatgggcagagaggaagacgaactgagtgtaaagcg

SEQ ID NO: 688038 - DNA, 462 bp, Homo sapiens
tctctatgaaaaatttaaaaaattaggccaggtgtggtggctcacacctgtaatcccagcaatttgggaggccgaggtgggtggatcgcctgaggtcaaaagttcaagacttagcctggccagtatggtgaaaacccgtctctactaacaatacaaaaattagccaggtatggtggtgggtgcctgtaattctagctatttgggaagctgaggcaggagaatcgcttgaacctgggaggtggaggttgcagtgaaccgagatcgtgcctttgcactccagcctgggtgacgagtgaaactctggtgtttttttacttccttttttttttttgaattcccagcttctcaggaggcagaggtgggagaattgcttgagctcaggagtttgaggctgcagtaagctatgattgccccactgccctccaggctgggagaaagcaaaacactgtctcacaaaaaaaa

SEQ ID NO: 688039 - DNA, 341 bp, Homo sapiens
  misc_feature (22)..(22): n is a, c, g, or t
  misc_feature (206)..(206): n is a, c, g, or t
  misc_feature (280)..(280): n is a, c, g, or t
  misc_feature (298)..(298): n is a, c, g, or t
gtcgcatctaaggatgagaggntctgccggtccaccctgaatcactttcctaccctacaaatactttcttccatggctcagaaggagctcaaagccctagtggtggaaagaccctcgacagcagtggtcctcagatttccttgtgcaacagtacaacaaagagggcttgtggatagagatttcccttactctggttaattggtttnaggtacggcccaggaatctgcatccaatgtgctagtctcaggacatgttgatataggcctttggaccacatttnatgagcccttctttcctncctggtggggcacagtgtatcacacaacctcttgctatggact

SEQ ID NO: 688040 - DNA, 81 bp, Homo sapiens
gccgaggacacggccgtgtatcactgtactagaggatacagtggccgcgcagcttatgcttttgatatctggggccaaggg

SEQ ID NO: 688041 - DNA, 358 bp, Homo sapiens
  misc_feature (4)..(4): n is a, c, g, or t
  misc_feature (106)..(106): n is a, c, g, or t
  misc_feature (131)..(131): n is a, c, g, or t
  misc_feature (137)..(137): n is a, c, g, or t
  misc_feature (185)..(185): n is a, c, g, or t
  misc_feature (194)..(194): n is a, c, g, or t
  misc_feature (209)..(209): n is a, c, g, or t
  misc_feature (237)..(237): n is a, c, g, or t
  misc_feature (354)..(354): n is a, c, g, or t
ctcngggttggggcaatgtgggctctgtcttggctgggcttgtggtggagcgttaatgtgggccatggcggtgcataacccagctcctggcttgggaggcattggngtctgggcacaggtgtgtgccatgnccgggngaagctgtgcgcagctccacctgcctgccaccgttgcctctgttctgntgggcgggngtccagctccaaggntgggtgggtgactcagctgcttatcgcnccctgggaagggtgggggtgggctcatctctgacagtgacatgcggctctcccacctgaggcctgtctcctagctgagcgcaggtaagacagctaggactgagggcctgctaggtcnggag

SEQ ID NO: 688042 - DNA, 409 bp, Homo sapiens
aaggtggtccggcacctggaaaaaaaacctggtttgcctccagggcagcctgtttttatccctgggggccccgaggggggggacgtttaaaccatggccccctacgtccaggatttccccccaaaaatgttgggtttggccgggtccccccaacaggttgccccgggtagtcccagtttccgggggtttttcaatcccggccccaaggattagggcccgggttacattgggggcccccccattgccatttacctggtcaaccccgggggccttttcccggattttttcggccggagcagatcggtttagcagatttcaaacagtgggggggggcccatgggggctttccccagtgtcctttttttagcccccccagtttgggccccctcctttaacggggggggtttta

SEQ ID NO: 688043 - DNA, 371 bp, Homo sapiens
agtatcatagacgctggtatgtgtctaatcctttctcactcacgatgctgaagtaccagtggaatcaaagtgtcaaactacgcaaaaacgatatgtggcttatgggtattagtgtctcattcttggtatatgcttgtgttaactgcccattggcctgaaaatactcattgtaagcctgaaaaaaaaatctttcccactgtttattctgcttgtcgtaagaatcaaatgaaataatgtatgttttaagcaccttgtaaactgtaccctatcaatgtaaaatgtcaaggtgtgttgttatttcattaattacttctcagtacagaatggaatttcctatgcaccactgtagactaggaaatgctgaaaacaac

SEQ ID NO: 688044 - DNA, 298 bp, Homo sapiens
tacaactcagctctgtacccagcagcatagatattaccgactccatctcaaaaaaaaaaaaataagaaaaactttttaccgtcctgattaccacatcagcaaccctaaaaaaacaaaaaacaaccccaaaactttttaaaaatttattattgcaaaattatcattatccattaatttttaaccttaattattatccttattggtatgatttataggcaatttagaaagaatgcagaaaccaagggatcctcttaattgtgcgagcagaggctattttccagaaattggagtctcactt

SEQ ID NO: 688045 - DNA, 129 bp, Homo sapiens
gtttatctagaggtcccgacagacctgtctgccggatcgaaggcaccgtcccgtcgggctggacaccacgcggctttcctgccggtcatctccgccacccgctggggccgcccagttggtcgatagagc

SEQ ID NO: 688046 - DNA, 282 bp, Homo sapiens
caaaaaaaatccaaattttgaggttcttggaaccattttttagtttcaggcatattaagtttgggccccaaggggctggggaaaaagggccaattcttttaaaaactggtaaatcccggccaccaccggaagttttaagcttctggtcccccctttttaagtggagggggggggggaaagcccaagcctttatttccccggttttattttcaacaagggaacctggtttctggctttgcaaaaatttggctttcccccttttcctttaaaacaaaggttcca

SEQ ID NO: 688047 - DNA, 703 bp, Homo sapiens
tattttcaaaaaaggacttgtttttcggcaagggtaaaaaaccacaatccttttgcaaagattcagcctgcccaacaaaagggttcaaaagaattaccccaattaccagtggcaatcaagaaattcttctttccccaattaaaactgaggttgtcaaggttcctgtcgtccctcaagtaacgtgtggaattctccagaaaagataaacgtgttgggaatctcttattttttggataggctaatacctcgcatgtgtcacaacgtaaacagggtggttaataattcgtcccacaagtaaaaaacttcatcaaattgtattccccttttttggcaacaaggggtgccaagtccttacgccaagcttgattttagggcccataacattctcagggagtctgggtatgctggtaaaatcagccagatgctggtgattttgacaccattacattttgatcgggaccctcttcaaaagcagccttcatgccagagatctgtggttattcgaacctttattactagtgacttcatggctggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaaaaaaaaaaa

SEQ ID NO: 688048 - DNA, 419 bp, Homo sapiens
  misc_feature (91)..(91): n is a, c, g, or t
  misc_feature (110)..(110): n is a, c, g, or t
ttaccctggtcacctgctccatcctgactcatctcgggtcacctgctttgaccggagtcacctttagttacctcttcctaaaccgtccttncccaccaaactgctcaccnccgccactctggcttcgtactcctgctctttttaaaatagccagtcggaattagcttagactgtgtggtccaaccctagccaataagggaacgacacagcagtagggactacctgcctcagggataagacctcctgtccctcccgtgtccaggtatgctcttgccatggctccacctgtgagggtcaccctttatgcaaaaagtcaaaactgccttgctgagaacattaaatggatgctcgagtgctatttctctgtggcactggggaacaagcattttgcatttctaacagtccaggcaccagccttt

SEQ ID NO: 688049 - DNA, 530 bp, Homo sapiens
  misc_feature (176)..(176): n is a, c, g, or t
tagaggagctgtaactgggtcgagtcttatgctcgcatctgttctagctgttctttatttcgggtcttttctccgtttagacttatgtgacattccaggtgaggaacagggatgagaaagtagaattactcctggtacatttattccaaatcctataacttcataaggtaaatgtntgggtgggcttaaacaattcaaaactagctgggcatggtggctcacacctgtaatcccagcactttaggaggccagggtgggcagatcacttgaggtcaggagttcgagaccaaactggccaacacggtgaaaccccgtctctactaaaaatataaaaattagctgggggtggtggtgcatgcctgtaatcccagctactcaggaggctgaggcaggagaatcgcttgaacccgggaggtggcagttaccaagagccaagatcgcgccattgcactccagcctgggccaccgagccagactccgcctcccacccacccacccccccccccccctccccccccacccccccaccc

SEQ ID NO: 688050 - DNA, 820 bp, Homo sapiens
  misc_feature (657)..(658): n is a, c, g, or t
gcctttcctttggcaaggatggcggagtacgagttgattactcgcatccgtgcagtttttgtgatcggtatctattcattgccgcttcttgagattgtcctctctggtcatccgtgcagcatgatcatcaatcgacataaggaatcttagtcactccaggtttaaataagggaccgttcttgagtgattaccgaacatggtggactctgcttagtggatgtaataccataaaccattaattctggatggatattcgctcatgctatgtagatgatgacgaaaaggaacactacaggtggttgcagcaagatgaagacagcttctagggaagaaactggaaggctaaggttgtgaatgattgtttggatagatcacaggataacgtacgagaggcaacaagtgcaaggtcaagctaggtgatggtatgagtgcttcatttgaagtaacttggcggatgagcgtggtttaagtgcaaggaactagtttagattacagtcgtacatgatactgcagtaaattccacgttacgatatgtgggaacttactcaggagcacgcagaatatctttattgtttttagagtgctggttccagcaacagatagaaatgctttaagttcactctggggaaagctggcctctgaaatcttaatgcaganntgggatgcagccatggaagaacctttacacggtttaaaagagaccatagattcataattctgtgagttctccacttcagtctcttcagcagagaacatggcttcattccacgtggtctctgaagggtcttcaatcaccccaaaggtcggataatatcattga

SEQ ID NO: 688051 - DNA, 165 bp, Homo sapiens
ccgggagctgccgacggacggagcgcccccgccccctgccggcttccggccgccgccgccatgcccttctccaacagccacaacgcagtgaagctgcgctacccggccgaggacgagttccccgacctgagcgcccacaatcagaccacatggccaaggtgctga

SEQ ID NO: 688052 - DNA, 280 bp, Homo sapiens
  misc_feature (117)..(118): n is a, c, g, or t
ctcttttaaccgtgtaaggtcttccatggctgcatcccaattctgcattaagatttcagatagaaatgctttaagttcactctggggaaagctggcctctgaaatcttaatgcaganntgggatgcagccatggaagaacctttacacggtttaaaagagaccatagattcataattctgtgagttctccacttcagtctcttcagcagagaacatggcttcattccacgtggtctctgaagggtcttcaatcaccccaaaggtcggataatatcattga

SEQ ID NO: 688053 - DNA, 144 bp, Homo sapiens
tttaatgccttatcagtagacactgccacacactcctcagaggatgtcgaacagatctgtctttgacttacgacccattttgcaacgacttaaagccggaggaacacattttcagattgttaaataagaggtctgattctgact

SEQ ID NO: 688054 - DNA, 155 bp, Homo sapiens
cacactgaaaatgcgggggcttttggtcccccccgcccccctggacctcctgatcccactgactctcccagcgctggttttgactttagcttcctgccccggccacctcaagagaaggctcacgattgtgtccgctactaccgggctgatgatgc

SEQ ID NO: 688055 - DNA, 373 bp, Homo sapiens
gagattaacaagtttcattttataattgagatcaaagcattggaatctgccctgtatagtacgccgtagcttcggtatttgtgttggatgtttcctgcagttacacttgccagccccactcacaatagttgttcatttcattgggtcactggctttatttgctagtcttgtctgtgaaccgagcctctgcctcagttttattacttgaaatcttggccggtgctttatagggaacatacattcggctatgtcacttgtactgattgtatatttctctagttaagaatgagggaatggggaggtttgctttctacaccagtgccttctgcatttgacttagaaatttttagtgtgggtcctccgtctagagagg

SEQ ID NO: 688056 - DNA, 134 bp, Homo sapiens
accggtactggcacccactcgactcacggactcacgcaccgttgcgcggccttctgctccgggtcgggacgtgccactgtgcttggcacacgttgacctcacggtgtgtgtgggggactcctctacgacgtcga

SEQ ID NO: 688057 - DNA, 256 bp, Homo sapiens
ttaccgcaggatgatggaagcgacgggccgtacaaagacagaagcgttggtttcactgagacagtgctgattctctcaaatagagcttgaaggataaatctttatttttgtatcaacaaaacttcgatacaaaatggaagaaaataatctacagtgcactagtgtgggtgatggtaattttgaagaagttcccagggagacggaaattcagtttaaacctacactatacagacagagggaccagatcggaaaaaat

SEQ ID NO: 688058 - DNA, 89 bp, Homo sapiens
  misc_feature (64)..(64): n is a, c, g, or t
actggatatgttatttaaagttacaaaagaggggagaaaaagaaaatcttgatggtcactctgntatgagcttaatggggttcaagcgg

SEQ ID NO: 688059 - DNA, 222 bp, Homo sapiens
cttgtcaaactgtggacttaaccccacttaagcgccctctagctctaagcttgcgtggtgtgatggggaagccaggctgagggttctccaggtggaggagatggggggcagccccagtgcatcccaaggtgagggacgggccgatttcccaagttcaggacataaaccatgagtagaagatgagctgattttgggagaacatgctggatcagcggatcgagt

SEQ ID NO: 688060 - DNA, 972 bp, Homo sapiens
cggacgcgtgggtcgatgccactctacccaggctgagctcattttccctgtcgtttccaggacacatttggccctcagcgcattctgcctcatgctctctggagcagaccgagagagattctctgagacatagaactttctttttttttttttgagacggagtctcgctgtgtcacccaggctggagtgcagtggtgccaatctcgatcactgcaaccatccgacctcccgggttcaagcgagttctcctgtctacagccctcccgagtaagttgggatatacaggcacgtgccaccaacaccctggctttacatatgcaatacacataaggggtattaaacaggtgcaaagatggggcgttccacacattgtgggtatcaaacgggggcatgcaaaacttcgtgaccatagagaaacacgacgtgactaggggccatcccagaagaggtccctggaagagtgacacagggtgtagacgccacagcaagagcacaagaggttgaacaaacagaacgaaagcatacacggaagacataaacgagtaacaaacagacccccgcagagcgaagagacagccacacagaacacgtagcaaaaccaccacagcgaaccaaagccaaagcagccaacaagagtagagagcgaaaacctaacgcagctggaaaaaccgagacacaggacagataaggacaggagcgacaaaagcgagaacacaccaccacacgcttaacaggaccgaaataaaataagagagacatagaacagaccaaaaacatagagagaagcggagaaacagtgataacaagtacacaacgtaaacaaagcgacgtcaagagatagcaagcaaaaaatacagtagaagcaatgagcagaaataagagcagcaacaaagaagtatacagaagaaaattcacaacacaaaaagggacagacagaaaagaacccgcaaagacaacgagcagactcacgac

SEQ ID NO: 688061 - DNA, 96 bp, Homo sapiens
aagacagcagcatatatctctgcagcgttgaagtcaccaggacgacttctaacccctacgagcagtacttcgggccgggcaccaggctcacggtca

SEQ ID NO: 688062 - DNA, 977 bp, Homo sapiens
  misc_feature (5)..(5): n is a, c, g, or t
  misc_feature (48)..(48): n is a, c, g, or t
  misc_feature (136)..(136): n is a, c, g, or t
  misc_feature (152)..(152): n is a, c, g, or t
  misc_feature (171)..(171): n is a, c, g, or t
  misc_feature (202)..(203): n is a, c, g, or t
  misc_feature (208)..(208): n is a, c, g, or t
  misc_feature (233)..(234): n is a, c, g, or t
  misc_feature (239)..(239): n is a, c, g, or t
  misc_feature (327)..(327): n is a, c, g, or t
  misc_feature (523)..(523): n is a, c, g, or t
  misc_feature (531)..(531): n is a, c, g, or t
cgagntaaagacaagccaaacggggattggggggggagtctcacagtncctttggaaggccccgaacttgcctttaatcttccctcacccaataaggtaattagtgcttggagagaatctgaatgttaggatgggnttccactgccccaaanggaaagatttttacccttnttttatatagatataagtgaagcaccccccnngtgcngaatatgtagtactgatatgccttnnaattncggaaattccaaacttgtactattttttttcccatgtagaaggcaggaatgtctcctaagctttcctggacagcagatgaatgagcgntagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttntgggaaanaaaaaaacaaaacaaacaaaaaaaacttgtgttgcgggcgcggccctggggccctggaaagaaaagttttttatagacccaatcgcgttggtgggcgccgcggggccccgagttgggtgttaggtgtgacaccggtgtggcccatagggggtatcccagaggaagacacccggggcccttgagacctagtgtggttggggatttcctcacccatttaaaaaagccgcccgggggagaaacccggacgctgtcccttggaaccaattcccagagatgggagtgtcgcgagaggggtccaataacgtggttctcctaatacaccacgagaggcccaaagagcagaggctcggaatattcaaaatttacggccccgctcgtcggggaaaaatgaagaacaaagagagacaaaacaacacacatactgcaagagaagaacacaacaaaaa

SEQ ID NO: 688063 - DNA, 387 bp, Homo sapiens
gactctaaggatcccttgtgggccttaccctgggacagctcgggacatttacaaacaatgtgaggagagggtttcctccgcagactgtgcagctgcagcccgggcccagctgatggctcaagacgctgtgcaaacacagaacacactgcactacctgctctgagcccatgacactgtgcacactcccaatcccccgcataaactggtctacgtgcttgtggacaccactcatgacagcaaccctgctcttgcattgaggaactgcgtgcgcacggaatgcaaacaacacataacacacacacaactcacacatactgcacacgcaactcacacacataatgcacaacactgcacacggagtcagaggtacatctagtactctgccga

SEQ ID NO: 688064 - DNA, 300 bp, Homo sapiens
attcgcggccgcgtcgaccactctttcaggccatattgaactcctgggctcaagtcatcctcccacctcagcctcttaagtagctgagactacaggcgcacaccattgagcccagctaattttgtatttctataaagacggtgtgtcactgtgttgcccagcctgatcttgaactcctgcactcacaacgattcacccacttacggcctgaccaagtgacgggattataggtgagccactgtacctgggccaggacatctctcttatgaaatatgacaccgtgcggcagcttacatctgt

SEQ ID NO: 688065 - DNA, 153 bp, Homo sapiens
cactatttactcttgagagttctgtaagctcactgcgactatcccttttattgcattctcctagttgttccttgttgtttccagtctcttccagactagacttggcacatggagattccgctcagaaagtgctcttcacacttctacctgctt

SEQ ID NO: 688066 - DNA, 1261 bp, Homo sapiens
  misc_feature (1)..(1): n is a, c, g, or t
nctatataagatgacgtagcaagattcttttggtgctttgctcctaactctgttcttttctgctacttattctttacttatatttgtcttcttcctctgtgtttactttttgctggtggttcttgccccccgctcccatcgtttttcctcttaagtattctcctcctttttagtgtagcacctttgtgggcttttttttttgccagcgcgctcactgttccttgttcgtcgtgtcccacccctatttgccttccccctttttgtgtccccagtattgtcttgtacccatggcctcaaatgggcgccttttcccccttatctagacttccaataggagtaatttaagatagaccattcaatatcttcttgtttaggctctttctttatttagtgagatctaagggattacccacagaaatgggttcagtctatcaccagctcccatggaattatctgggtcacccgattatggatgagagattctattcccgtggatcagaatccaactggtaccattgatcccctctggagcccttaagtgctcgcccaattggcaccaaaaagccccaggcttcgccagaataaacgcccaactttttttattgtgggaataatcaataaaggaccataatttttttctctccacgagttatagtgtgttatattgtctcttggccttgaagatttgagggagacactaaaataggggctcttggtgaaaaaagttaataagaaataccacacgtcactcaactctcactgaacatgtgtccctgtgtgggacacataagttaatttttcgcccacgttataagagtgagatatatatcgtaactccacgttggaagttgattctctccaagaagggtgcctcgcgtctcttttaaatgagaaatagagaaaatttatatagcttaatagtgtgttgttgccctccaaactctggcgtctttctggtgacacccaataccagtggtgtttgaatagttttgtggtggttcttgccataaaaatatctgaaatacaccaatatccgggtgatatctgtgtgtgcccaatagttagtatagtatagtaaaccatgatagtcaccagcccatttttttcataaatgtgagtaaaaataaaatagtatttttaaaaataatagtttgacgccaccgtataggtcccttttttgttccagacactttttcccaaaatctaaacataattaaaatactctttcagccacatgaataaataatgagtgtttcttgta

SEQ ID NO: 688067 - DNA, 365 bp, Homo sapiens
tacagagtgaatgtgacaagaccctgggtgaagcttcgcccgaggacgtcgaggtcggcgtgcccatccagcgtggcaagagcgggcccaagggcttgctgtcgatcctgatgagcaagcgcagcgagcccaacagcctgctgccggaaaacctgaacgacaacaaaatcatcaaccaattgatcgacctgcacgcccgcgacaaggacctgcgcgtggtgctggtgaccaaagacatcaatatgcgcctcaaggcacgagcgtgtgggatcgctgccgaggactacagcaccgaccaactggtcgacgacgtgtcgatgctctcgcgtggttatcacatgatgaccggctcgttctgggaccgt

SEQ ID NO: 688068 - DNA, 628 bp, Homo sapiens
tggtgactcacgacctttttctagatctcattgggttttctgaacttgggggacttactaatgccctggatggatttcaaccaatgaactttattcactcactaaaaaactattgacactcagatactatgataaggatcatccctaacatagtatccaacgctttaacggttaaactcttcacagcctataacccgacttacgacactaggaagatgaatcctcatatgactataaacattatccctcgttatccaagaaacctcttcataaagccaatatccctttactagcataatccgtcgcccaactttccgccttcttcctcattccacgatcagtccgatcaccctttataaacccgtactcgactgaaaccgcttaacttctatgtccgccgtttacgatatttggcctatctaccaacataaccttctaccctgacactaaaccctggcacactcaagggctatctctatgcgttactagatcctacatctcgccgtaatcccttaaatcacggcttacttcactcatgctttttttaagcttacttcacttagctcgttgaacaacttcagaattcttcaacttaccctactagaacaatctccgcagctcccatttc

SEQ ID NO: 688069 - DNA, 194 bp, Homo sapiens
tcagggacgcaaggactgtgtggaggcagccgagaaacgcattcaggagatcattgaggacctggaagctcaggtgacattagaatgtgctataccccaggaaattccatcgagtctgtcatggtgccccaaacggttccagcaatccagacagattactcagggatttcatgtgttcaagattaaacttccca

SEQ ID NO: 688070 - DNA, 817 bp, Homo sapiens
  misc_feature (39)..(39): n is a, c, g, or t
  misc_feature (118)..(119): n is a, c, g, or t
  misc_feature (210)..(210): n is a, c, g, or t
  misc_feature (250)..(251): n is a, c, g, or t
  misc_feature (254)..(254): n is a, c, g, or t
  misc_feature (268)..(268): n is a, c, g, or t
  misc_feature (277)..(278): n is a, c, g, or t
  misc_feature (322)..(323): n is a, c, g, or t
  misc_feature (335)..(335): n is a, c, g, or t
  misc_feature (348)..(348): n is a, c, g, or t
  misc_feature (354)..(354): n is a, c, g, or t
  misc_feature (375)..(375): n is a, c, g, or t
  misc_feature (380)..(380): n is a, c, g, or t
  misc_feature (390)..(390): n is a, c, g, or t
  misc_feature (403)..(403): n is a, c, g, or t
  misc_feature (442)..(442): n is a, c, g, or t
  misc_feature (445)..(445): n is a, c, g, or t
  misc_feature (504)..(504): n is a, c, g, or t
  misc_feature (511)..(511): n is a, c, g, or t
  misc_feature (613)..(613): n is a, c, g, or t
  misc_feature (678)..(678): n is a, c, g, or t
  misc_feature (715)..(715): n is a, c, g, or t
  misc_feature (813)..(813): n is a, c, g, or t
ccttcaggggttgggagttgggggggcacgccttccaanctgcgataggtacttatggtgggtatctggtgattcttagttggcccaaatgccctgcctagcccccttacctgcgtcnnttcccagatggggtgttttgttgttggtgttgttagtaggcggggttgccttaccctgggggagaaagaccagcttgagtgaaagtccgcngtgtttttgattttgtttgtatgtgtgttttaatgccacnnccngctccccgtttccnagtgggaanntattcagtagcatcatgtacttgtactataggtaagggcttaanntgaccatcctcnatcctggcctccncaaatnagccacctggcacattacttnattcnttccctcaanagaacttacactnggggcttccgccccctttatggggggcggtttcccggcngcntggaccattcggatttgggtttgtgttccgcactttcgcaggttccactttttgcttcngccccgnttgggctccggtgcgggcttctcatccatccctttctaaagccaaagcacatttgtagcacataatccaggagaagcagaagtaaatgctatgactggtggnatttcttagcctggttttgtagtttttaggcagtaagtagattatgagcgaacaaatgtgaaggntcatgtggagtcataatacctgtgatctaggtatggncttggtcaagctcagagacaacaaagccttctaggtcattaggcaatggtgggtttctagcaccatagactgtctactgacctcatttttcttttggnatgg

SEQ ID NO: 688071 - DNA, 140 bp, Homo sapiens
gtaacttgcggcgtaatctctaccaccctgctcactaacaccctagatctccgtccaggtatagaaaacacctattccgggtagtctaggctccacgttaagcaaacaccactttccgtgttcaccgacatacatagtta

SEQ ID NO: 688072 - DNA, 215 bp, Homo sapiens
cgcggcggggacaagagaagtcgaagatggactgccactggtggcataggtggcaccatttacgagtacggagaccctcatccattgatgtgggtaggagtacatcccctttcaaagcagtatgctggcaaagtacgtcctctcttgtcaacgtggccagtctactgatggcctgacggtgccagtacattgtaactgaatgcactacaggcaag

SEQ ID NO: 688073 - DNA, 193 bp, Homo sapiens
  misc_feature (153)..(153): n is a, c, g, or t
atgtactgactctgctccaggtctgagatttctgctctgcttagctctgagtgagatacaggctccgcacacactcggtaattttgtatttagtagagatgaggttcacatgttggcaggctggtctcaatctcttgacctcaggtgatccanccgcctcagcctcccagagtgctgagagcagcattcttga

SEQ ID NO: 688074 - DNA, 835 bp, Homo sapiens
ggggaaaagcaagccaggatggtgcttgtcgggtcgctttctagtagttctccacgtgcgctgcccgggcggctggcactaacgcggtcctgcagtgctgtgcgctacgtgttgctccgtgagcttggtggcagccgctgatatggagagtcctgatgtggcgaagatgggcgtagagggacgacccacgctggactccgttggaggagctgcggcgttacagccaacaagtgtcagagtaacctgggacgtgggagcggagagaggatgcttcgagatacttcgtgtcctagcgggataacggtgaaagaggacatggttgctgtgggcgaagctgcagggtttcaagagattgagacgatacggtgaacgatgtagaagtgtggacgggaaagatgacggtaaatggatgtgtactgggaagaaggaaataccagtttagggcaagtacgtcaagaggggagagacttaatcttgtcttcttatgagattggaaggcggtcgaagacgtagaaccttgggaacaggggtagctttctaaaagatcaagggaaggtaccaaggtaccagaaagggcagcgatgggtgagcaggaattcacacgcaagaattatttggtccttggaattgaacacaccagcaaaggccagattggggaagtatgaaaatggtggtgaaggaacatttaaaggttggattggaaggccgcgatatggagcacggaaacgagagcaagtagaggggccggtggcacacgaggcgagacaaatatactgccaggattgtggaccgtttcaaaagttcggagacggggggaaagaaaagaggtgggatg

SEQ ID NO: 688075 - DNA, 411 bp, Homo sapiens
gtcataatggtcgatccctttgcttcggacgggcaaggctttgcatatgacctggggtcacgagttcaagaccagggtgaccagcacgggagaagccctgatcctatactgagaatccacatcactagttaggagtcagtggcacatgcctgtagtccgaggcactcctgaggttacggcagctgaatcacttaaacccgaggaggcacatgttgcaggtgagccaagatctgccactgactctacgctgcactgcacattgagactccatctctaatgagactccatctctattcggccaggattatgcgctcagttggcaatttgagcctattgggagattgatcacaattcactggcgcgtgacatacaactggccgacgtggaacacccgtcgcgttgcctctggct

SEQ ID NO: 688076 - DNA, 486 bp, Homo sapiens
ggagaaggtcccggagagctgagcagttcaagatgtgtgacattcaccgaagaccagaccgcagagatgaatgtgaaggtgctgtgactttgagcactttctgccgcatgctgcagacagtggtccaagaacaaggaccaaggcatctatgaggattatgtcgaaggacttcgggatgatttgacagaggtaaggagaatggacaccgtgtcatggagctgcgtgaagatcgcgagcatgtttctttggtcacactgggtgagaagatgacagaggaagaaggtagagatgctgttggcaagggaatgaggacagccaaaagagatcgtctctaacgtaatgacaacgcttagatgacggcctagtccatgtcggaagatgaagaggaacccaagggggcgagagacattcgatacagcagtggacatgcagcaatgagacgaggaaccgttccacaacatctaacaccaaaaccaacgccaaaca

SEQ ID NO: 688077 - DNA, 802 bp, Homo sapiens
cgtgttcccctttgcgccgcccctacctcccctttcggtcagtcggcaaattggtcaccttccctcccttgtaaagtcaccataatcacccttttgcttcgcgccaattcctcgctcttatttctcgcgcggtcggcatatcggtcttttaaccactacggggtggatatcttttcgggcacgaaaagtccaactcgtcaaatctttcgggggcggctccccaccctaccgtgtgtcagtagcacctttctccttagtacatccgggcccaaatgtgcccccctttgccaagccgcctttgaccttgctaaggaactcctttttcccggcttggttcttcaacccaacgccttcccccattttggcgatcaaaatctctcccaattgattccttctcgtgaatcaactcactggcgtcaggaacgcgcccctatgggtacggatgcccggatagtacaagctgctgttagctgacacgagggcaggcacctggtctcacgagtcgacctagatcactaccgcgtgatctcagggacgggcatgcaagacgatgacaccgctctaacgctcgaggcctttggtgtgtgacttctgactctcttcttgttagaaaaagctcctctgctagcaataactgagtctaattcttctcactcctgctcgcaaggcgctgggactcgtgggtgcggatactgggattatgggccacgggattcttcccctaaatttgtcccccctggtactctccctctagttgtcttctctcgcttagactccatccagacctgaaccagctttgtgt

SEQ ID NO: 688078 - DNA, 159 bp, Homo sapiens
agaataagtggttcctacatatttcaatgaacggatgaatttaggcagtttaccgaagtgcctgtgacagcaccagtcacaggcacttttgtgtgcgcgatgaaatgagacgagaacgagtagtgatacattgtggtgtctaaaacagcatgaatcaga

SEQ ID NO: 688079 - DNA, 1504 bp, Homo sapiens
  misc_feature (772)..(772): n is a, c, g, or t
aatggttgtgtctatgcgtgggtggtcgcacgccgccgcatcgtttgggtacgtctgtgtacatcgcttgtgttggctggcccgggcgtgcatggcttcacgtgtgtgagccggagggttgtctcgctctcggtacgcacctgtggtgtgcttgctgaggacagggcctgttgtgtgacgttggggtagctacccttttctttggccgctgggttgttttggtcgctgttcttgtttcggtagagccccgcggaagaccgtccttttgtgtgtggatcctcgttgtcttggtgtagcgctcgtgggatgccgctttccacgcctggcgcgtctgtctcctctccggactttcgtggtctgcggactctccagaggggtcgcgcaccggcctgtgtgtccccgtgtggaagcggaacacttgttcgtggggcgccggcgacacctcttttatggggaaacggcaagggggactctgtggtgggtgctctgtccccgaaggcgccgtgtgtgtggtctcccggagttgttgcgtcgcctgtggggcgccgcttacccaggatgcacccgcgccttctctgtgtggtggttgcttccagaacggttgtgtgaagagaaccctaccactgtgtaaaatggactgaggtgttatttgtttacctggtgattctgttaagcgcgctgttaatgttgtgtaaaaaatgtgaataaggcgaaagagaagaacaatgcctttgttaggcagtgccgctaacgtgttcttccgcccccagcncccctcgtgtccctccccccccggagtagtagataattaaatgggggtaatatttttttaagaagcactatggtgctcgcccctccgggtgcaccgcccccagggcttttgagagttccaccgttgggttaacgaatcaacagggtgcacacgcccccccaccacattctgggctataattttttaaagaaaatgtagattttctaaggggacccacgggttctcccgctcgtggttgcccccacggggtttgtgttctttgagagctctcctcgagccctctcacagtggagtcctcccctcgttctctcaggcgctgcgcccacaagttggtgtaccacagcacttctatagccactggtggtgttaaaatccggtaagaacttgagggcccgggttgccagtggctcaccaccctataaatgcccccccctctttgggaaggccacaaggcacaggccgagtttgcttgaagctccacaggaggtttccgaagagccacgctttggcgcagggtggtgaaaaccccgctctctaccacgagaatacccacaaacttatgctgggcctggtggctcaccacacttgggtagtcccacgctaacttgggaggcctgaaggtgggaaggaattgtttggaagccctatgaagggccggaggtttctgtgagaccgagatcaccacccctgcactcccagcctgggccaccgagggaggagaccctgtttcca

SEQ ID NO: 688080 - DNA, 290 bp, Homo sapiens
  misc_feature (5)..(5): n is a, c, g, or t
  misc_feature (11)..(11): n is a, c, g, or t
  misc_feature (18)..(18): n is a, c, g, or t
gtatnagcctnaggcacnctagaggattccccgactgtggtgtaccgtcgtactgtggtgttaccgtcgtactgtggtgttaccgtcgtactgtggtgttaccgtcgtactgtggtgttaccgtcgtactgtggtgttaccgtcgtactgtggtgttaccgtcgtactgtggtgttaccgtcgtactgtggtgttaccgtcgtactgtggtgttaccgtcgtactgtggtgttaccgtcgtactgtggtgttaccgtcgtactgtggtgttaccgtgtgaatgagggatt

SEQ ID NO: 688081 - DNA, 1272 bp, Homo sapiens
ggatctggtttcatggtgtcagatctggccctagcatgggtaaagccctttgtgtcagccgtactcccaaaggtatggctggcagtagcaatgcttagcaaggatggcatctgatagaatactcttctgtcgaactctgatctttaacggttatcagacgatggcatccaacgtcttaatacaaggtgaatgaacagtgatcatgcgaggctagtctcgggattggataaagatctagctgagtcagatagaagacgcatgtgacgtggtgacgagattgcgcgggtattaaagcctcatcgtacggcagcctcgactggggattcttacccaccgtgcgtgtaccaggttttagacttaggctggctgggaaatcgggtactactccttcgttgggttgctgacaagatagaagattgccaaacaaggcgctagggtcgagcagggtgaatcgtttttcccttcagctaggcccttttaccattgaggtcgcgaattcctaaggagaatcctcgagcgaagcctaatcggtaccatccttggaaatctggtttcaaatggtccactattttggtacctttggtgctttccatcattgtaagtcctaaatctccaaccgatggtccaagggaatacaattgaactttgagttgattgctgggttggaattccttattttcggaggggcaaaattggtgtctccggtgtttcaatctcatggatctgtgtttgacacagaaaggtcatgtgggcggggcaaatttccaggaattttcatagggaactagaattgcgatgtttgtgcaagggaggaaaacgcgaggaggagaggcctttgggggggggggttgtcacatggaagaattgacttcctaaacaaaaatttttgttcccaccaaaatgggcccaacaggttaagagggagcaatgacatacttccgacagcaactttggtcgcgccccagaggcttgaaacttgcggccgttacttgggtgcccctggtgactcatttccccaattaattgggattgggcctcgtggcaactacttattttttatcgccaaagttctacacgcggttccacacaggggttgtccatagcccattcttggagggagattatacagaaagacttcattttaacgacacttttcgccaggcagccgttcaaaaacacacaaaggtcttcatttttgtcttggcgcaggactttgccaccttcgtcgcgttctctcaagcacaacggctttccaagagggaaacaccttaa

SEQ ID NO: 688082 - DNA, 225 bp, Homo sapiens
  misc_feature (34)..(34): n is a, c, g, or t
  misc_feature (80)..(80): n is a, c, g, or t
  misc_feature (107)..(107): n is a, c, g, or t
  misc_feature (149)..(149): n is a, c, g, or t
caactgtcaagatcgtcctgaaggagaaacatangaaagcctgtgtgcatggcgggaagacgtactcccacggggaggtngtggcacccggccttccgtgccttcgncccttgccctgcatcctatgcacctgtgaggatggccgccangacttgccagcgtgtgacctgtcccaccgagtaccccctgcccgtcacccccgagaaaagtggcctgggaagtgct

SEQ ID NO: 688083 - DNA, 110 bp, Homo sapiens
ctgcgtaccctttattcagcgacgctggagtcgcatcataatccgtctctcaatggatgcaaactctacgtcccactaagtagctgttttgatagactatctagtcaagc

SEQ ID NO: 688084 - DNA, 108 bp, Homo sapiens
  misc_feature (41)..(41): n is a, c, g, or t
  misc_feature (74)..(74): n is a, c, g, or t
gatcaacctgtggctgttttcccgtctaggttctcacaggnatctcctgacagaggtacttaacaatggctctnctggaaatttctataaataaaatgtccaaaatgg

SEQ ID NO: 688085 - DNA, 303 bp, Homo sapiens
cgtgaaaaagcggttttgccgggccaggtcctgccagggacccttggaacagtggggtgggttctccctatgttgcttaagctggtttagaactcaagccagtttttcacttcagccttttgagttgttgggattacaaaagcccccatgtccaactgctgattttgaacttctggggtcaagtgatcctcccccctcggcctcccaatgtgttgggattacaggggtgagttgcggcgcccagctgatatgtatacttttttataggtatattacccttcaataaaaagtttgaaacagaca

SEQ ID NO: 688086 - DNA, 336 bp, Homo sapiens
actgtcacagtcacgtgacagggtgaagcctcaggccctggctgggtacacagcctctcctctgacgccccccagtcagaaccagctctgctctaaagcacaagcccagcacctcaggacctccgttagccctgatgctgccctgatatctacaaacccgccgcagcccctcgacaagtcatggacccaaccgtatctccctctcgtggatcgccctattcgcacatccctgaccttgcctggttatgggttcagtggtcatgcaaaaggttttcgtgtacacagctccgctagtcaacatcatttcaggcttcgccaaccccccagtcctctgtc

SEQ ID NO: 688087 - DNA, 287 bp, Homo sapiens
  misc_feature (30)..(30): n is a, c, g, or t
  misc_feature (66)..(66): n is a, c, g, or t
  misc_feature (137)..(137): n is a, c, g, or t
  misc_feature (156)..(156): n is a, c, g, or t
  misc_feature (187)..(187): n is a, c, g, or t
  misc_feature (236)..(236): n is a, c, g, or t
agacagcctgtagaatggggaaactatttncaaactctgcatctgacaaaggtccaatatccagantctacaaagtacttaaacaattagacaagcaagaagaaaaaacccaattaaaaaatgtgcaaagacatgancaggcacttttcaaaagangacatacaagtggccaacaaacgtgaaaaantgctcaatatcactaatcatcagataagtgcaaatcaaaactgcaatgngttaccatctcttaccagtcacaaagttggagatggtgggtgaggctgcag

SEQ ID NO: 688088 - DNA, 305 bp, Homo sapiens
gggtcccgggggacccagcctgggacgacctgcgtgctgatcgtgatcgtttcaccgtgcgccgtgcgtccctctgtgtggctgtaacttcacgtgtactttaccctcgagctgaagcagatgcaggacaagtactccaaaagtggcattgcttgtttcttaacagaagatgacagttattcgggaccccaatgacgaagagagtatgaacagcccctgtcgggcgagtccagtggcaactccgtgcagctcgctctggaaggattattttgagaacctctagagtcgatctctactagagtcga

SEQ ID NO: 688089 - DNA, 178 bp, Homo sapiens
taacagcgcatcacatcaatgactggacgtgggctacgatgagatatgggaattggatgtgcctgtcctcacttccgcgaccccctcgtgaatccctgccaccctgacgactcccaaaccgccgattgatggtgtgttgcgctggtacgggtagatagtgcagactctcgctgtcata

SEQ ID NO: 688090 - DNA, 197 bp, Homo sapiens
  misc_feature (173)..(173): n is a, c, g, or t
aatagaaatttctccaccagatatcctaaattatctctctcaagttcgaagttccacaaatctctagggcaggggcaatatgccaccagtctctttgctaaagtgtaacaatgaatcacgttgtgctccagttgcccaagcaagtttcccctatctccattctgagtaccacnccttcctctttcgaggggtaccga

SEQ ID NO: 688091 - DNA, 1342 bp, Homo sapiens
tggggtaaaaatggggggtctcgctattgttgggccaggcggggtctcaaattcctgggcctcaacgatcgtcctggtttcgggctctcccaaagtgtggccggggtatgagacagggctatgtgacgccaccggggctctgggccctctttctttgtggatatggggctctctcttgggtgttcccggtttcatatggccccgtggctatctttttgggggagccccaagggtgtggtacctgtgtgtgaggtattgagattcctctttttttcccctcttttctttttaacctctaatattaaaggtctgtgccattgggaagagccccgcctagggaaaaacaccccgggagggtgagattatcccgaacccgaaaaagaacgggaagtgtgggtgtgtggcggggggtcccccaaacccagaggtggtgggtgtgtccacggggcctatcaagacagatgtccattactcggggtgggggggtggaaccccaatttgtgggggaaacactatgggggaccccctggtggcctcccctcggagacgccacaagaaacgggtggggccactggagactgtacacgaaaaagctctgtggggtttcaccacacaaaaatgtctcttcacgagggggagcaggagatgagagggctctcttatatcccgagggtccttttggcgaaagaaaacccggggtaaacctgtcgtggggggtcctcacaaaaaagtctggggaaaaccagagagcacaggtccctcctcctagcgaccgtgtggcccggtgaaaagggaaccaaacaacgctttggggaagggggggtctaaaaaaggccgctaaaaggggcaaagtcaaaccccgcgggtgtgtcgccccaggtgttgtgtggtcggactccctgcaagaggcaaaacccgccccccgcggctctggcctcaaagcaagagtacacacgtgtgaaaaaacacagaaaaaaacccataccagggggactccaaaggttccaaaccttaccccaccacgggggagaggaggggacacatctgcggactacacccctggtggcccggcgaaacaaaaacccggggtgtcagaggacgaaccatacaacccgggggtgcaacaaacacaccgtgggactaaccgaagggggaggaaacatcccccgcacaagacgcgtattagttctcacccaccacacatcttccccggtcgtagaaaactaggaggagcccaacaggtgtatgatgcacccgggtgatacacatgagagcaacacaacacaaggcgtcctgcccacaacaacacaaaaaacacacaacctacgctgggcagggccgt

SEQ ID NO: 688092 - DNA, 522 bp, Homo sapiens
  misc_feature (15)..(15): n is a, c, g, or t
  misc_feature (91)..(93): n is a, c, g, or t
  misc_feature (209)..(209): n is a, c, g, or t
  misc_feature (243)..(243): n is a, c, g, or t
  misc_feature (264)..(264): n is a, c, g, or t
  misc_feature (322)..(322): n is a, c, g, or t
  misc_feature (335)..(335): n is a, c, g, or t
  misc_feature (347)..(347): n is a, c, g, or t
  misc_feature (522)..(522): n is a, c, g, or t
agaagaacaaacagntagtgggtgccgaggggtgaagggcagaaacaacgaaaaaacgcctgctgcgtagcatggagctgaaggtcagcgnnngcaacgcccatcgaaccaaataccacaactccgcgacaagcaggaaacaaccccagcaagggagaccacagcagcaacaacccacgaaaaacgccaagacccattgccaatcacanttagcaaccaaaggagtcaactctaaacaaaaanagacgaaaaaaaaaaagcaanccgacaagacagcaacgagaagctttacgtagcggctagtggcaaactcattggaaanaacgggataaaanagcggaaatcgnacttcagcagccaaaaaaaaaaacaaccaaggagactcaaaggaaccggaatggaacccaacaaagcttagcgaaaggaaacgccgcgcaaaccaaaactcagccaagaaaaaaaaagcccgcgcgaatcgatagagcaaaccaacaaggaaaccaaagaggccgcagccacacn

SEQ ID NO: 688093 - DNA, 410 bp, Homo sapiens
  misc_feature (52)..(52): n is a, c, g, or t
ctaccaggtgagaaaatatctgtaaaacaaacccctgtgatctgtgactacncatgttacaggctgaataatataatctggtagactaatttacacaggcttccaaaattacaaaaagtccaaggaaaattacctgtttctgtatgtgtgtataaaatgaattgtatatctggtatgtattattaagctttctttatattgaagttatagtttatgcttggacaaaccaactacatgcttgtgaaattttctgacaaatgtctgaaagaacaatgaacaggaaggagtatattactacccaaatagactaaaaatacagctcttaagctgtttaattcttttaaatagctacaccattgaggcaaaaatagtaactggaatttaaggctgacaaatccaataaatagcag

SEQ ID NO: 688094 - DNA, 190 bp, Homo sapiens
  misc_feature (190)..(190): n is a, c, g, or t
ggttttccctgtacttgagtttcccctggtcttggctggcgggctgctgtttgaagcgttagtgtgctgagggtggggagctgcccagcctctgttgtcctcttccatgtcaggttctcccagcaggctgagctgagccggagccgggtgcatgccattggtgagaaggtctccttggtccagtgccagn

SEQ ID NO: 688095 - DNA, 214 bp, Homo sapiens
  misc_feature (7)..(7): n is a, c, g, or t
  misc_feature (44)..(44): n is a, c, g, or t
tacgagnttagaggatcgcagttctggtccccactcctactgtntggtctatgatgagcccatcaaaggcattttgcatctctgttagtcttttttgattctaacctgtgctttttttttttttttttttttttttttttttttttttttttttttttttttttttttttttttttttttaaccaagaaaaacccgggggggaggggggggggg

SEQ ID NO: 688096 - DNA, 208 bp, Homo sapiens
tcagatatattatagccctctctgaagatcctgattggctgtcagcacccacctcaaaagccaaaacagactctatcaatatcctagcggacgtcttgcctgacgagatgcccaccacagtgtagcaaagcatgaagctaggggtggatgtaaatccgccacggagaggtcattgttcaggccatttctgccgagtccgctgcattgt

SEQ ID NO: 688097 - DNA, 197 bp, Homo sapiens
gttgaacaggacttaaacgaatcatcagggcccggatattttttatttttcatttggatttttacccttgaatccaaagtgtttgcaatggccaccaattgaaggagtggcaaacttacttgtattgagagcccacccaattcctactggtgaaattactgtttttgtttttaataaaataaaagggattcccaata

SEQ ID NO: 688098 - DNA, 330 bp, Homo sapiens
  misc_feature (41)..(41): n is a, c, g, or t
  misc_feature (47)..(47): n is a, c, g, or t
  misc_feature (169)..(169): n is a, c, g, or t
  misc_feature (184)..(184): n is a, c, g, or t
  misc_feature (256)..(256): n is a, c, g, or t
aggtggctttgccttgtctatacatggcccagagagaaaanaggaanagggctgggcgcgggtgctcacgcctgtggtcccagtactttgggaggccgaggtgggaggatcacctgaggtcagtagttgagaccagcctggccaacatggcaaaatcccgtctctactnaaaatacaaaaattncctgggcgtggtggtgggcatctgtaatcccagctactccagaggctgaggcgggagaatggcttgaacccnggaggcataggctgcagtgagccgagatcatcccatggcactctagcctaagggatagagtgagactctgtctc

SEQ ID NO: 688099 - DNA, 255 bp, Homo sapiens
gagtaaccagctattctcacgagacctcgctatgcgaccgagacaattattccctagcgaaccccgttaatgtacccctcaccacatttaagcccgacataacatttcctattcgcctacacaattctccgactccgacccttacaaactaggaggcgttcttcccctatgactatccatcctcatcctagcaattatccccatcctcgatacattccaactacaaagcataatacgttgtcccggcaaatcgaa

SEQ ID NO: 688100 - DNA, 621 bp, Homo sapiens
tacctctctgactgtcagggtcacttacatggatcgaagtccctgttacggctaccagtgcacgtcagaggagcacgacaaggcacatcacactgcttatctcgagttctccccaagcaagagcttagtgcaccttgagcccatgtctaatgaactaccctgtggccttactcagacagagcaggcgcattatatgctgaatggaggcaccctgctggtgctgaagaagctctacttctattatctgatcatggcaaagggaggcattgcccgaactgcacctcatggactgttcgtgaagcatgtagacatgaaggtgcatgctgtcatctcaatccatgtgaagacagacattgctcctggcgatagagtgctcatgtatgctgctttacctaccggggacgaccttggggattctgcataacatgaggttgtgacagccttacacgcatacctgcgagttacagcggcttgttaatccgtctgaagcctccgtgccgcggaccaaagcatgctgctcatgaagcctcatgctgagctctcagctgctgggctacctgatgccagataggacctcactgcctcactgaggctttgaagaccaggacgataagactggtc

SEQ ID NO: 688101 - DNA, 507 bp, Homo sapiens
agcgggacgtggaaggggccttgaacactacactaaaggaacggggagtaagaggggagcccatgaaggtttctaggaaggtgagtaacatgatctgatagaagaagatccatctgttggtgataaactgcatcatcggcggcaaggtgaaaaggcaatcacccaacagaaaagggcagtggattgggtaactaaaatatcggaaggtgcacggtcacagtgctatcgcaattaaggggaaggagattaagtatcagttgagtatcgcttaaccaagatgtaggggagtagaagtgttttagatttcaaatttgatcagattggggaatatgtgcagatataaaattatctggggtataggacccaagtctaaacattaaattcatttatatataatatacatcttatatacatagccggaaggaaattttacctttctctaagggacagggaatcaatgctatgtggcatgattgcatttggactgcatgtggaggacaggagtgg

SEQ ID NO: 688102 - DNA, 256 bp, Homo sapiens
catctcaccgcgcctcttgacttcgacagcgacatagaccccgtcggcatcgcgacaaagcaggtcaaccggaccgataggcgtcatgtactcacgacggaccaacgaccagccatcgccgaaagtattaggattctcagccagtaattcctggagatgagcctctaccccatctttctgcaggcccggatcaatacccaattcctcggtgacatcaagcaccttcggtcccagcaggatttggagatggtcgccg

SEQ ID NO: 688103 - DNA, 215 bp, Homo sapiens
tcccttcatagaggccacggaggctaaaagcgcagatgaggcaagatgagattggcccacatagatggagatcatctgacacggctgaacgtctaccaggcttttaaacaaagtaagtgtaacttggatgggagacactctggtctaaatgtcactggcagtgtataagatgtttcttggtcccacttggatttataatccgtggcctctatgaa

SEQ ID NO: 688104 - DNA, 119 bp, Homo sapiens
tgagcatgtgctgttggaaaagtggaacagatagacttgctggagacagggttgccacaaagtttcaatttgtaaaaaatgtgatatatatgaaatgcaataaagtaaagtccaataaa

SEQ ID NO: 688105 - DNA, 105 bp, Homo sapiens
tgtacagagtacagatacacacagtactgactgtagtacactgcagtgcaacgcggagcagcagcgtccagtagcacatgtacactgcagcagctgtgacagccg

SEQ ID NO: 688106 - DNA, 181 bp, Homo sapiens
acggggccatcatgttggcaggctgatctcaaactcctgacctcaggtgatccacccaccttgcctcccaaagtgtgggatagcaggtgtgagctactgcgcccagccaaatgttctgcatttgaatagtgctgactggtttacacacagcgtgtacatactgtcacaccgtgtacacttt

SEQ ID NO: 688107 - DNA, 101 bp, Homo sapiens
aagacttatcagaggttctgagaggacttgtaatgaactatccacatatgacaaatcttatcaatctgggacagagcactgaatatcgtcacatttggtcc

SEQ ID NO: 688108 - DNA, 294 bp, Homo sapiens
cacgagggatcgccgcgaacatggacagcacgacgacggggccgaaggcgatcgccgccggcccggcctctatggtggccaggccacggaaattgacgagtgacaccagtatcgtgatgacgtagatgtcgagcatggaccagcggtcgacgaattcgacgatgcggtagcacccgggtgcgctgcatgacgctgcgccaccagcggagctgcagcgtcacggtatcaccacgcgaacgtctatgatcttcaacagcggtaccatgctgctggctaagaagaccaccgccgaca

SEQ ID NO: 688109 - DNA, 1146 bp, Homo sapiens
tacacgactgaggttttaactccagtttatacaaatgacaaatccaaagtcaggggcatagggcagggaccaattgccgtacctgttgacagaatcttaggacagaaaaccccacaggtgtggcacagaattggagtgctgagtagagtccctaagggagatgcccattcttcagccacctcccgtggacagatcagccatgaggacaccaaatggctgctccagttcaagtgaaatgggacacttatattggaggctccagggccacggggcctggcgcaggagcgttgcccttcaagggaaagaacaaccttattggaccttcttctggggacgcaggtagtcggtagtgaccaaacttcatatcattgcggcagtgtgcccagcaccgagggtcaaggcagaagacatagcacttgcggaagcactcactctgatgtcgcagaaggtatatgctgggcaacgctgcgtggacacaaaaaggctcaataagtgccacctcgcaggcgacaaacacccaggttgcatgggttgtgagacatcatatacatggagaaatgtcagatcagcctgtaagagaagtgtggcgggaccaacatcacatcacaagcatgatattgcccgtgccaaaatataatcacgaccggcgtttcgttggctaccaggttgtggacataaccccttaccagtaggtacttagaaatttgggggcatttagaacaatttccctcaaaatgtgagtgtaccaccatgggggatttcggagcaccctaaacgaggtgatagaatgagggaaatatgtgtgcccaaaaataaaaggggacttcattcacacacgacagagattctagtgacatagtgttagtaggcgaatgacagctccacctgcgacaacatctatgtgagtgacattacaggacatagaattcctcgcaccggtaccgaagattttactacctaggacctgggtatgaacaaatggtgtaaatacaaaatgaataattcggtccgggacacgttgtggatcctatttgcacaaatgtgaggtccctgctacagtattgtttgccaacagcaatggataatgaaactgtgacgtaacagaaggtctctccccgaaaagacggtgtatacaaccaataccaa

SEQ ID NO: 688110 - DNA, 440 bp, Homo sapiens
gaggggtgagtgagtcaggagtgagtgagtcggtgagtgaggggtgaagggtgagtgagtcagtgagtgagggatgagtgaggggtgagtgagtcagtgagtgaggggtgagtgagtcggtgactgaggcagtgactgcggcggtgagtgaatgcaaaggcctgggagatgactgtacactatggtagactttctcaatactgcacagaggctacactaaatcgattaaaaaaaattgtactacgatgttacaatggctacaatgtcactaggtgacaggactctctcagctccattataatcttacgggactaccatggtgtatgtggtctgtcattgaccaaaacatcatcatgtagcacacggctggatctgatatttcatgtctactttgcaaccaaaaataacgagacatgctaaaaggcaaaaaaaaaaatctg

SEQ ID NO: 688111 - DNA, 181 bp, Homo sapiens
agtaaggaattcagaatccatgatattttggccaatgcagagggtcttctctgagctatagcccatgctctccctgtgtgtgcttttaattacgtcttctcgtcaacttctaaatcacgtcaaagaatcagctcaagatttcttatcaaattttcgggtagtgacagatgggtagtcaccg

SEQ ID NO: 688112 - DNA, 673 bp, Homo sapiens
tcatgccagtaatcccagcactttgggagtgtttgaggcaggcggatcacaaggtcaggagtttgagaccagcctggccaatatggtgaaaccctgtctctactaaaaatacaattagcctggtgtggtggcgggcacctgtagtcccagctactcatgaggctgacgcacgagaactgctcgaacccaagaggccgagcttgcagtgagccgttttcacgccactgccctccagctgggtgatacatcacgaattcccttcacataataccagacctgtttcttatggacccctcaattccaatctgcacaccatggcactccccttcccccctctcccctcacgtgcttcctcctcacactttacccgatcctcacctaccctcacgctccgctcatcatcttattctcttctctccgacctgcgtctctcgtacttatcccaggcccctgcctatcacgtctctcaatgctcctgtctatctctccatccaccgcttctgcctccccctaccacccagcgagcttcactctctcacaactcgctttacctccaccatcccacatcttctctactatctctatccatactccaccatatcatctccgcatctcctcgccatctctcaccctactcctgtatcacatctaccgttctctcgcattcctcccc

SEQ ID NO: 688113 - DNA, 471 bp, Homo sapiens
atttagcgagccaaggtgtgtatcagaataatacacatttggttttgctttatccaaaaaggaagttggataaaaacttactaaaagccacttgacgtaacaattggcatccaagagatgttcacacatttatccgaagaatattgagcactacttcctgcgcagctgattctaattaagtggaatgcaactttgacaacgtattatgccccagtcagctaccggtcatttgaaacaaggcttaactgacacgtgatagtaatcataaaaagctgcgggatatttctcacatttagatgcttgcatatctttcaagccaaggagccatgaggggcaaacgggtggattcagagatttgaaaacactcatattgcagacctggggtcaatattacctgcaaggggatcttggcactcccaactattatgtggtgacaattatatgactcaaaaaacataatatacaggcgtg

SEQ ID NO: 688114 - DNA, 323 bp, Homo sapiens
ctaacgacccatagtacgcttctctattctcatcgggccgagggacaccctagaacatatgagaagggtgcatgccagattatgatccggggtgaagggtctgtgaaagaaggtgaggttgggccggaagattgccagatgttgcccggagaagatgaggcacttcatgccctgtgttactgccaatacaatggtgaacgtccaaaaggccgtggcacagattagaaacatcctgaagcagggtatcgagattcccagaggaccagaatgatctacggaagatgcagcttcgggagttggctcgcttaaatgggacccttcgg

SEQ ID NO: 688115 - DNA, 170 bp, Homo sapiens
  misc_feature (5)..(5): n is a, c, g, or t
gttanggctcactccaggtcctgttgccttttctggccccctacactctagttacagcactgtcttctgaagccaatactctgtccacaaatggaattcaccgctggaaaagaacagcagcaggaagcagatcacacccatgtttgaatggccatcctcagctgtcctgc

SEQ ID NO: 688116 - DNA, 691 bp, Homo sapiens
  misc_feature (450)..(450): n is a, c, g, or t
  misc_feature (586)..(586): n is a, c, g, or t
ccaggtgctcgaacacacataatccccttggtcagagagagcccagtcaccatccaaggtcccaggattagacaccgggcctgtctgacttgggtctgtggtcttcctataacacagtgaaaatggcagcagctgacaggcttcttgttttaagcactggctggggtccacctctcttctgaggctgcttcaagccctgccaaggtcctcccaacagagctcggtcatgccagatatgaattcgtttcacacccctctgatcttattccacgctgccaaacacactgcatccctccttttcacttaggcattctgttgaacggtgaaaacaacagtgttggacagcagggctgtgagaggaactgagggacacacttatgtttaaacactgagactttacccgtgttcagcccgtactcagtccttggaaactgaatcttcagcacaganttacgcggtctcttcatatggaaacagtggcaataattacagatgacctggtccagtcgctatgtccgtcttacttggtcgccttggacagtagtagctttgcaaagcgtttactgtgcctaaggcagtcccctancagagcgttcctaaacactcatattcttgggccccatccccagagactctgattcagtggcgtctgggtggggcacgaggcagacattgtcagtttagacaagct

SEQ ID NO: 688117 - DNA, 258 bp, Homo sapiens
cctcgggcattgcactggaagggtggaaccagcccaaattgcccccctgtttcacttccaatgattaggagccagcccaccctcctgccctgcccacacccctgggccctgggccagtcccttgggtttgatgttcccccccccccatttcccttaaaaggaagggccgggcaaggcccctactccctaaaaaaattttttgggtaggaaagggtgtgggatggtgggaggggaagcattaaaaccccccacttttta

SEQ ID NO: 688118 - DNA, 345 bp, Homo sapiens
gaaggactgagtgtcagggatttctctagagggtggagaaccagtgtttgtctgcgggtctgtcagcggtggaaagtccaagccgtaggagccaggtttcctttcttagctgatgtcttgggacagaacagcgtgggctgttactagctttgagtaggaagcggttggcatttacgcctgtaactgtattccttcttaatttatgtaaggttttttttgtacgcaacttctcgattcttggaagagatgacaacaaatttgggttttctcctgttatgtgagaacattaggccccagcaacacgtcatggtgtacggaacaaataacaagtgctgccgtacaaac

SEQ ID NO: 688119 - DNA, 487 bp, Homo sapiens
  misc_feature (136)..(136): n is a, c, g, or t
aagcgctgctggcaaagaggacgtcgcatcgaagagaccgcgtgtccttcgagcaggagttaactctgtctcctccttggtggagaacaagaaagctcagctggtggtgattgcacgcgacgtggatcccatcganctggttgtcttcttgcgtgccctgtgtcgtaaaatgggggtccctttctgccttatcaagggaaaggcaagactggtccgtttagtccgcaggaagacctgcccccctgtcgccttcacacaggtgaactcggaagacaaaggcgctttggctaagctggtggaagctatcagccccaccccaatttcagatacgatgagttcctccgtcactggggtggctttgttttgggtctttagtttgtggctcgtatcgccaagctaaaaaaggcggggggtaaagaacttgccactaaaatgggttaaatgtacactgttaagttttctgtacataaaaataattgaaataata

SEQ ID NO: 688120 - DNA, 101 bp, Homo sapiens
gggaagcagcacttgttgtgcctcatccatggtcttgtccgtttttctccttggttttccttttttaactgcacagggctcagtttaatcccccatttttt

SEQ ID NO: 688121 - DNA, 124 bp, Homo sapiens
gagggttgaggctccgattcttcactgtagcgatggactttgtggtccaaggaggtcccagtttccagaagagtctatcatgctgtgcttttgggagccaagttggttttattctctctagaat

SEQ ID NO: 688122 - DNA, 691 bp, Homo sapiens
ggacatggccacgctataggacttgaccttcaggctagaagtatgagaatgaggtagctctgcgccaagccgtggaggctgacatcaacggcctgcgtagggtgctggatgagctgaccctgaccaaggctgacctggagatgcaaattgatgagcctgactgaagagctggctactctgaagaagaactcacgaggaggaaatgatcagaccttcgaaatgtgtccactggtgactgtgaatgtgcccaagtgatatgctgccccgggtgttgatttctgactcaacttctgaataacatgagaagccaatatgaacaacttgctgaacaagaccgcaaagatgctgaatcctggttcagtgagagagagcaaggaactgacataccagcaaattgatatatacaccacttgaactagatatccagactaataaatctgagattactgaattgagacgtaatgtacagagctctggagcatagaactacggtcgcaatggccttgaagagcaatcgcctggaatgacctcctttggcagcaacacaggaagggtccgctacttgtgtgggagctcctcacagatttcaggagccagcattatcccgtactggaaatgaacagtgtgccaagcagaattcgaggactgaaaaccgaggtggccaggaatactgaataccaaaagtcctgga

SEQ ID NO: 688123 - DNA, 178 bp, Homo sapiens
ccgcggaccagactgatgctgagaacccctaattgctctgggtacgatttgtatgtttgaatagaagtggtgagaggggggcatccttgtccttgtccctgatctcagtaggagaagctgttcgattttccactcttgaaaatggtcatagctatgggctttatcatatgtggtgttt

SEQ ID NO: 688124 - DNA, 177 bp, Homo sapiens
gttcggttggtctctgctattgtggagataatcatattatggccaatggtcactgatagcggagctaactcagaggatagtcttgtgatatgtgatcagggtggacaggttaaaggagccacttattattaatgtttattgtaccaatgatagctagggtgcctgcgaaccctctca

SEQ ID NO: 688125 - DNA, 984 bp, Homo sapiens
gcccttcctggggtatttggattttgtttttatttatatgtgtgattgaggttaatgggaccttgagtttttttgccctctttgtgaaccccgttttcccggccccaacttttcctttccttcctgcgccccctgggccacacaaggttgtcccccttatgggtccctgtcccttcttgtgtttttgggtttggatcgtccatccaagagggtttaatgtggcctgggtttctgtctttctaacaggccccaccccggagggtcctcccagtggttcccttggggaccccggacggggcttcctgaaggggttaccgaattttggttgggcccctccccctcgagggttctctggggttccaggcttttgcgccttctgctgcctttccagttccaccccatagttcgacctcccctctcttggaagattcccgtgcccctcttctcttgggatagtgcctctttggaggtccaccttcttgggctctcgtgcttgttcgtccccttctcttcaagctttctttgttccctctgggaacacaagggttcaaacgcccagcgattgggccccacggccctggggattcccccacccccacggatacccccacggccccctctccccttgctcgtcttttccggggggcccggcgcacgaaatggaactccctctttgggtctccccgaaggtggggtcccctcccacgccctgcaatcctccgctgccgtaagaccctgctccccacgaggaaggggccttgagacccacacacggaacgctgtggtggcccctggcacactcacgggagacccccacgctgccccacgccctggttcttctggcgcatctcttccctcttgtcccgcaagattctgcgccttctagtgcctctttgaggggttcccatcatccctccctgatattgtattgaaaatattatgcaccctgttcatgcttttactaatccataaacgctttattta

SEQ ID NO: 688126 - DNA, 108 bp, Homo sapiens
tcgtacttgtgtgttacgtaatatatgtcagagttagaatctgctgcgttgtgaaaagaagcttagtgatgcggtattggccagatgcatgattatggaaaatagaaa

SEQ ID NO: 688127 - DNA, 1480 bp, Homo sapiens
ttttgttcgttgttagaatggtctaggccccctggtgtgggtgtggggtgtgtgtagggtgggtgtcctttctccgtgggggcctgtgaggtgtcgtcccccatgtgggtgtccctttgtgatcgaggggtcctcctattgtgggctgcctctgttttcgcgaatggtgtgggcccccctccttgaaggggtgtcccccgcccccctgagagggaggggtcttttccccgggggggatccctttgtggtcccccccttgttgggggcaccccccttcggggcgtccccctttggcgctgtgtgaagaggttttttttttggaggcaccttgtggtgtggcccccccctggggcccccccgggtgtggaaagttgtgtccggcgccactcttccccttggggggagccccacaatgtcccctccccgtgtggtcggtcgcttctccccccggttaaggagtgtcctcccttgggaaaacttgtggaggggaacccccgctgtttgtttttgggcgcctcgggggtgtttggagcccccacgccccggggtttcttgggggcgccccggggcccgcccacactggtgtgagagagggcaccgcccacagagaggcccggtgtgtttgtcacaaccactgtcctgtcgcaacaggcgcccaacacacccacagggtaacacagagtgtgtttttggggtctccccctctgtcacagctccccagcagcgccctctttctccccacttgtgtgtccgccccctgcggtgagccctctctactgtcccccctctgaggagcccctctgggtgtgtcctgcggcgtgtctcttgtgtgtgtcaccgcctctggggagcccacacagagcccacaccccacaggttctggagactcaccccacagagttacgtcacacatgtcacagccacacggcgcccctgtcgtgcgccacacatgctctctcacatcttgtgtcacacacacagaggggcgcgtgagagggtctctccagcgagaaggtgtgcgccacaaaggctttgaccacagaggtctcccgctgttctcctgagacacttcaccacgccacgcctcccacacacacaccaggcgtcccacagagacctatggctcactggagacgcaagaatgggagaaggcaccacgcggaagaaagggagataacccctaccaccccacgagacccccgcggctggacacacacgctgaactgtccttctcccctcccacgcctcttggcctctggcttttttaagcgctcatttaacctcgcacagcgctgagagccacacttcttttccctcttttccccacgcactcacactcccccaaggaaagagagcccaagttttcccccccataatacccttttgccgacccctagttccctctgctccagacccagacttgttatcagcctttcagggccctgggtcacccatagaataaaaggtagtaaattagaaa

SEQ ID NO: 688128 - DNA, 169 bp, Homo sapiens
cccctcccccacatatcactggtctcatcctcaaaccctgacctcggggctgagggatctgcaggggctgcttccagccatggccctgaagctgcagccagaattgtttggccaaataggggagggtgtgcttggcagggggcctcttggagccaaagggatgtggtgt

SEQ ID NO: 688129 - DNA, 90 bp, Homo sapiens
gcggccgcctactactactactgctcgaattcaagcttttaacgatgtacggggacatggcaaaaaaaaaaaacatgaaagttgtactgc

SEQ ID NO: 688130 - DNA, 121 bp, Homo sapiens
  misc_feature (52)..(52): n is a, c, g, or t
tggaccggggaagtcagcccagcccagagagatggaggtgccctcggggggnatcctggctctctatcgatctgccctcctaaaagcaagctgagggcgctgctcactcccctcggagcct

SEQ ID NO: 688131 - DNA, 1498 bp, Homo sapiens
gataagaaccaagagctggaagttgtgagtgcaagcatgacgcggagcagtctgcgagagacggagctaagcctaggcgagaggagcacccattgtatcgagctccacacggcatcgacggctgcgatgctttgctctagcggctgctagcaggagatagcgtcggacgtatgcgtggactaggatcggcgaaccgtgcaatgctggaagcagaacgtagcgcgagcttcgcacgggagacctggtggcgtagcagcttggaacgcgactgaagtgcatgatgaagcgatcgagggctgcacggtagcaggtggcagcgatgagaactacgaagctggaaggcctggcgaggaggtcacgcctgggtacaatgagtctacgggtccgcccgacagtgcgcagttatcgttgtgcaaggagagcacactatgagaaacgagcggatgcattgggttcacggggcgcgagtactccgcaatagaggaaagaaatgcgcgaatgtgaccaaggcaacgccttattcaccaggcacagagaagacctagataccaaatgcaatatgcacttatgcacagggcccgaagtactgtgccaacaccggcaacctcccagttccagctaccccgagtgcggccaggctgcttttgccattaagcttcccggcggggacataaccctttgcaaccaccacattataccgaagagcacgcaaagctggaagaggtacccacttcctggttcgggtagcgggcaacggcaagagggacgcaaaacacgagagcccgatgtctacaatacattatacccacaacgcaaagaacccacccttcttgtggaaaacggtctatcgcacatgttccacttttccacatagggctttgatctggcgcttcggccaaagaaaccgtctcaagacagagggagccccaacattcggaccacacacatagagggggcatacgtgcttacgacaacggcacatatcgaggtacaaaactcgtggcagcggacggctaaaggcgaagatctgagacgaagatgtgcgttaggagggagcacagcaacaggagttacatgacacattcagagcaagcggaaacaaagttaggttcccccgcgctttgcggacatactgacgatcgatataggggccattttacgccagtgcagcgcagcacgttacggccgacagatagactggtgtgtaccagtttcccgccggtgaccaacggtgggtagcgaggacagaaggccctatggtggtaaccattgtgccgcccgtgtcctatgcgcgcctcgccagtagagctaagagcaatacataaatagcccatattggggtccaatgaagttccgtgggcaaccgtgcgtaacacgcacagcatagacaactctcacagtgcaaagaaccatggacccagcgacaggggcacacaatggggtctgtgaacacgatacacacgtacgaagctaacacgaggagttcgatcacgagagc

SEQ ID NO: 688132 - DNA, 353 bp, Homo sapiens
atgttgacagagttggagaaccccttgaactccatcatcgacgtctaccacaacgtactccttgataaaggggaattcccatgccgtctcagcgcatgacttgacgcacttgctagagaccgagtgtcttcagtatatcagccacaacggtgcagacgtctggttccaagagttgcacatcaacactgatggtgcagttaacttccagcagttcctcattctggtcacacagctggccgtggcagcccaccaaccaagccatgccagaaagccacccagagtacctgagtcactgggcccagaggctggccccctggacatgtacctgcagaataataaagtcatcaatacct

SEQ ID NO: 688133 - DNA, 161 bp, Homo sapiens
  misc_feature (40)..(40): n is a, c, g, or t
  misc_feature (86)..(86): n is a, c, g, or t
  misc_feature (123)..(123): n is a, c, g, or t
actgtagtttggtatttccctttactttggtggcctgctnccctcatgccctggaatacaactcagagctccaggcagcggaaccntctattgttttgtttgccagaaagtgttttttttttngtctcctgtccaagttggaaatattatgcatgtgcagg

SEQ ID NO: 688134 - DNA, 268 bp, Homo sapiens
  misc_feature (120)..(120): n is a, c, g, or t
aagcagatacttcagattacctgagcaatatcatagacaatgatctcgttatatagtagagaggtgtcatttcaacaccaggatgaaattccgggtccaagaggaacgtctacaccatcnagactactgctagcctgaagctcagggtagtttgagcaacgttcgagacatgctgcattgcccttggttaacatctgatatgtgaagcgtgcttcagttcatacatgttcaggcaactgacgtctccaacaggattaagcctattggg

SEQ ID NO: 688135 - DNA, 1045 bp, Homo sapiens
ggagcgggtgaccttccggaggcgggagcgagcgaggaggccctggtgtagcgccgagcgtctgccgccgccgcctgccatgaacaactcgtggctgcctgacgtagatcgggcaagctcttcgtgggcggtcttgcactggagcactgacccaagagactctgcgcagctacttttcccaatatggcagacagtcgtcagcatttgtgttcatccatgcacacagcatcaaaaccagccaacccagtcttcgcagggcttatcgaggtcttgtcaaaaatttcaacaggcacgccaacactgtgattggggcacgtgtgctgggcccagcgagaccgggaccacgcgtgagcatggcccgtgaaaccatcggaacccggcaagcccaatgcagacaaccacccgagtgggcattgcaagcctggcagcagaaacacagggcccgcaacgcgcaaaggcatgggcagacagatggggacacgcaaggacgccgacttacaccaggttcacaagtcgaaagttacacgcacaacgttgatggatccgtgatggggacatttgcgcgtacaagcagaggtgtggtgggcttgacggaccactggacgacctacacgcgagcaacagttacactgtccaacacgtaacgagttattccaggagacaagtgggggtcccacctgggcacgcgggtacacggtccaagtagaaatccctcgatttagcaacgtggcccctggcacgtgaacccggccactggaacggaggcaccacacgtggcaaagagagttatgctgtgggggagaccactatcatgtgcaggttttgcaacccgtttgttgtccgcgcaagaggcacaaccgggaaacacacgacaagtttcccaagcattgtgggggagccacccccatggtgggcccctttgtgttccacaaacaccaccatttggcacgacattttcttgcagcccaagcgggcgaacacgctagtttccacgaattggggtgcgacacaccacaatacagaccaacgggtgtgggtgacgacg

SEQ ID NO: 688136 - DNA, 1232 bp, Homo sapiens
  misc_feature (379)..(379): n is a, c, g, or t
  misc_feature (381)..(381): n is a, c, g, or t
  misc_feature (407)..(408): n is a, c, g, or t
  misc_feature (411)..(411): n is a, c, g, or t
  misc_feature (419)..(419): n is a, c, g, or t
  misc_feature (423)..(423): n is a, c, g, or t
  misc_feature (435)..(435): n is a, c, g, or t
  misc_feature (488)..(488): n is a, c, g, or t
  misc_feature (542)..(543): n is a, c, g, or t
  misc_feature (552)..(552): n is a, c, g, or t
  misc_feature (591)..(591): n is a, c, g, or t
  misc_feature (596)..(596): n is a, c, g, or t
  misc_feature (615)..(615): n is a, c, g, or t
  misc_feature (621)..(621): n is a, c, g, or t
  misc_feature (652)..(652): n is a, c, g, or t
  misc_feature (654)..(654): n is a, c, g, or t
  misc_feature (658)..(658): n is a, c, g, or t
  misc_feature (678)..(679): n is a, c, g, or t
  misc_feature (690)..(690): n is a, c, g, or t
  misc_feature (715)..(715): n is a, c, g, or t
  misc_feature (726)..(726): n is a, c, g, or t
gtgctaacacccttgacatcctctttgcctaccggccaccccagacccccttcttcccaaccaaattaaatcgcctggctgggcgcacgcatctggtagtcgcagctactccggatttgaggaaggaagatcgcttgaacgcaggaattcaaggttatagagactatggtcaacccctgcactccaccttgggccaagcgcagcctctctctctaaaaaaaaagtttcacaatgttcactggttttgatccggggttaaatcccctcccgccagtctcctcctcgttgatgctgtcactgctgaagagcattttctatcacttcactcatcggctcaaaaatcttcaggaagtcttgacttgcagcattaaaagttcanangccttggctgaacatgccagtcttcnnccnctcgcccntttngcaatttcatcnctgtctttggtgaggtacaaagcgtgccaggtcagagtcagaagacatgaatnaaagtcatgattctgtgaccaaccagctacgtgatcttaggctaactacgtcanntgcactggnccggggctccttcccgttcctaaggagccgggaggcgtntcggncagactggattgtcacagntcactnccatctctaacaagcggacttctgagccccntngcgnccacaagtaggaccatctcnngcatcctcctnacccttctacttctagggaccacanggcttctgtgnccacttcttgctgcttcgcttttgccttcctaagtagactaggctttagaagagctacaataccagctcctttaaggtcgacctcctcccggtcacaaggcacttgcctcccactcttcacttgggacagtcctcttcacagtcagaatccgccacgtagtaagtgccgcttccaaccaatcaagaggcagttagcgcagacctttgagggacatccacttccaccaatgatcttcaagtcttctccagcgcctcgctttgtggggcgaggccaaccaccgcgatggccaatctgttgtaggaaaggtattccgggaactgatgagcgcaccaatcaggtaaaaagacgtcggggaagggcatttctcattggtaattgcgtccggaagagggacgggcctcgaacgacgaaattacgatttgattggtaggtgcgatgttgaccaccagggaaagtccaccttccccaacaaggccagcctgggaacatggagtggcagcggccg

SEQ ID NO: 688137 - DNA, 538 bp, Homo sapiens
  misc_feature (525)..(525): n is a, c, g, or t
gtagatctagaggatcccgacgcatccaacgccgcctacaggatactgcataatttcatatatatcacccaaaatgttgattctgtctggtttgtacagtacatccacaaaatttttgatattcttttactaggaggtggagcttagttcccctcccatgagtgtgggctggacttagtgactcccttcatgagtagagtatggacagggaataaagtaacttaacaatggagaaacctggttgacaccagcttaagcaagtgatcaaggctaacatcaccagtggtgagtcatgttgacatcgtcatgttgacctcgtcctccccgctatggtacgatatgaaggacacttcacttctgtggtattttcccccagaatctgtaagcccagtctcatcatgagaaaacaccaagacatgcaaatgaaggacattttacaaaatacctgacaagtactcttcaactgtgtcaaggagagactgggaaactgtcacagaatggaggaggctaaggagacgcggcgtnggatgcagtcggg

SEQ ID NO: 688138 - DNA, 201 bp, Homo sapiens
  misc_feature (7)..(7): n is a, c, g, or t
  misc_feature (57)..(57): n is a, c, g, or t
  misc_feature (95)..(95): n is a, c, g, or t
  misc_feature (165)..(165): n is a, c, g, or t
  misc_feature (169)..(169): n is a, c, g, or t
gctagtnatctctcagacacttggtcggtagaaaagatcccgcaccatcctccaggntccaatggccttggagagagggctgcagggcccacggncattgctgactctttagaacgtgctgacatggagccagaccactcggccctgagtgcggcgaggaccctntttntggatgtggaggagcgcgggccggagcattgt

SEQ ID NO: 688139 - DNA, 86 bp, Homo sapiens
tttatattttttatttttattattactttcagatacagggtctctcacttattttgcccaggttggactgctgggctcaatggatc

SEQ ID NO: 688140 - DNA, 482 bp, Homo sapiens
actcctagaggatccccgacttacggctcctagacgggaagggactgtctgtcagcagctgggacgcttctggatgctgatattagtggagtgctccaggagaagcaggtctcggctacgtgtagctaaatattcaacagttggtgccatactccagagggaaacattagattaaaattagtttgcgttccactgacgctgaaagggaaagcgggcattaagggccaattggtgggtgtttatttcctcatatgagatgacatgttagtattctactcgtgggattatgcaaagtccgtgtgtggacaggcctgatgaccttggccatggccatcactaacatgtagatcttgtctctattggattagcatgtccaggattcccatgactccacttcttgatttctgatttcttgccagtttattttcactgtgacaactgaacattttaagtgctgtcatgggatgactaaggacatattt

SEQ ID NO: 688141 - DNA, 162 bp, Homo sapiens
  misc_feature (101)..(101): n is a, c, g, or t
gcacagcccagctggggctaggcccgtgggaaggagagctcgttaatttattcttattgctcctattaatattatatgtttatgtctctctaggtgatggngatgtgctgatattttacttatcgaggtagatgtcctcgtgtatcagctctgattgcgttc

SEQ ID NO: 688142 - DNA, 151 bp, Homo sapiens
cgctagaggatctacggagccttacctccgggagccgaacctccgggagccttaccctccgggagccttaaccctccggagccttccagcgagccttaaccctccgggagccttaacctccggagccttaacctccgggagccattaccct

SEQ ID NO: 688143 - DNA, 728 bp, Homo sapiens
taacccctctttaagctttatggcgcgctcaagaaaccaaataaaaccccccccccatgtgtaaaagggggggcaggggacacaaagcgacaaagaacagacacagaaggcacagctcgggagaagaccacacaggtcgtggcccccgagacattaacgcggcactctggagtgggagacttacgggtgtaacacacatctctgggccgtggggaggcgagtgagggtagagaagcacgagagggtgtggagaagcactccgctggggaggcgcacctgaggacaaagagagaagacaccctctggtgagaaaatgcacagagagggggcgccgtgcgggacgcataaggcgccacatatggtacagcgagagacctggggaatccacgaggggagaacaaaaggtggacatagggatcccaacagagagacaacatcccaaagaacgcgagaacagaagagagagagagagcgagtatatcgagaacaagcagcgggcccctcacccacagagagtagcaccaacgcagaagtgagtctgctcgaggagagagacacaacgagagcagcggtagagagcacaacatggagaaatggcaacagagaaaaggcattacgccaaaggaagacgagaaaacagggacgcaacacacaaaagagagatagaaaaacaaaaaacgggaggcaaccaaaaaaaaaagaacaagagaaaaacagaagagacatag

SEQ ID NO: 688144 - DNA, 626 bp, Homo sapiens
  misc_feature (14)..(14): n is a, c, g, or t
  misc_feature (70)..(70): n is a, c, g, or t
  misc_feature (395)..(395): n is a, c, g, or t
cacgagggacttgnactcctctgtccagcttttaacaatctacattacaccctcttctgggtcacactanaatcagatctactctccagcatcttctagtttcctagcaagtatttcctactactttagattgaccacgatggcctagaactaccttgtgacatgagcatgagggcttctagatcagaagatcatccacctgttgatggaagacaaagaactgaaagagatcaagaccttaaacaatgccttcagaccagaattgagagatgaattttctaagctccacaacaagaccaagctaactgtacttaaatgatacattctacatgagccattcctaaaaagaacctaccgaaacgtctcaatcatcatccacaccacctatatcatgnatatctttaatatcactcacacagaatccatcatgaatgtcaatgtgaaaggtacccagctactgttggaggcctatatccaatccaatattccagtcttcatgtacaccattagcataaaagtgaccaatcccaaatcctacaaagaaatgatccagaacgggccccgaagaagaccctgtatgaaaacacataacccactgcatacccgtacaggaaaaaacttactta

SEQ ID NO: 688145 - DNA, 1041 bp, Homo sapiens
ggtgacattcgtcttttgagcctgtgtggcattccctgacgcaccgccgtgatgcccaggtaacgacagggcgatctggaagtccaagctacttggccttgaagatcactccacagctatatggatgattatcacgaatagatgttgtcatatgtggtggaggtccgacaatgtgtggactccataggcagcatgcatccagactccgccactgtcccattcggtgcgtggaaggcgtgttgggtgcgtgatgcggctacagtaacagcccatgcatgcgcataggccaatcgcgaggtgcacgctggcaaaagatcaaccccagtctactgagagaacagctagcatagcacttcaatattcctgcgcgcgtgaatgtggagcttcttgttgtatcagccagagggacggacgcgtcagctgtaagtatcatggggacgaatgatttgctggcccaactgagacggatgtcccatgcgtgactgcaccgtggacgtgtgtgcgcaatttggcaccctatggtggaagctcacgtgatgccagtgcccacgaaacacctgtggtctgcgaggtcccaggtaggaagaccatcctttttttaccacggctttattacgtgtattcaccaacgttaagacactctccaggtgagcaccaatttggaagagtccgtgaggtgatgttgcaggctagagtcaatgaccttggacgaacaacacgttggggaagccatgacgtaacgcacacgcatggcatgaacccattgtcgtcaatacagtctacccgccatatcgtcccttttggggcctgggtcatcgcacgcacacgggtggttccgaccaaatggacaaggcatcttaacgaatcgctggaagggtgctttggaatattcacaggaagggaacaggtcctggcatttctcacgacttccttggaaggggtggtccggacactgttggccagtagtcttggtcatgcagatttgtgctacccaaactggttagcatcagtaccaccatttctaatatcaagggggtagaa

SEQ ID NO: 688146 - DNA, 606 bp, Homo sapiens
ctggtacgggagtaggtggctgtgcacctgtgtgccggccacttggtaggctgaggcaggagaatggcatgaacccgggaggcaaagcttgcagtgagctgagatcgcgccactgcactccaacctgggtgacagagcaacacgccgtctcaaaaaaaaaaaaaaaaaacaaccaaaaaagattgttagatcccaattaggcaggaaaaacattcagcctgcagactttgagggcagtgtgaacttggctgcatgactgtggtttgtgactggaagcccaagagaaaagggtccatacagagtgaagctttgtgaccactttatgtgtgactatcaggtctagtaattctgaccattgtgagagaattatctttaaaaccagaggccaggcacaggggcttatacctgtaatcccagcacttgggggggggcgaggcgggtgaatcacgaggtcgggagttcaagaccaagcttgaccaacatgttgaacccccgtctctactagaattacaaaatttagccaggctttgtggtgtgcacctgtggtcccagttactcaggagactgaggcaggagaatcgcttgaatccggggaggcgaactttg

SEQ ID NO: 688147 - DNA, 877 bp, Homo sapiens
agtctgcgttttttgctcgccccaagtatagctgtgacgactctgtgacggcttctttctcgggggtctcgctggtgctcggggtatagccgccgcggtccacccttttgttgttcgcctctgcgcgccgcacaataccgcggggggtcttttttgcgtcacctcattgcgccgctgcctccaaaaagattccgtcctgcggtggttccacccctctttttatcgggtgtgccgggtctcgtccctctgtccaccgtgtccgcgcttcccgaatgacagtagtcgtcgtgccctcattttttggggcctgcatccttttttgcgggctccccccaaatgggggcgccttgtttgccggttttcccctgggggggctgcccctgtcggttcgcccctcccggggtctctggccccgtcccaatgaaatctccccaaaaggggggctcccagcccttttccgccctttgggtgggaaagggggggtctttggtcaatggggagtgcgggcgcgagcatgccctcagtcgaggctgggcggcaggtccttgcgtgtgctcatcgtcccctgtgcggccttgaagcagattcaagtccatccagttgcaataacatgggtctatacggctaccctggcaaggacacgcatgcactgctccaatcctctcatgctcagctgcctctgcggccacggacttctgcccttcatctgctctctcttactctcctgagcctagcccgtccgtaagctccctctcctgcctggttcccagggcaggctgactcagttgactgcttgtccaagcctggcctggcactgtcagtcagcgtaagaatggataagcctttcccggtttttgcttttcgttgtttgttgttc

SEQ ID NO: 688148 - DNA, 607 bp, Homo sapiens
tcagcccacctgcacccaggtgaaataaacagccatgttgctcacacaaagcctgttggtggtctcttcacacagatgtgcatgaaatttggtgtggtgactcggatcgggggacctgcctcaggaaatcaatcccctgtcctcctgctctttgctccgtgagaaagatccacctacgacctcaggtcctcagaccgactagcccaagaaacatcccaccaatttcaaatctgaatctaatttgaagcactgagaaggataaggcatccatttgcacaccaggactcctatattgcaacatgaattctgctaacaattgaacgcaagaacaaacactcaacatttatgatgaagtctggcgtagaacgaacgatgaaattagtgacgctttataaacaccgtctattcgggacaataccccaaatgaatcagcagtttaccacactggataacttactttctaacgacgaaacaacgatgactgtcgacgatgaacgcctgcaacggcagaccatctacatcaattcggcaccgcaccaacacttcactcttgttcatgccctaacggcaggaagactgacaattaacagcaactgacaatagccaa

SEQ ID NO: 688149 - DNA, 1065 bp, Homo sapiens
  misc_feature (52)..(52): n is a, c, g, or t
tgatatagtagcattttgttatcatcgttcgtttctcataagtgcattgtanctgccttgaaccgttcctgtcggtagccggcgaggttttactcctaatatcggttcttcgccacgtaacgccgttagattttggtggaggcgcccgccatactttttgaacacactattaagacgtcctcttcccggccgcgaaattatgcgcggcttgctcgccctatctgtcccgggccattttccctcgaaaggtcctgccgggcaccgtgcacccacaagatgggtggttttccgcggtatcttctgctccgatgtttttagggcgctcttccaccttggttgccgacaccacgtgcgatgggccaaaaactcgtaccaccaccgcgatttgggataattatattacggcgccctgctgccacgcgatccctgtccgagctcccgggaggtgttaaagactcctcgggggacgcccccgaaggtcttgtagcaaccaattcatgctaagacttcgtgacttctgaggcacccctttttcacccccagtcgtgcaacaaaccaatctgggccccacggaatcttacagcacccgcgtgccctcttgtgcagtgttcatttccgaagatgcaattctgcggcgtttgttgcaacacacagacaagtgaatacgtgcctccgcttcctcggtgggtccgttaaatccgcggcaccatcttctgcggcaaccatcggggcagaaaagagatctccacagggaacaaacacaaaccacactggtggtcaggcgctactagggccacccaacaggtgctttcacaacactatcaggacggtggctcccccatgcgtggctgcaagaggccgtggaggcaccatccccccatcctcccccagatatcacggatcctctgtcccacctacgctgaatacggtgctattcagactcgcaaagagtctccctcagaagcttttgtcgtttctggagcaaaagttcgccctcacactatcttgtgggagaagctttccggcaccctttcccccaaaaaaattcttcttcaaacaaaaaca

SEQ ID NO: 688150 - DNA, 678 bp, Homo sapiens
  misc_feature (83)..(83): n is a, c, g, or t
  misc_feature (99)..(99): n is a, c, g, or t
  misc_feature (454)..(454): n is a, c, g, or t
  misc_feature (633)..(633): n is a, c, g, or t
cggcagcagcgcaaacgggtctcctagagcccaccaggccctggaactcctgagtctaagaaggccaccagctgtttcccacntgccccattgactccnccagagaacctggaccaattttgcccaaccaaggctgggggctccctgggccccaaaaaagtaaccccgaagcaagcgcccaagccgtttaaacccgtttggaaagggcggtgcccccgagcaacacgcacaaacacgggccacgtccttcgccagaccgtctcctttacctttatataccccaacggtgccgtttgaaacccctgtggcgcccaagttcgaagtggcccgttcaaggcatctccccttcaaatgcagacgaacgcccaaagaggaacaggcctacgggagacaccacagcgcgtttcctgtccgtgtctgtgtggatgccccttcacacgcgaatagggcgccnttgttccaaatggggctttccccccacaaatcaatcctccggcaactggtggggaaaaccctcctgtaccacgaattttctttcccgttcgacccaattttggcccaaacactagcaccaagcaagttccgcaagagctgaccccggtccctaacattgtgctatgtgcactgacacanattttgggggagtgaccccaaccgcgcatgcgtaaaggcgcttaa

SEQ ID NO: 688151 - DNA, 160 bp, Homo sapiens
aatggtaaacagggaactggaggattagggggagggagaggggaggggtgatcagtgaacgcacccgcaggcacctgagcctgcccagtgctgtctggggtgtcttgagtgtgtctcccgtgggagtggtgcatctgggaagctgggcaaatgtgccctg

SEQ ID NO: 688152 - DNA, 332 bp, Homo sapiens
ttttttttgagatggagtcgtcgctcaggctggaatgcagtgtggtgatcttggctcactgcaacctctgcctcctgggttcaagcaattctccagctttggcctcccaagtatctggaactacaggcatgtaccaccacactccgctagtttttgtattttaagtagagatgcgggtttcaccacgttggccaggctgggtcttgaactcctgacctcaagtgatccacctgccccggcctcccaaagtgctgagattacacccatgagccactgtgcctggtcaatacatggtattcatagagtccctttgctatacaggtcatgctgac

SEQ ID NO: 688153 - DNA, 1067 bp, Homo sapiens
agcgggaatggcgcgtgtgagggcgtttccggagcacgcgccgggcgggggccgctgacgtcgggctcaggtgcgcgcgcccgtccgcacggcccagttggcggcgcgcacctacaggtggcgggcgtgcttgcgggtgagtgggaccgccagctggcgtaggcagtctcgcggttggaccctgggcgtctgcggctcggggggcagcggccggtgatggggccgtcattgggtccatgtcgctccatgttgagcgggccggcgggacggttccgtgctagagagaagcttgcgcacgtcacggtgctgattgctgcggagaccctgagtgacggccggcgatggccattgactgttgttcccgggacccccatgaccactttcagcgcggcccagtggcacctttcgaccgacgcgggaacgcctctccccttccggtgcacgtggggccggcgcgccccggccggctttcaacttatcgcgctggcgccccgtgcgtccggccccaggcttggaacgctggcgcaagctttggttctcccttcgcttcccaggcgaggctgtcactgctgtgcccgaccaaggggcgccgtaaggaaactccccggcgaccgtctccgcggaatgcgggagcgccccggcacgccctctgtggctgggtgccccaccagcgccggtttaaccccccccggagggggggagacattgggcaaaggggggactgagtgcgccccgccggaagaggccccccgcaccaggagagtcgaggggcactcccgcggctgaggagtaccccccaagccgcgccctatggcagcggggggccaccacaggcagggccgtaagagccgataccccttgccgcgacaccatccaggaggagccgcccctacacaacagtattctgaatagtcccccgggtcccgaaccccccagagacgccccccattttgagtaacataacacaccagggaaaggcttcaaactatggggggccaggataccgcggagcggaggctctcacgagcacgaagagtgccacacaactgttgcgggccaaccgcgag

SEQ ID NO: 688154 - DNA, 167 bp, Homo sapiens
gcgcgttcgtaccggtcccatgccagttatatcatacataaggctgatgttggagggctcaggagagggactgttaagattttaagaaactctcctacccccaggagtccctccctccctcatcctcagaaggagcagggatgggggagggagggactccagtggag

SEQ ID NO: 688155 - DNA, 105 bp, Homo sapiens
ggatgcataatcacccccaggacacctccatctcgttgccgattcatatacttcatagtcttcatctggagttgtgcctgcagctgggcatgatgggtacagggt

SEQ ID NO: 688156 - DNA, 144 bp, Homo sapiens
  misc_feature (131)..(131): n is a, c, g, or t
gcgtttggcatgatttcttcgagtatttggacctgactcaaactgcatattagtccttcaaacatgacaaaccagaacactccagaatatatgaaaaagataaaacagcgtttgtttgaaagatttgcgcnatgtatacctcat

SEQ ID NO: 688157 - DNA, 153 bp, Homo sapiens
cacgaggagtatgctgtccaggtttgtaccgcaagaacatgagattatcacatttggcctacgtggatatctgactccaccatctatttttgtgtgtgcacactccacaacattcacacactgctgcgtttgtctgacgtggcatttctcaca

SEQ ID NO: 688158 - DNA, 432 bp, Homo sapiens
cgttatgttctaccatcgtggggtttggagcatataatttgtacgaatactggcgtagaatagtcgataagatgggatctattctgtattaggccagcattttctgtatgccaggaacttatcctctgtacacttgttccttctttccttcctggagtttatacattagggatgaagacttgcattcacggagtctggtgtgatcagcattgtatttgggaagtacgtatattgtgggactgaacagtgagaacctaacccagtagttatcctcgttggctgtctttgaggaattgtgtctgattttgggatctcacagatagagataggattagtaaaaatgagcccaggctagaaaggagactgtgtgaggccaggtatatcctgttctgggaacctgtgagtgctgtctgactggtagaatagccaaaa

SEQ ID NO: 688159 - DNA, 244 bp, Homo sapiens
tgaatcagaggtgctcacaggacatactgcactgcacggcagtagtcgttgtgtggattgctggctaggatgaagaataaagatccatctgcaggatgctgcgcaagagggattgctgcttatttgtggtgttcacttggagtagggcaagctgccaacaagctctgtcccatagggctggtggtgggggggtgcagtaggatctgggctaggaaagtcccaggagctctggcctgcaggggtt

SEQ ID NO: 688160 - DNA, 363 bp, Homo sapiens
  misc_feature (358)..(358): n is a, c, g, or t
ggaggtagggctttgaaaacaccttcatccaggcggggcgagggtggctcacgccttgtaatcccagtagttggggaggccaaggcgggcagatcacctgaggtcaggagttttagaccagccgtgccaacatgacgaaacccggtctctactaaaaatacaaaaattagccaggcgtggtggcaggtgcctgtaatcccggctattcagaagtgcgaggtgggagaatccgttgaacctgggaggcggaggttgtgatgagccaagattgagccaaaaaaaaattagcagaatgggggttgggccctgaaaaattagtccgatttggtggtgcttgacttgcatcgtctcaggagancccaa

SEQ ID NO: 688161 - DNA, 303 bp, Homo sapiens
ttccatcagcagtgtaaaagtgtcctatttctccacatcctctccagcacctgttgtttcctgactttttaatgattgccattctaactggtgtgagatggtatctcattgtggtatttcatttgcatttctctgatgggagaagactgcgcgcatcttgctccccatcagataatgtttcttggagacatcccacaatgggctctgtttttattggaagactcattgaacatatgcaagaatatgcctgttcctgtgatgtggatgaaattttccgcaaggttcgattttcatttgagcagc

SEQ ID NO: 688162 - DNA, 119 bp, Homo sapiens
agataagtaggagagattaatatagagaggtagagtataatcgtggtagtaggttcactggctaacgtggcgtaggcttgccaatgattgtgaggggttggagtttatgataccgcgaa

SEQ ID NO: 688163 - DNA, 221 bp, Homo sapiens
ttgactggtgttgttaatccgtctctctggtattcagcagcagcaagaaccctatcacaaacagcactatggactgggcctgagttaatcagagtggctctggatctttgtcctgtagacaaactagagcgaggaactatcctcccttttattagcgttatggaaaggacaccagccaacccagccactctatcttgaaaactcttgcttgggctctgaca

SEQ ID NO: 688164 - DNA, 808 bp, Homo sapiens
atataccatctcacttctaggaatactagtatatcgcgtcacacctcatatcctccctagtatggcctagaaggaatagtactatcgctgtatcattatagctactctcataaccctcaacaaccagtccctcttagccaatatgtgcctattggcatactagtcttgccgcctgcgaagcagcggtgggcctagccctactagtgctcgaagtctccaagcacatatggcctaggactagcgatagcataacctaaacctactcgcaatgctaaaaaagtaatcgtcccaacaattatattgactaccactgacatgactttccaaagaaaccgacataatttgaatcagcacaaccacccacaggctaattatgagcatcatccctctactattgttttaagccagagagtcaacaacaacctatttaggctgttccccaactcttttcccttccgagcgcgccctaacaagccccctccgttaatagctagactagctgatctcctacgcgcctcacaatcatggcaaggcaacgccagttatccgagtgaaccactatcacgaaaaagagtctaccgtctctatactaatcgtccctacaaatctccttaagtgtaacattcacagcacgagaactaatcatagttttatagtcttcttcgaagaccacacttatccccaccttgggtatcatcagccgatgaggcagcagcagaacgcctgaccgcaggcacatacttcctatgctaaccctagtagggtcccttccctaatcgatcgcactaattacatcaaaaaacctagg

SEQ ID NO: 688165 - DNA, 156 bp, Homo sapiens
ctgtatacgctccgagacctggagcctgctctccgctttgtcttctgctttggtattcatttctggtgttcccaaaccaaagcggttctctggtaagacctggtgctgcagtttaggccctgcaccacctccatccggccattcgacgcctccgga

SEQ ID NO: 688166 - DNA, 269 bp, Homo sapiens
atgtgaaaaatccctggggcaccggggcagttcagtctcatcagcagtcaaagaaaatgctccgaagacatatttaatcacttcaaatacacagttcaactgcacacgagcaccatgtacattatcagattctttttaaaaaatcactacaaaggacaaaattaagaccagtagagcaaagccaaagaaaactgcttcaactatatttcaaggaatcatatataattgtggagagttgtccacagtctgcatgtctcctatcttcccag

SEQ ID NO: 688167 - DNA, 345 bp, Homo sapiens
atcccatgggttatctgtatggactgactgggttattgaaaggactagccccaaactagcattttagggcccttatctgtctttatgtcttggggttgggggaggtaaaaaccaaatgaaacactttcaggcccttccttcctcttgcaggtgttttttaatctcctttactagaggagataaatattttgcaaataatgaagaaatttttttagtaaaaaacgcaggccttttattttttaaaatgatgataggataaaaatgttaggaaaacagaatgattttagattttccagagaatattataaagggctttagggatgaaaataaatcatctttgtttga

SEQ ID NO: 688168 - DNA, 261 bp, Homo sapiens
  misc_feature (36)..(36): n is a, c, g, or t
tgaacaaaggcaaaacaccgagaagggatcatattntgggttttatgtggaccagttctatagctcgtggaagaagaatcacagcaataaacaaagagtcctgggtcattgttcgtttgtaaaattggaaagactgtgttttccacaccacagccaacctccaatattcggtaggtggctgaggatccaggaaactcatcaccacaaatttccaggtcactaactccctgcagtacatcgatgaacgcatgatggagtctg

SEQ ID NO: 688169 - DNA, 115 bp, Homo sapiens
caacatatggtattgtgatggatggggggtccccgaccgaatccaggtgaccacggacctgtaccaggttctagctgccagagggctaccagctggagtgtcgaggggtggtcaa

SEQ ID NO: 688170 - DNA, 1360 bp, Homo sapiens
ggccctggcggagcagagacaggccctcggggtggacggtcttagagtttcataacgagcctgacgagagacttatttactacacgatatgtgtaaccacacccaaacgtacctgtgaccctaggaccaggctgctaacggatgtcttcaaccaaacggactatggcttaggcaatggtcaacgactagaccctgacaaaaccaatgtcttgatagtggacgtggacattattactaccttactggtcactgcttaccactgactaccacgggaacacgcactcacggcaaccctacgacaacccaagactactcacggctctgtaaacctactgagaccttacccttacaacccaggacacactggacacacacgaccacactacctactacgggaccacgacacactcttcattcgggacgacactacagttggcctgacacggcgtaagacaacctgacctctttgattacccactacatttgtaacgcgacagcaccaaggacacacgaccagacgctcgggacacactatcgacacggtccttcctactaacagcggggactctgtattaacgctcgtatgggccggtaaactagtacgacttactacggaattatagtacgtgggacgcaagccattactaactggtgcttgtgttgattagtggattgagccctttcgacaaggcgttggacttttgcaatgggcttatccacgacattgcaagtttattgaccatcaggcctaatattctcaaaactctgtcccacatgagcttacttttcgccccctgcgtgttccacaggctggtgtgaacttcacacgcttgtcagacaccaatagtgaaaccggactagggcaacctggaactcctggcaaggtaaccaatctagccaagaacaggggaatcgagtacagatttggaccacattcccttaacaccattgctttggacacagccagcggagaaccaaagaccccgcacagggcaaacgcctgacaccgacacgagccggcactcgcacacacacacccaacaccggcaacagaacataagagacaagtcggtatggacacggtagtctgtaagacgacccttgtaccgaggtataaaaattgtgtatactagcataataggactgaagtaaatcatgctgagagataactgagtgctagtaattcatggacgacaatgatatatgagaacaagaaaagatctggcagattcaaaaccataatatggtgacaacgtcgcaagaagtaataactaaaatacaccagaaagatcatctccgaaccattgattgattacaaaatgaagtgctcgtctcttctgctacgcttactctctcctga

SEQ ID NO: 688171 - DNA, 763 bp, Homo sapiens
  misc_feature (362)..(362): n is a, c, g, or t
  misc_feature (395)..(395): n is a, c, g, or t
  misc_feature (413)..(413): n is a, c, g, or t
  misc_feature (446)..(446): n is a, c, g, or t
  misc_feature (459)..(459): n is a, c, g, or t
  misc_feature (505)..(505): n is a, c, g, or t
  misc_feature (730)..(730): n is a, c, g, or t
gacggcccggcgcgtggctcgggctcgggcggagctggagacgtgtggagctgtcgaggactcgcgggtgtgcagtgcacctatgatatgtgttagaaatagccgtaaacttgggttggaatgaagaatgtctctcaatccacctatatttctcaaacgaagtgaagaaacatagtccaaaattggtggaaacaaaacagtcacaaactacttccatagcttcagaagatccccttcaaaacttatgtttagcatctcaagaagttcttcaaaaagctcagcaaaagtgggagatcaaaatgtctcaaatgtgggtggtcccagaatgttctactgctatacatgttatgtccagttgaaantgtacctattgaacagattccacttgtgtgaangcttccattgaagattgncatctattaaacttccaattgaaccaggatggncaaaagtacctgntatacatgcaaaaatctcttagcacctgatttgtgtaaactttttnacagcgtatccgtgtatcccagaatatgacgaaaaggaccatgaagtggcactcatttttccgtggacctcagtctatctccaataaaagatatttcttttcatctgcaaaaagggttcaaaataatgttagaggcaaaatgatgacctgacagccatttttaaacggcaaagactgagaacagagtctggatttgatgacagcagtgcaagcccacctgaaaanttttttagatgcgcgggcaacacaaattccgtg

SEQ ID NO: 688172 - DNA, 189 bp, Homo sapiens
acttccagagtaggtatatcatttctaaatattcagtaagaagtcggcctggccgttagtggtggctataggctgtgcacttacattggtatttggtaattcattttctttgggatgtaaaatttttaagcttagttgtatgttatttttcaaccgtcttttctgtttatcttctactctggaaaggtg

SEQ ID NO: 688173 - DNA, 300 bp, Homo sapiens
  misc_feature (95)..(95): n is a, c, g, or t
catggatgagccttgaaagcttgctaagtgaaagaagccaggtgcaaaagcccacatattgtctgactgcattgaaatgcaatgtctaaaatggncgaatctatatagagtgaatatagattagcgtttgccagggcctggaggctgtgagagatgaggcatgactactaagggtttggggtttctttttcgggtgatgaaaatgttctgaaattagtggtgattgtgcccgattttgagaatgtactaaaaaccaatgaactttaaaaaatcccaataaccaaaaaaaattccccagaa

SEQ ID NO: 688174 - DNA, 513 bp, Homo sapiens
aaccccagcaaagaaggagccagcaacagtgtcaatagtgtcagggtcgagaaaccctgcttttttgctgctgttgtttgttttttgttttaaatcccctgttctactttgaaggttaaaaggaaagaacagcacgctgatgagctgatgccaaatccacttttgctactgagaccatttagggcccaatttcaggatttccgggtggaacctccaaccctggtaaagctgcccttggtgtatgtggctatgagaaagtgcttaaagcttcaacctaaggctgtgctgagtgggcctggtacccaagacacagagacattctgtttggtcagagagagagaaaagggctgcagagttaggtcagaggtcagccctaagatggtcaccctaaaatgaaaactgctatgtaaacctgtggtaaataccagatgaaaactttgaggcggagcttgcagtgagccaagatcgcgccactgcactgtagcctgggcgacagagcgagactccatctca

SEQ ID NO: 688175 - DNA, 161 bp, Homo sapiens
atcagtactacaggacggcgatgatggtgtcaggccagcagctactgtgttggttagttctgcttcaatctgaatggtagtcaagttgtagcgttcttccttactatatcattacttgtttatatgtgatagaaatttctgaggaacttgaaaatgagtta

SEQ ID NO: 688176 - DNA, 681 bp, Homo sapiens
  misc_feature (43)..(43): n is a, c, g, or t
  misc_feature (88)..(88): n is a, c, g, or t
  misc_feature (171)..(171): n is a, c, g, or t
  misc_feature (173)..(173): n is a, c, g, or t
  misc_feature (190)..(190): n is a, c, g, or t
  misc_feature (355)..(355): n is a, c, g, or t
  misc_feature (372)..(372): n is a, c, g, or t
  misc_feature (375)..(375): n is a, c, g, or t
  misc_feature (402)..(402): n is a, c, g, or t
  misc_feature (414)..(414): n is a, c, g, or t
  misc_feature (421)..(421): n is a, c, g, or t
  misc_feature (439)..(439): n is a, c, g, or t
  misc_feature (460)..(460): n is a, c, g, or t
  misc_feature (464)..(464): n is a, c, g, or t
  misc_feature (467)..(467): n is a, c, g, or t
  misc_feature (472)..(472): n is a, c, g, or t
  misc_feature (513)..(513): n is a, c, g, or t
  misc_feature (528)..(528): n is a, c, g, or t
  misc_feature (544)..(544): n is a, c, g, or t
  misc_feature (572)..(572): n is a, c, g, or t
  misc_feature (592)..(592): n is a, c, g, or t
  misc_feature (595)..(595): n is a, c, g, or t
  misc_feature (605)..(605): n is a, c, g, or t
  misc_feature (675)..(675): n is a, c, g, or t
cgagtgtccggagctccgtggtttctgttggacctcgcgggangcggttttctcccgcctgctgtgctctgtgacctctctgctgccncctccacggtctctgggcggagcaatccacactgctgaacctggggtggtttggaattcttcggcgaagtggagcgggccganantgggtttcccgtccccnagccctccctcatctcggagatgccgcacttgtgagcgacagggcttcatttgaattttcgcacctcgcgagttgcggagctgcatctctgaagctgcctcggtgaagagccacaacattattttttttctctttgggaaagtagctgtctgggatttaaaatcntatcttccctgcaaatnacnaggttgcatcttcactgataggaatanatttacttcacnaaagganatgaataaaaataaaaanaaccagtctctgataacaagnagcnaanatccnaaaaaagcagtaaaaaaacgtcaaaattcaacacggaattncggaacaaataattnttctaggttttctagnaaaagcttaaaactgaattatagactanaagaagatgtaactaaatcnaanaaaggaaaanatgggagatttgtgaatccgtggccaacatggaaaaacccctctattccaaatgttctcagatggctganaatgga

SEQ ID NO: 688177 - DNA, 194 bp, Homo sapiens
ccccagtctgaggagagccaagatcatcacaccactgcactccagcttgggcgatagagcaagactccatctcaaaaaaaaaaaaaagtatggggcgtgtttcaagagtgatgtgaaactcaaattccagtttccaaacacttccagttttaccagcacacaaccacccccatttgtttacgtattgctcagcg

SEQ ID NO: 688178 - DNA, 973 bp, Homo sapiens
ctcttgttttcctcttttttgtgtttctttcttctctgttcccttcatttgttttgtttgttgtttcttttctcgtttttgtgtttctcgtgccttctctccttgtcgttctcttttctttttgttttcttctccctctcctctggcttttggtcgtctcctcctctctctctctctctctcttctttggggagtcgtgtttcccctccccttctctctcattttcatctcctccctctcctctcttcttttttttctgtgttatgtgtgtggtgcccgctcctccccctctctctctctctctctctctctctttctctctccctcctcgcggcggcgctctgctgtcgtgtgcgtcctcctctctcccttgtgcgtgtgtggtgtttataacacaccgccgcgcctgttctctccctccctcgcgcgcgcgcccccgcccttcttattttcgtttttttggtcggacccccccccctcccctccgcgcgcgcgcgcgctctctctctgtgtctgcgccgcgcgcgctcgctcctcgctgtcttcgcggtctgctcgcctccgcgcgcggcgagaggacacacaaatctcgccccccccacccctgcctctctcaccactctcttctctctcccctcccccccgcgcgcgtgtgtgttttttgatataaaaaaggtgtgtgtgtgtatatatatattatggtttttttatagcagcgcgccgcccttttttttgttttgttttttgtgtgtggtttctctctctctctctctctctctttctctccctcatttttcttttgtttagtgtagtgttgttgtgtgttgtgtagtagagagagaacgcgccccccctctctctctcttttctccccgcgcgcggggagaggagagagagagtgagtgtgtgttgtctctctctctcctccgagagagagagaaaaaaaaaaagagagagaggagggtgagagaga

SEQ ID NO: 688179 - DNA, 1376 bp, Homo sapiens
gtaggtgttaaaaggcgttctttctttctcccctctcggggggccaccaacacacatagtggtggggccttttcaacaaaaggttggttcgcacaagcgaaacagtgtggttgttgctgtcggctcccacacgagaggaaatagtggtgttttctgttgttcgcgggtgggggcgaaaacccgcgttttgtggtcgtggtggggagaccacaacgcgccgcgacgaagtaatgtgggcgccgcccccccgccccgagttgggggagaaagcacacagccctgtgggtggctgttaccaccacgcggccttcactacgcggtgggaagagtgtaatttccccccctggaggaggcccatcttccccaagggcgccccacatatttattaggcgtccccccgcgcttttatattgccccccccccggggtaaatttggaggagtttggccggccacacacacgggcggtcatcacaccaaatgtgcacaaaaggcggcaagagttgtttgcggcttgtagtgtcctgtagaagggggagagaaacagagtttgatggtccccccccttttcctcgggtgagaaaaagcgctcgggagaaaattgggggcgcgctcgacaaatatttcttctcgagaaatgtcttcgggtgagagagtgctcgcccccctctgtgtgtgagataatatggtgttctcctcggcaccacagccccacatctgtgtgtgtgtttggagagagagactctttctctcacagagactcatttgtccacccctctctgtggggtgtctcctcttttgtctcgctgttccgtcgagtatttagagagaccacagaccacagctgtgtccggtgtgggtgtgttcactccacacaaccacactgtggacacacacagagaagaggctctgtctcggagagctcgcgccacacagagtgcaccacacaagtgtctcgccccacgcagaaaggctccacagagaaggcgtaaatagagataattattccctcatataatacctcgccaccgcgccacctctcttataatctacagcctgtggtgggagaagagaccgcgtgtctccacagagacctcgtgttgtgttcacacttggcgccactcttaaagtgttatagtgaagtaaaagagactggttataatgagataacacacatgcactctgtaaaccccttcacagaaaggaaaaggagagaaatgtttttgttggagccccctttggttttctttttttgcgtgttggcacacttttaaagttaatatatagattttttaaatccaatactttttaatggaaaccaccttgaccccaaatttgtccccagaattttgagaccccctttaaaaaatttaatgag

SEQ ID NO: 688180 - DNA, 694 bp, Homo sapiens
gaagagcaacgtgctttgggagcagagaagagggagaaagcagcatcttgcctggatgagccaggggacacagaagagaagcccacatatctcatgtaatctttacgaacatctcattgcaaggttccctgtgttgtgaaaatacatgagataaatcatgaaggccgactatcatcctcctatctgctgggcacaagtgtcctgggctggaccgattatcaacagagaggcttatcatgacttgtatgctagaagatgaggcttctgggataggcccagaagttcctgatgaccgagacttcgagccctcccataggaccagtgtgaacccttccgctgtcaatgccagtcttcgagtggtccagtgtaactagatcagggtctggacaaagtgccaaaggatcttccacctgtacagaactctggatagaccctgcagaaagaagcaagaataacgcgagactgcgacaagatggaagactttgaaagaaccctgaagaaaccttcacgcaatggattcataggtcaagcaagtagaatgtaggcaaaagtgacgtccatggagacatttaagaacattgggtgacagtacggaacagaatttatactgggccaagagatcaagggtgaaaggaaatggccagagaaaaatgcccaaaagtctagcaggagactggcgtgccccatgagcctg

SEQ ID NO: 688181 - DNA, 101 bp, Homo sapiens
ctgctaatggatcatagctctgtcaccaggcatgagtgagtgcgcatctcagtactgagcttcattctggctcacgcgtcttaacttcagcctctcgagta

SEQ ID NO: 688182 - DNA, 176 bp, Homo sapiens
cctgacgggttaaaaaaagtaaaaggaactcggcaaatctagccccgtcctgtataccataaacatcacctctagcatcaccagtatcagaggcaccgccagcccagtgagccaagattacaccactgcaccccagcattggctacaaagtgaggccatctcataacatataaaaa

SEQ ID NO: 688183 - DNA, 878 bp, Homo sapiens
tacttctatttgctgcataccttagtacagcctgttgagacgagtggtagttataagtcattgtccatttgtaaaacataatttgataaggaatgctcttatctcgagtatgtagaataccacctactggacagaacaattttggtactcacaaacactgtcattttcttagagatggcttgagaggagtaccactatggtttaaggcttgcagtataaatgccaagcactgtagtaccttggaatccagtttattcttgtgctaggcagaattgtaaaatagttaaaaggtcttatcaagtaattcgccgattacaaagacaccattggttttttatttcattcttggttttaactcatgtggtagtgatattaaatactgttctgatcaaacgggttcaaagtaaaaggtaagtttcacatttcttttaaagaacctctgaaagtgtaacagttacgccatattcataagtggtagagaaaggtataaaatttggaaacatttggtgggcatagtagtgatgggtgaaaaggatacttatatcaacaatgagaatgtgtgtactgtggaagtagggagctaaggggatgttcttcagtaagtagaactggaacgttgtctactaacagtgttttataatgcttgtcagtaatttatcggtgtagatttaattcagtggagctataagtggttctgaccgtactgattaattaccaggattgttagaggtaacgttaaatgggtaggttaaaaagtggattttaagaaaaaagaaaagagtggggcgcccgagataaacatttggggccgagagatagttgggcagacggtagggtcacaaggggggtgaacagggttgtaaacgaacgcgcaggaa

SEQ ID NO: 688184 - DNA, 396 bp, Homo sapiens
ggaggtgatctagaggatcccatgcgcgagctccatcaaagtccatctcttagccgggtatcaaacaaaccgtgagttttccagaatctgtttcccagttttcccctcagctttcctggtctcccatccgaactgcttctgtgtgcacctcttgttctttctcttggctcccagtcttgattcctgtgatcactcttgcatcactaatggcacaagtgattgcaggtgcaactctgattagcctgcgtccacacagtgatcgatgatcctatgtgcctagaaaggacactgtgtgctgctcatgacctgcaacaggaacaaagccatttcttgttagcagtgtaagaaccttagagcaaaggagttgaccttctgatggatggaagcgtcgcgcat

SEQ ID NO: 688185 - DNA, 1448 bp, Homo sapiens
gaaggaggggccccgccgcctagagggtggagggagggcgcgcagtcccagacccagagcttcaaaacagcccggcggcctcgacctcgacaaccccagccagtccgtcgatccagctgccagcgcagactgtcagcgcctggcacatccgctgctctgtggctttaaaacgtgacccactcgcactcgacatcgcacctgccctgtgaaaaatgataggttgcttacttgcgttacatcatcgaccattccacatcacactctgcaagcctatgctgtaacagttgccaaccgatcggacacatgccatggcctgggctacggagaatgacgtatttatctgcgagcattgtcttgggaggaaatactggtagccagaacaaccgaccgaaactggccacaaggtcccgtcgaaatgaaccaggaattggcaaacgcaagtaacgtcgccaccgccatagccacagcgacggagacacaagggccacgacacccatggattccggtcagtccaaccaaatatcatacgttggcgatgccaagtacagcccattttcatatcaagtccatttccggtaggcataccacagccactccattccaccgagcgcgttggaaacgacacaggggaacggaaagcaagggactagggatcccgttaaacgcagtagccaatacgaatacacaaggacattagattggatacaatggatcatggtgaaatgcagcacaagtgccaactgggcagcgcaccgataccacaaaaccacatcacacaaggcacaacaggaggacacgacgtgcatacggaacacattgcacaacggaagcagaagaacaaccaacgcacgaccaaaatacacgtaagcccagcacggatagaaccccaaagcgacgcacaagcaggacatgcacatacacaagggcaattacacacacaccttacaccacatccaccagggagcacagcattgtgaaagcatggagaaccaaaattgagaaccacatgtgcacaaaccgatcgatcaaacacaaggagacagcggacacacttgcaacacggatgacacccgtaggaaagccacaccacgggaagaaggccacgagcgacacaacagctgcgcagagagccaccgggcaccagcctggggaggatctgttccaacccgagaccaggtcgaccaggatgacgaagacgcaacatcacacacaatgataacgaaagcatcaaccacacagatgcagcggcgctccctacagcaacgaccagatcatacgcgcacggaatcgacacccacgcaaccacgagggcacatggcggactcgcagctcagaaagaacgcgcgaaacacaaacgaaaacacgaatcacagccccgaaacacagtagtggcgacacgccgagacaccagccgaacacgaagagaaccaaaaccacgatggtcgcac

SEQ ID NO: 688186 - DNA, 289 bp, Homo sapiens
  misc_feature (22)..(22): n is a, c, g, or t
cccccccttttttttttttccncaacagcgtttggacttaaggcttgttttaaaaaaattttaagatttacacaatgttcccctgtaaatctcgccattaaatgtaaaaaccctcaataaaccgtttatggcagttacacagaattccaatcctggtatatagcacctggtattatgggtaccaaaaaccctaattttttttattaaagaacattttgcttttaaaagtggatttttttcttttgtttttagaaaaaataaaataactggcaaatttttctttgggcca

SEQ ID NO: 688187 - DNA, 344 bp, Homo sapiens
ccctacaccttcctgtacgtgtggtcttggtcacttctgtggctacggtaagaacgtgcttgttgaagacaggtctgtggcttggtgagtctgtgtggctagcagcctctgatctgtgctgggtattaacgtttcagggctgagtgttccgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgt

SEQ ID NO: 688188 - DNA, 618 bp, Homo sapiens
  misc_feature (15)..(15): n is a, c, g, or t
  misc_feature (50)..(50): n is a, c, g, or t
  misc_feature (57)..(57): n is a, c, g, or t
aattcggcacgatgngcagcacttaccagcccacatccccatcccacccngggggancgcctggccaaggtttggacatcagagagccatagaggattagggtacaccctctgaggtcgagaagtaatctctcctctcaccagaccacattccccctctagacagctgagtcaccccacccacccagggcccctgcccctgagtcaccttcttatttcagtgccgcaaggggtgaggaaaaaatttgtactctccctgggccctacatggggcagggcggggcagtggggttccccaggaagaagggattcttaagaagtctaggcagggggcagtggctcatgcctgtaatccactttgggaggctaaagtgggaggatcacttgaagccaggagtttaagactagcctgggcaacacagcaagatgcccatctctacaaaaaaatttaaaaattagctgggcatggtgtcatgcacccgtagtcccagctacttgggaggcttagctgggaggagttggagctcgagagttcaaggctgagtccaggagctggaggctgtagtgagctatgattgtgccgctgcactctagtctgggtgacaaagcaagactctgt

SEQ ID NO: 688189 - DNA, 351 bp, Homo sapiens
tccgcatagatctactttgctcccctctcctggagtacgggaaggatacgtggagagaagggacaggaatctgcatggcagcaaaagaccggggaaatcctctcctggacggagtctgacgagaggcttcgatacctaagtagcaaaggacagagagtgtaataaatagtaaatacaggatatggagccagggtgttccgattccgtccacaaaaataactcaggctgctttgccgaaccatcctgtccaccaggggcgtagctgaggctgtctgcctggaaggttcaccaatgggcgcggaaagtcctcactctcatggctcgggccatcgccgccgtggggtaggaggt

SEQ ID NO: 688190 - DNA, 174 bp, Homo sapiens
tgtagacactgggttttgccatgttgcccaggctggactcaaactcctggcctcaagcaatcgcctgcctaagcctcccaaagtgctggtattacaagtgaaagacactacatccaacctacacttttaaaaattatcccacaggttttggatattctgttgtttttaaaaatt

SEQ ID NO: 688191 - DNA, 911 bp, Homo sapiens
tgcaatgcccacatcgtgttctgtcttggcgagggggctgtccctttgcccctctttcaaggtggccgctacatcttcttgtggttgggatgccgtcttgatctagcaagtcgtttggggcccaaccaacgagaattggggggtgttctggggaagtccctgttcaatacaccctgtttgggtaacccgtggcacatcccgttctgttctcgatgtggttgtgttcacccccaagtcctctgggcgttgaagctattgggcggggcctttgtaagttctgccgccatgtttggcaatctccaaccgttattgtttccccacacagtggtctcctcgggggaaagggaattttaagaccgccttagtggtaggttgtgtcacaattctcgttgcgcgtggaagagtattttgtggcagtcacaaaccaggtccttatctttacaaatctggtccctttgtaatgcgtcacgattttttctagttatagtgcccgtgcggcttcacaaacaaggttctgtggggcagtttatcagacccacgctatgagtgttcttcggccatatctccgtaacgtcaccttggttaatggtctttcttcctcaattcctgggcaccagtctcctttgttttcttgcccctagaagtgtcaatcccggtatgaatctaatgtgtgaaccttgcaaagattggagctgcagtttctgtatgtgccaagaactgatatgctggttgctgctgccctgtgtgtcttcaataggcccctgttggaactgctgcctgaccaagcttgcttctttcttgattgactgaaattgtgtgatgggcattgttcgccttcccttttgccccttgggcattccttccccagagagggcctggaaattataaatttctatcacataaggattata

SEQ ID NO: 688192 - DNA, 113 bp, Homo sapiens
  misc_feature (52)..(52): n is a, c, g, or t
  misc_feature (85)..(85): n is a, c, g, or t
gatgaggggtctgggtggtcaggaaggccaatgaagaatctggagtgtatcnttctgtggcttttatggaaaacgtgatgtcacnagagttgtgggtcaagaactgtgtaagc

SEQ ID NO: 688193 - DNA, 401 bp, Homo sapiens
gagtgtgaaatgttctcttagctagaaactccgttgtctcttcatgttctatcaatcgtaagtttctcaagagatattcacgtgcagtcttcagacggttttctttcatagcaaactgtcttctagttctcctatgccatcatccaggaggaagtgtgaggatatcaggaaaggacagtccctggagtcccgcgaacactgtagctccaccaccacagcttcctggcctccctccatacccactttcatccaaggtgttatattttgcaatttcaaaatcttgaggaagatgaggaatttcaacattctgcataccaaactcagtgagttccacagtgtcttcctcctctgtggcactgtccgggcatagaccttctgttttcacttcagaactgctcgcc

SEQ ID NO: 688194 - DNA, 468 bp, Homo sapiens
  misc_feature (66)..(67): n is a, c, g, or t
  misc_feature (69)..(69): n is a, c, g, or t
  misc_feature (84)..(84): n is a, c, g, or t
  misc_feature (166)..(167): n is a, c, g, or t
  misc_feature (258)..(258): n is a, c, g, or t
  misc_feature (275)..(275): n is a, c, g, or t
  misc_feature (278)..(278): n is a, c, g, or t
  misc_feature (328)..(328): n is a, c, g, or t
  misc_feature (354)..(354): n is a, c, g, or t
gcaagcagtaagatctcctgcctgtcctttgcactagacgacctcgatgaccaggccgacgcgcanngngccaggcgcgccggnaaacctgggcaagaaccccgacgtggacaccagcttcctgccagaccgcgaccggaggaggaggagaaccggctccgagagnntggcagccaagagtgggaggctcaggcgaggaaagtgaaggacgaggagatggaggtcaccttcagctactgtgacggctcgggccaccgncgcacggtgcgggtgcnaangggcaacaccggtgcaagcagttcctgaagaaggcgctgcaggggctgcnaaaggactttcctggagctgcgctcngcccggcgttggagcagctcatgtttcatcaaggaggacctcatccttgccgcactaccacaccttctacgacttcatcatcgccagggcaaggggcaagagcgggccgctttt

SEQ ID NO: 688195 - DNA, 177 bp, Homo sapiens
ctgcgttttgtaacagtcagcgtgagctagttaggcacacgtggtcaggctaattaatcccagggctaagggaggcctcgaggtggcgcagatcacataaggtcgggagttcaagaccggcctggccagcttggtgaagccccatctctaccagaaatgtagaaattaccccggtgt

SEQ ID NO: 688196 - DNA, 399 bp, Homo sapiens
cactccccttccacttaaatgtacaaaccctgtgtttctgtggtgttttacaggttttatttttatttttggggggacggagttttgctcttattgcccaggctagagtgcattggtgcgatctcaggttactgcaacctccgcctctcgggttcaagcaattctcctgcctcagcttcctgagtagcggggattacaagcatgcgtcaccatgcccggctaatttttttgtatttttagtagagacggggtttcacatgttggccaggctggtttcgaactcctgacctcaggtgatctgcccgcctcagcatcctggagtgctgggattacaggcgtgagccaccgtgcccgacctgttttatagtttttaaataggcagcatttgtatatctctag

SEQ ID NO: 688197 - DNA, 991 bp, Homo sapiens
  misc_feature (454)..(454): n is a, c, g, or t
agcggtcgggctgcggggctccggctgcgggcgctggtgccgcggaggccgcggagcttgggagcggagacccaggccgatgccgcgcggcgccatgaagggtcaaggacgcgacgacacggacgggcgcgcggcaacggcatggggcgctggtctggcggaaggccccgagaagacgcccgaggcgcgcaggagctctagtgagcatgggcaatcgtctgttcagtgcggccgagtaagtacgcctgcgatcggcaggctggtcatcgctacaggcgccgctgccgatcacccaggaacccagcttgcgttggcccgtcgtcttatcgagccatagctcgggcctttgtgctaccatgaatcgagtgcattgctagctaccgagcaaggctccatgggcctcgcacctgcacgtgcagcgctctctggtatgctgtgtacgggcaagtcttgntgtaagtgctgcaactttcctttcccttggggagcaagatgcgcaatgcatggtagcgacttggaagcaagtcttatgtaatgcatggcactattctggcccaaaattcgtgacaaacagcaagtctttatcaacgccccatgtggcgcaattggcagtcacgccgtgcttgtacatcgttccggaggcactgtacctattgcgcacacagagtcggcattcattttcgggaaaaatctgtcaggaaaatgcatagtaaatgaccgtcatggggtataacccagttaacttttgcatggaagaccggggctggctcagtacaccaaactcgagttgtccaggcaagccccgaaacgtccttgtccaaacattgcccattaatgcactgttcttttccccagagaggggtcctttcctaagttgtggtcccccggttgtcggggggccacgagcggcttgttaaaagcgcaacgggtggggcaaagggaccgttggttgtgccacaaaaaggggcagagggttttgggtctcccagaa

SEQ ID NO: 688198 - DNA, 467 bp, Homo sapiens
ggggttgaaaagtcgcaggagcccaggaggagtgcttgggaacagtgctgatgcggtgcctgctccagtgatcgcctcagaagcagcagcagcagcagcctcagcccatgccatggaccgctgcacctcaactgcacggccctccaattccctgcccgctaacctctgcttccaaagacaggagggcgtaatcattgccacttgtaaataagttttactcagtttttagtctttacaaacagcttttgaaatgtgaatatttaaggtataaacctgtgttgtaagatatatccagcttatttggctttttaaatgctctacaactttaaaagaatttttttttaactttaaaaatgtgaaactttatatacttcaagcttaaaattacttattaagtgtaataaaaaagtaatatatgtatctttacagttttgaaataaactactcttggaaatgtaaaaaaaaaa

SEQ ID NO: 688199 - DNA, 332 bp, Homo sapiens
  misc_feature (45)..(45): n is a, c, g, or t
  misc_feature (63)..(63): n is a, c, g, or t
  misc_feature (65)..(65): n is a, c, g, or t
  misc_feature (71)..(71): n is a, c, g, or t
  misc_feature (73)..(74): n is a, c, g, or t
  misc_feature (125)..(125): n is a, c, g, or t
  misc_feature (145)..(145): n is a, c, g, or t
  misc_feature (164)..(164): n is a, c, g, or t
  misc_feature (216)..(216): n is a, c, g, or t
  misc_feature (224)..(224): n is a, c, g, or t
  misc_feature (229)..(229): n is a, c, g, or t
  misc_feature (256)..(256): n is a, c, g, or t
  misc_feature (331)..(331): n is a, c, g, or t
gaggggaaagggacaccgcgcgcgaagagaatgacgaccacaganaccaatcttcacaaaaanantccaananngatttctagggaggagcagggcatggtcagctcaaatttggtgaaaacgtnaggatgaaggaccccaagcntcccgacgctttgaccccngggaaagatctttgcacatcgcccggggaagaaagcagggccttctgaggcnttgatcanatatncccccttgttttcaccaggagggacanggagcaactgcataattttgttcagcagcgcatgaattatctgaaacccaggatttttgttgtaataaaaaggana

SEQ ID NO: 688200 - DNA, 282 bp, Homo sapiens
tcccccccccggggggggcccgggtttttttttttagggggttaattttgtttccccccccccccggcccccccccctttccgctggttaaaggggaggtgggccgggcccctttttttttttgggccccctgggaccccgggcttttttggcccccccaagggggtttggggcctggttgtcccccccttgggggcccctccttggggttgcccccgttttccccccttttacctttgggggtttttccccccctttttttttcccggggttggggcccga

SEQ ID NO: 688201 - DNA, 407 bp, Homo sapiens
  misc_feature (11)..(11): n is a, c, g, or t
  misc_feature (74)..(74): n is a, c, g, or t
  misc_feature (84)..(84): n is a, c, g, or t
  misc_feature (91)..(91): n is a, c, g, or t
  misc_feature (182)..(182): n is a, c, g, or t
  misc_feature (221)..(221): n is a, c, g, or t
  misc_feature (270)..(271): n is a, c, g, or t
  misc_feature (279)..(279): n is a, c, g, or t
  misc_feature (285)..(287): n is a, c, g, or t
  misc_feature (307)..(308): n is a, c, g, or t
  misc_feature (314)..(314): n is a, c, g, or t
  misc_feature (320)..(320): n is a, c, g, or t
  misc_feature (330)..(330): n is a, c, g, or t
  misc_feature (339)..(339): n is a, c, g, or t
  misc_feature (357)..(358): n is a, c, g, or t
  misc_feature (363)..(363): n is a, c, g, or t
  misc_feature (383)..(383): n is a, c, g, or t
  misc_feature (404)..(404): n is a, c, g, or t
ttaaaaacatngtttctcacttcccaacttcggccttgagagaaagggcacagcacggagcaatcccccaaatnagaggacatnatggtangggaggcctggaattgtcattctggaggagcgaggaagggggttctgggaggccaagttctctactaaaaccccgtctctactaaaaatgngggataatatgggagcaatgaggtggtcacaggcacacnaaagcctgaaatctgatttccaaggacaccacttggtctctggaccgannagttcctngggacnnntgaatatatcctcaggaganncaaggntcaatncaggtctcanaaagggtanggttggagtgacaggctnngtaanaaataccggccaatagaaanctcaatatgagcccccgggcnaat

SEQ ID NO: 688202 - DNA, 410 bp, Homo sapiens
  misc_feature (203)..(203): n is a, c, g, or t
  misc_feature (355)..(355): n is a, c, g, or t
  misc_feature (394)..(394): n is a, c, g, or t
atgacctcatggatccacccgcctcagcctcccaaagtgctgggattacaggcatgagcactgtgcccggcccgtaacccaattcttaaacagctttattaacatataattcacatgccacaaaattcagtcatttaaagtatacagtttaatgtatttaatatattcacagagttgtgcaaccatcaccactgtcaacatgnggaaaatttccataacctcaaaaagaaattccatacccactagcactcactctgcattttccccagccatagacaaccatttatctactttctggtctctatgaattcacctctttctgggacattttcatatggaatagagttatataatnaagtggaagttttggtgactgggcttcttttcacttagnccagcgtttttcaaaa

SEQ ID NO: 688203 - DNA, 915 bp, Homo sapiens
gccttgtccagtgaaagagcctcggtgggaagtcagtacgttctctcctctcctctcttcttgttcagaacatggtgtggagtaaagcagacagctgttccaggcatttacagatccagtggtggctgttcgagcccccagaaaaggtgcttggttcttccagctctgccagtaattcgagatcagtttcatcgaggagagctgaacaataagatatgcaggagggaaccccgtttgcgtgcgccaactcccaagtggcaaaaaggaatggagaattctttaggttgtcccctaaagattcctgacaaacagagaatcagattcctgaagaggcaggaacgcagtggcttaggaaaagcacaagagaaaagcatgtcctttgcaactgatcacacaaatgatgaaaaagaatagaactttctcattcatctttgaataacgtctccttgtttaccctggtatctagaatgtaaatttacataaatgtgtggttccaattacctttgttgaccaggcctttcaattaacacaatttagggtctacactttcgatgttcaacagtagtttgtgaacctcgagactggtccagactacttatgggttaccttagcttagtattcactcatactgcttggtccgcttctttaacaaattaagtgtctagttcttgctacagtccagtcatgcttgtgtctaataccagtattggactgcgatgctagatgtgacgcggcaataaatgggtggcatggccgggcgcatggacctctactggtacacgccgcattcgcgcttacactgttcaccaaaaaaacaacaaattggcgcgccggacgtataaacatgggcccgagaaaaacgtcaagggagctgccaacacggcgaacgttgtctcactctcggggcaaggaacc

SEQ ID NO: 688204 - DNA, 272 bp, Homo sapiens
tcatcatgcgaaaatttttccacaactttatgaaacatcgtgttgccggacgtatcggcggggcggtcttttatgccgttattgtcgcggtcgccatggattatttctggcggccagggcatatttactcttctggttttaccgttttgcccaattagtgtcaacgtttatctggcgggcagattccagttggcttgcgttggcctttgttaatttgcctatgttgatgattgcttggtggcgggtatcgtggcgatttgcgatttttacca

SEQ ID NO: 688205 - DNA, 309 bp, Homo sapiens
  misc_feature (16)..(16): n is a, c, g, or t
  misc_feature (80)..(80): n is a, c, g, or t
  misc_feature (91)..(91): n is a, c, g, or t
aatggatgaccgtagntagcttattaaaaaaaaagagccaagatccaattaaccccattaagaatgccaaagggacattncccaccacccnttagaattccaaaaaccctcagagctattaggccacatctatgcacacaaactggaaaacctacaggaaacaaataaattcctggaaacatatgacctcccattattgaaccagaaaaaaaattgaaatgctgaacagaccaataatgagtttcaaagtttaatcagtaataaaaaccctactaacttcctggtgtggtggctcacacttgtaatccc

SEQ ID NO: 688206 - DNA, 318 bp, Homo sapiens
tgtgatactgtgtgagcttggactgagcgttggtggttcttcctcaataggaattgaactttcttcgcggcctgcaggtctctgggccttcagcgcgggtcctggtgcttgcggccacaccagcctggggtgctcattgacagagcttgccataatgaaccttaaaggacgggaatcacgagggaagctggggctcccctggccacaggagaggatccccgttcttcaagcttctctgctcagtgtctactaacgaccgacattagctaatgtacattatagtaaattattgagaattctaattcttttacacagtta

SEQ ID NO: 688207 - DNA, 223 bp, Homo sapiens
atgcccttgactcacctaaaatgttatcaactgtctggatgtgacatttcagacttctaaacaggaggcatatcaaaacaggccttttgcctattcatgaggttgctagcctgataaacaacatcctcatagagccacactaacacaccttgacctgcactggagtattcaggagtagctaggtaccagcagcggacacagtgtctaggcaactaggagctac

SEQ ID NO: 688208 - DNA, 901 bp, Homo sapiens
agccaaaccatttacccatataaagtataggcgatagaaatagatacctgtggcgatagatatagtaccgcatgggaacgatgaaagaattcatagccaagcataaatgaatagtcaaggattaacccctataacttactgcgataatgacttacgtagaaataactttgcgaaggagacgccacagcaaagtacccccggagagctccagatcgatgctgaacctcatgtacacaggctaatgaggagcatcacccagttccttattgatacgtcgccatactatgtcgtgagcaacgatttgatacgagtaggcagagcacgatcaaaagcgctacctgatgcctgcgtcgatagctcggtgagtccataggaagttaggaaaattctcttacgcttgcagacgttataaatacttatgggccccaaggagatatcccacttactgacataattgctcccctttgtccgaatagttggtgaaccgtggtttaaagttccccacataggaaggggagacccaagcatgcttatgggaccaaactcagtggacataataaccgcttctgtcagccaagacgcaagtttagggcgcacatgtcaaccgtcaagcccactacgttacgagtcccttgacagcagcaggcgacgtcaccatccaaaatttatagagagaaacgccgattcccataggacttccagaagagtcctctatatacttctacaaccaaaactctcccatagagcaatttattacatctgaatacgttcccctccaacgtacgccaagaattgtgcacaccacattccttatttcactcccctattcagcaccgcagacggtacatcgctacagagttcattacagttaaggaatggacaacacatcatttcatttcgt

SEQ ID NO: 688209 - DNA, 1234 bp, Homo sapiens
agctggtccgtgctaaaacgctttattcctaactgctgggcacaatttccaactcccagtgagctcttcaaaaaactctctctcttcttggcaactactacttctttctctcagttggattacattacattagacacaaacgctcatatgacaccttgccctgatatggcattgtgtaaccggtaaccttaacacattacctgtcaactgggcattcatataattccacgttgacacgtggttctctgactgttgcatttgtgttacttctccttaaggttgaatatgtgcatctcataatattcacaagaagcgaggccgttcttaaaaactccaaagcttcgcttttccaggctttttacactgtcgcactaatacgtgatatcgtcagtacttacacttctgctcccttccaccgtggtattatttacaggtgtgtttctcaaataattgtgtgcacaaaacacgctctaactctttccgtggggcggcatatttgggccatttaaacacagggggccctattccatcttctttttactttaccagcaggtttggcacacacactccacttgggggttataacttgtgcacaactcttctccacgcgccacagggtgcacttcacacaccgtgggttataacgaggttggcttcatttccttacaccaatagttaacgctaacatcttactttcaacagtcgttcacagcagactttgcccatcttacttctggggcaccaacaaccaaacccacagggtggtctttctgcataacttccccataacttggcgcactttgctccaacatcgtcactctttcgggaaatttttcaaccgcgacacactcaccggctgggttctcacaacacaactttttccccttaaaacacgtttggggctatcctagtgaaactgttggccttatcgacattcatattaccaaccttctgcggcatccaagcagcaacagttgggtttgcacaacttcctcccatgcattaaccttgtcccttttataaacaacgttttcgtaccaccgcgcttcaacccgggccgttcaatatagtttggcacgggaacaatacaaacatcaactatcgaaccctactacactacatcatcacaacacacataacagaacacaccacctattgttgtgttctcggtcacgtgcgtatctagttctggcacccatcctcagacaacaagcagctctacttactacgaaga

SEQ ID NO: 688210 - DNA, 177 bp, Homo sapiens
  misc_feature (168)..(168): n is a, c, g, or t
gtcacctaaggacgctgtctgctctgatcttttataagaatagtgtgggctgggcgcagtggctcatgccgcaatcccagcaccttggaagtctgaggtgggcggatcaactgaggtcaggagttcgagacagccctggccaaaatgtgtgaaactccggtctctacntaaaaaaca

SEQ ID NO: 688211 - DNA, 154 bp, Homo sapiens
catggcccagcgcccccctgcggctcgcgcccgggtggggccgtgctgccatgctgctcccctcgggcctgctcttgccggggtccatccggatcgttgagccatccccatgttgccaattgcgtcacacacccacccacccggcccgtcccgt

SEQ ID NO: 688212 - DNA, 958 bp, Homo sapiens
cttcgtgcgtcacgtccttgtctttacgttcgcctgtttttgcggcgtcgttagcaggcactgtcttgcgtggcccttgccttgtcgaacgtgttcgtcgattccgattctgccccgcctcgaattgcctgcccttggtttggtggttcgccttgttcgcccgtgtgtgcttggacatcgtgggcgcctgtcgagccttctccagagcacggccgtgtttccccacgcctccctggggcccacactatccgtctacggcccacccaatgtgtacaggggcccgcctatgatacccgtggtcattatagagggatccccaccccttttgggacagaatcttttggatggcagctccccaattatgtacgcacccttgtagtttaccggtgtaggagtagttatccgcagaagcttatttaaaggtaagtaccaacatagacgtttgtcctgaatgtggtcacctgtgtacagaaacatgttcctttgtggcctactgctatgaaaaggtgtgtcataggatgactgcagaaatcagacgacagatagggtactccagaagggggcccttttaaggcttccaccatagagactgtggtgctgtacacaggagagacaccgtctgttacaagatcagggccagaggatcattgtgacgagacagaagcgaccatcctggttcacccagaattgacacccaagatgttaaaaggataacttcacagtaaatcatgttctcctgaaatagaggaagattctttacgttgttgttgcttgtttttataatcatcagtatagtttaacacattcttttttaagcagttttgtgtgggataatttgaagatatattatgagttactccgaaaattttgtttatcccaaggctccatggattatgtttctattatatacacaggttttaagtaaacattaaatttcccggaccaaaaaaaaaaataa

SEQ ID NO: 688213 - DNA, 259 bp, Homo sapiens
ttttggggtctttgctcgcttcaaccgactgctgtcaccttcaccgttccagtttttaaatcctgagtcaagccaaaaaaaaaaaacacccaagccatcccaaaaaaaccaattagggccaccccgttcccattttttttcttgcccaagtaagattttgaaaaaaagggtgtaaccccaataaagcattatcccgctaaaaaccttttctggcgaacaatgtaggggcggatctgaaaatccttctgttgcttgatca

SEQ ID NO: 688214 - DNA, 745 bp, Homo sapiens
ctgatgtccgccgagcggtgactattctctacaaagccacaaagagcattggaacagtatacctataattcgtggcatgagcgggagtcctaggcacagactctaagcctccttattcgagccgagctgggccagccaggtaaccttctaggtaacgacgacatctacaacgtaatcgtcacagcccatgcgtttgtaataatcttctgcatagtaatacccatcataatcggaggctttgagtatactgagtagttcgccctaataatcggtgcccccgagtatggcgttgtccccgcaataaacaacataagcttctgagctcttacctccctctctcctatctcctggctcgcatctactatagttggaggccggagcaggaacaggtggaaccaggtgctagcctccacttagcagggatattatcccaccaatgaaagcctccgtagaccgtaaccatctttctccttacgacctagcagggtgtctccctgctatcttaggggccatcggatgtgcatcacagacaattaatcacgtatagaaaccccttgcggataaaccgaataccaaatgacgctcttgcgtctgatccgtcctaatcacagcaagtcctacttcttcctatctctccaagtcctaagctagctgagatcaccttgactagtaacagatcggaatcttaaacaccttgtttggacccggctgtagtcggtggccccattgtatagaggagctatgg

SEQ ID NO: 688215 - DNA, 496 bp, Homo sapiens
  misc_feature (471)..(471): n is a, c, g, or t
ctcgtgccacccaagcagtgtacactgtacccaatgtatatttatccctcacccccctcttatcctttcccccgagtcctcaacacccattgcattattcttatgcctttgcatcctcatagcttaggtcccacttatgagtgagagcatacggtgtttggttttcgattcctgagttacttcacttagaataatggtctccaaatctatccaggttgctgtgaatgacattatttcattcctttttatggctgagtagtattccatggtattccatggtatatgtatgtgtgtgtgtgtgtgtatatatatgtatacacacacatatatatatacatatatatacacacacatatatatgtatatatacatatatacgtatttacgtgtatatgtatatatacatatatacgtatttacatatacacacacattattccatggaatacttttatatatatatttatattntctttatccactcatcgattgatgg

SEQ ID NO: 688216 - DNA, 474 bp, Homo sapiens
gaggtcagagtgactccacatactgttgaaattggggcacagcgggctagtgattagtcaggatcaatcagtggagaggagattaaactcacatctggagtccgaatcagaacttgagttcttttttttgaaatggagtctcgctctgtcgcccaggctgtagtgcagtggcgtgatctcggctcactgcaacctctgccttccgggttcaagcaattctcccacctcagcctcctgagtagctgggattacaggcgcccaccaccacagccggctactttttgtatttttaggagagacggagtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccc

SEQ ID NO: 688217 - DNA, 347 bp, Homo sapiens
gttcagtagattccttctggccacggaatctgccggtgcacatctagatttcaccggccgccatctactgtaccgtagatttcatccggcaggacctcgagcagtgaggagctggaggacatgctggtagagtgtgacccccgtccatctttgcctctgggatcatcatggagctccagcatctcgaagcaggctctgagcgagattgagacgcgtcacagtgagatcatcaagctggataacagcatccgctgagctacaccacatgcttcatggacatggccatgctcgtggagagccagggagagatgattgacccggaacagtacattgcggtaggattggtg

SEQ ID NO: 688218 - DNA, 403 bp, Homo sapiens
  misc_feature (323)..(323): n is a, c, g, or t
gaatgtatagtgactatatgtcagagatttacttacttcattagtgagaaaaccagtaggcagatcaagtcagttcacagagtatttgaggaacaaagatttatatggtcagtcaggaaagggaggttaaaaaaatttgtttaattgggttcaaaactgattaagtccctccaggccatacaactacaatgcttgggattatcttttctcccagagatatatcattccctccttacccagataagtccccgtgacccctttctaaacaaaatcacctttcctctgccctttttttcccaaaaaaataaactctcccccccccnctcccccccgtgtgattgacatgtttattacttttattgtagtgatggtttcatggcaatatacatatgttaaaatttaa

SEQ ID NO: 688219 - DNA, 107 bp, Homo sapiens
agtgattagaggatcccctcccttcacaggcaaatgatgtgccagcatcagctactaaaataaacaagcaaaacactccgccataagaatttttttggcatttatgt

SEQ ID NO: 688220 - DNA, 91 bp, Homo sapiens
cggtccaacgttggatccgattcggatccaaccggatccaacgttggatccgaattcggatccaacaccaatctgaagtgggagcggccgc

SEQ ID NO: 688221 - DNA, 151 bp, Homo sapiens
aagcctgcggtattctaccaggcttgtcggacaacttctaggtgggcactgtgcggaaacttgaggataaatcagggagctgcatgcacttaaaaggcatggcctgtctcctcacttaagtgcaggtccatcgaccaaagccctgtactag

SEQ ID NO: 688222 - DNA, 369 bp, Homo sapiens
tcctcctagcgggcctagctgggtctgtagcacatcttgctgtgtggggatgtagtcactctgtgcgatactgctccagtgtcgttcaggtagtagtgcagctgagtacgttgagcttggtattcccattgagacggacaaatgcaggcctgacacaaccatgtgtcagccctagagcctcctggatgacgcctggacatggtcatcagtggagcacgcacttgctcctcaggtggtgcaggacagtgcaaatagctgactggcgtcgtccgctctggaggggtcggcaaagtcgatctgcaggttgcccatggctttgacaatggccatgatggactggatggtgtagctgtagacaaccgcccggta

SEQ ID NO: 688223 - DNA, 273 bp, Homo sapiens
  misc_feature (4)..(5): n is a, c, g, or t
ggtnntgtgatgatcgttgatgtttgggtatgagaccgtttcagcggtattgaagtgtgccggctgggatctgggtccgagaggagagggtatgcactgcgcaaacatttcaagagtatacgagcaagcgctgttatggtgagaaatgttagcgcttttgcgccgtaaacgtgtatggcctttgttctgcgctgctgaagtgttagctagatgatatttatatttgatgcttttaaggctttgattaatcactcttatacttgcctggaacat

SEQ ID NO: 688224 - DNA, 432 bp, Homo sapiens
atcatagctcactgcagcctttacctcccaggctcaagcaatcctcccatctcagcctcccaagtagctgggaccacaggtaccagccaccacgcccagctaactttttattttttgtagagacaagggtctcactatgttgcccaagctggtctcaaactcctgggatcaagagatccacccacctcagcctcccaaagcgctgggattacaggagtgagccaccaagtccggcctggtgtgggcatgtatttattttgagatagagtcttgctctgtcacccagactggagtacagtagtaggtatgtatgcatgtagtaggtatgtatacatgcatccatgttttttttgttttttttttttttgagacggagtcttgttctgttgcccaggctggagtgcagtggcacaatcttggctcactgcaacc

SEQ ID NO: 688225 - DNA, 899 bp, Homo sapiens
  misc_feature (624)..(624): n is a, c, g, or t
gagcggcggggggcgctgcgcccggctgtccggcctccgcgctccgccctcgtcgccctcgcgccgccgggcgggcgctcgcgcgtggcgtggggggaccaggggctgatgcgcgggtcgccagggacaggtgcgccaggggtgcgctggttcgagtgagcgcggtaaaggtgacggccgaaggcctgcgtggcctcgaggccgcaggggggagcctggggtcagcgaacacgtgacgagaagagagatagaaacgccggagagaaaagcgttcgtcgtaggagtggcaccgggaactgcacgagtggacctcgaggacgaaggcagtggactagaaagggccccgatgaggggaagcaaacgacggaatgccagcgcgatcgcgatcacaacgaacgaaggtcacgcacgggttcccagtgtgcaccactggcgtactgactcccgcatacttttcggaagcgttccgttcgcgtgcctgttacatcacaggtgaccgggaccggggacctcagggcaactgagcagaagattcccgactgaggacaacgaacaacaaaagtagcccaaagggcaaagcaccaaggtgccatagggcatcgagaagcgccactccccagaggnacgagccacagggcaaagtgcgaacaacgcgcgcacatgcgcgcaaaaaggggcactgggacacccagtcaaactcaaccaaacgggaataacccacgtgagacccaaaggcggcgagccagggcaaagggtcgactggcaaccacacgggcgccgtccgggcaacacgcgagggtcaccctacgctgcacagtggcgcgaaaccgcaaacacgctccgcacgggcatttcgtgaagccaaagaaaagaacccctgggccgcaaacacaccaaac

SEQ ID NO: 688226 - DNA, 239 bp, Homo sapiens
  misc_feature (181)..(181): n is a, c, g, or t
aactaaccagaggatccccccgccgccccgagcgggaagagactggagatgaggaggatgggagcccatcggaccacccagccttctgggccctccccccatggccaatgggaaacctggcgaccctaagtcagccccaaactggataccacccacatgtccatcatcagtagaatggatnaataaattgtcgtgtatgcatgcaaagagactacactgcaacgaaaaatgaatgaact

SEQ ID NO: 688227 - DNA, 212 bp, Homo sapiens
  misc_feature (81)..(82): n is a, c, g, or t
  misc_feature (134)..(134): n is a, c, g, or t
  misc_feature (152)..(152): n is a, c, g, or t
  misc_feature (156)..(156): n is a, c, g, or t
atcaattggctatatgggatttaggataaaggatatttacaataaagaatatttacaatagagagtttattattatttgtnngtgtgagcaacaaacataccctttatctctgtaaaatttatacacacaaaanttaacaagagattctgtnaganttaattggctatatgggatttaggatagactatttacaatacagagtatttacaat

SEQ ID NO: 688228 - DNA, 538 bp, Homo sapiens
gctatgtgaaccaggcaggatcaccgccttagtatgatgctctcatggtactgcaggcggagcatggcaaacttcattgttgaggatgtgcatggacactatgaaggcaatcccaagctcaaccaggagttctccgatggcacccgtactccatcaaagaacacctctggtgtgtttgaagccttgatggccatcttcttctcagggggccactgtgtcagggcagtgtgggaaagcagaggtgtgttcaacaggttgtcactgggggaaaaactggtccttcggtccttatgcaccagggaggaatgacgaccactagactattagagggtacaggcaacaattcccctcaggccctgagggctaaggaggcctggctatgtcctattttgtgttggacttggttgctggacgcaaaactttagctcaggtgcatacatattagtcccaaagggcacattcagtccaacttctttgggttttggacacgtcccccgggtgacttgcaacaggccatctggccaggaggccagtcctg

SEQ ID NO: 688229 - DNA, 114 bp, Homo sapiens
aggaaacgggagtaaacggagagcgtagtgacccatcatgaggctctccacaagcccagagtgagatgaccccagagagctgcagcagcgagaggaggagggatttaacaaccg

SEQ ID NO: 688230 - DNA, 435 bp, Homo sapiens
gtattcattccacatacaatatctgtttaaaacgatttcctgtataagtagctttaatgtttttttctctagaataccgtagtctatccttatatcatcactccatgctttcttccgtgggttttaaacttcatataactttcataaattggatatcaaaaattttgcttgtcactgcacatcaatataaaaaatcttatttaacttatcaaaacgtatttattgccaaactatgcttttttttgttaattttgtcatatttacgggatgacaaaccatagaatatatctttatgttaatatgactcatataatcttaaatttgtgtcggcttttccttttttccacagttttaatatattattctcaactacatttttttgaactttacacttttttggttattttattttaaaaaaattgtaaattaatttaa

SEQ ID NO: 688231 - DNA, 389 bp, Homo sapiens
cgtagcaactggtatggtcttttccccaaatgtctaggcatgccgcgacgacgtgatcgaggaccacgtaatgcggcttaattggagtggttagtacgattagtcgcttaggggtcgttcttcgttcccctccccgcaaagataagacttccgggagccccaacctcgccacgcatccgtttcgcggggttcttatcgtcccctcacgggagatatctccaacccaatagacgagaacacccccaaatctcgaaaacaaacaacaccacataatgcaaaacctgagggggggtttggcatttaacccgtttcacagcgagctgaaccataacctatcggttgttgccccataatgctgcgatcgggtttcggtcccattcatccctgtg

SEQ ID NO: 688232 - DNA, 168 bp, Homo sapiens
tgactaccgactccccacaaataaaattcccttggccttgaggtctcggcaccgtcttgatggtgtccctcatattcagaaatatcctaccgtcaactgactgatgtcaccaagtatccaaacaatggtaccaatttactcgactgaagatcataccaccagcttgac

SEQ ID NO: 688233 - DNA, 261 bp, Homo sapiens
gacaagaacgggttactcgtgctcagtcttagaccagatcgtgggtgcatcatccgtccagcgtcggccttccgttccgtccaggaacctctttggccatctggcgctcacctttttgcatcttgacctcggacttcagacaaccaaccgcattcattaaactatcaatcttcttatcataacaggttcattttaccagtagaccttgagtcataccatctatctgtaaattaggtcacatataagtcgacatcactgatg

SEQ ID NO: 688234 - DNA, 994 bp, Homo sapiens
  misc_feature (340)..(340): n is a, c, g, or t
cagttggcgccctaccgtgcatagcgtgaagtggagctcctcgctggctgccgatcggggtctgcagggctcgctagccgctcacctgcgtgtgacgcgcggacgcccgcagtacccgccgtcctgggctcagagcgacgtgactccccgaccctgctgcccggtcacctccccgggggtccgtgcgcccggttccaggcgtcggaggtccagcccacgcggcggctcatggcatgcgcgcctggctcccagtccatcattgtttccccacttggttaaagctagttgactggtggttgctggacggctttctgctggacatgatgcctttgggctccgnaggtctgcagcgggtaccggcatgctgcccgctaccgcctgatggggtagggcgggacgcttggtactcttctgctgacacgctgccctcaggttcctctgtccccggtgccctcgagagacgtggtcgtgcgtgtcgtcctggcgcggagccccagtagccgggttcgtgcgcgtggactggcgctgtagctcacgctggtccgtgggccgctgggatggagctcgcggcctggcactgtgtcctactcgacttgcttcctgggtggcacgtcccatcgagctgccacgcctggaacaaggaccgaagccagatttgcccatcttgatccgaacagagccagtggagtgtgcatagtcgtaatgagagaagagcggtgacaacatggtcccaaggttgcacagagcttcgaacgagctacaacagggcaggttgacaggcagtcgactgggccaccagaagagtaaaccgtcattgtgaccctgcgtgcacagagccgcatcgccttacgttgttggactgctgaagggggccgcaatatggaaggcccacggctgggtcatccctgcgggatccaaccgggctgcccgctgcgttcgcttggcccccaaaggagaacgagttgctggtggccagcgggtctccgtgtgtccc

SEQ ID NO: 688235 - DNA, 150 bp, Homo sapiens
tacccggccatagtacgaatagacggaatgccgtcctggaatgtttcgcgtggtaatgggtgtgcagttgggccaggtcgatcatatagcggctgtaggcggcggtatcggagtccgtcgccgaggtcagccagtccgggagttgttggt

SEQ ID NO: 688236 - DNA, 103 bp, Homo sapiens
cggtgactctgaggatcccactgccggtaagaggttgagagggttgttgaaggccccgcccaggcaatgagcagaggaaccatgatcgtgggtgcagccactg

SEQ ID NO: 688237 - DNA, 319 bp, Homo sapiens
caccaggcgcacttcttgactcacactaagtgtagcactgtagtactaaagacatcgttgagaaactgtaggctatcaccatacattggtcatctatcggagttgtggccaacggcaatataaaataccttagctaccttataccctgtatgcatttcataccatgatcaagtctctaatgacagcccagttctcatgcttatctctggctgcctattgagactggccccactacggtggggactggggatggggacacacatcagtgcccaagcttcattctacacctccccccttcagccagaagtgcgcctgggtg

SEQ ID NO: 688238 - DNA, 1134 bp, Homo sapiens
  misc_feature (5)..(5): n is a, c, g, or t
ctcangcaagctgtgcagtggtggctactgcctgtaggtattttccagtgactgaaagaggctgctagtggtcgggattagatatcatctgatgtcctaaaaagactgaacccttcatattccccagaagaataacagctgttccccacctcccacacatctgcatcaagctgaagttctgtgtcctcgtgagctgatttcacctttgcacagatcttgggggaggtgatgacaatacaccctggacctcaactttctctgtctgaagctgcagggggcccctgaagggtgggggagatggcaggcccaccaggataccctgtgctgatcaatcctcttctctcttctccagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagttatctgtattctgaactttcttaattgagaagaggcaagaaatcactgcagaatgaaggaacatcccttgaggtgacccagccaacctgtggccagaaggagggttgtaccttgaaaagacactgaaagcattttggtgtgtgaagtaagggtgggcagaggaggtagaaaatcaattcaattgtcgcatcattcatggttctttaatattgatgctcagtgcattggccttagaatatcccagcctctcttctggtttgctgagtgctgtgtaagtaagcatggtggaattgtttggggacatatatagtgatccttggtcactggtgtttcaaacattctggaaagtcacatcgatcaagaatattttttatttttaagaaagcataaccagcaataaaaatactatttttgagtcta

SEQ ID NO: 688239 - DNA, 1346 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccaggtacatcagatccatcaggtccgagctgtgttgactaccactacttttcccttcgtctcaattatgtcttggaagaaggctttgcggatccccggagaccttcgggtagcaactgtcaccttgatgctggcgatgctgagctccccactggctgagggcagagactctcccgaggatttcgtgtaccagtttaagggcatgtgctacttcaccaacgggacggagcgcgtgcgtcttgtgaccagatacatctataaccgagaggagtacgcgcgcttcgacagcgacgtgggggtgtaccgggcggtgacgccgcaggggcggcctgatgccgagtactggaacagccagaaggaagtcctggaggggacccgggcggagttggacacggtgtgcagacacaactacgaggtggcgtaccgcgggatcctgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaacggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagtta

SEQ ID NO: 688240 - DNA, 143 bp, Homo sapiens
accccttttttttggttttttaacccccggagcccggttttcggttttccaaaacgccttttcccattttatattggggtttttccccgggttcccgccacccctttttgggtttaacccctttgcccctttggaaaagggga

SEQ ID NO: 688241 - DNA, 902 bp, Homo sapiens
gtggagacgcgctggcgtcctctgctgagcagccagcggaactgtaccatcgccgtccacattgttcatatccaactgagaaagagatatgtgctcggtagcatctgtctgctgacgcatcggtatcgcagtccatgtaacagatacatacctttgacatcacctgaaggggaaccgtgtggtctctcttttaaacggggacctaggttgtcctcggtgaatctgggggacgcgcctgaagtagttgaaggtacggcgagtagagagttggtagtctgtaaggaacaatcaagacgcatgagtctggacctgacatcgacccgcaagaattctcaggattcgagatgtccgtggacaacacggtggttgagctgaaaaggtatagataagcaagggaaagcagggatgtctcctacggtacatatagcagatgacctgaatcctattgcggaatgacgtgtgaaaacgctgtgggggatggtgcatgaaggtcaaggtttgcaatacgtaaaacccagtttcaacattggagggctagctgtctgggatgctgcgatcagtttggatgcaaagaactgaataagttagaagtataaagggtgtaatgtgggcaagtgcgtgtgggggagatggcgcaagcatacatgatttgggtgtggctttgttcatatccagggtttcgctttgatgcaggatgtaaggcatgaagagggggtgtcaggattgcttgatatgatcgccgtccgttatgtgcagagggagactgtctcgaaagtagtatcgatcgttagggggtaggaggtgaaaggtggcatgtagaatggtgtacagcattgggtgataattttgggtcctggaaattgtcttggattgtacgaaaataaatgtgtcgttgaattgac

SEQ ID NO: 688242 - DNA, 1752 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccaggtacatcagatccatcaggtccgagctgtgttgactaccactacttttcccttcgtctcaattatgtcttggaagaaggctttgcggatccccggagaccttcgggtagcaactgtcaccttgatgctggcgatgctgagctccccactggctgagggcagagactctcccgaggatttcgtgtaccagtttaagggcatgtgctacttcaccaacgggacggagcgcgtgcgtcttgtgaccagatacatctataaccgagaggagtacgcgcgcttcgacagcgacgtgggggtgtatcgggcggtgacgccgctggggcggcctgacgccgagtactggaacagccagaaggacatcctggagaggacccgggcggagttggacacggtgtgcagacacaactacgaggtggcgtaccgcgggatcctgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaacggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaaggacctcaagggcctccaccagcagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagttagaaatcactgcagaatgaaggaacatcccttgaggtgacccagccaacctgtggccagaaggagggttgtaccttgaaaagacactgaaagcattttggtgtgtgaagtaagggtgggcagaggaggtagaaaatcaattcaattgtcgcatcattcatggttctttaatattgatgctcagtgcattggccttagaatatcccagcctctcttctggtttgctgagtgctgtgtaagtaagcatggtggaattgtttggggacatatatagtgatccttggtcactggtgtttcaaacattctggaaagtcacatcgatcaagaatattttttatttttaagaaagcataaccagcaataaaaatactatttttgagtcta

SEQ ID NO: 688243 - DNA, 205 bp, Homo sapiens
aattccagcttatcttcatcacttgctttaaggtgtgaaagatgctctaatacttttgccagagcctctagttcctttaaggtctcatgcctgtctggatggtgctgaatcactttgccgaaagcatcatattcttggcgatgttattcgtattcgttgtgcttgaagaattgggtttttgcactcagcaccatccagacaggca

SEQ ID NO: 688244 - DNA, 196 bp, Homo sapiens
  misc_feature (16)..(16): n is a, c, g, or t
tcagctcgtacacatnattgtcacgctcttgacgagctaggtcagaacaccacgtctgccccaagccaatctagtgatgacctctgaacgggctccctccccttacctctagtaatgggccagtgctccttcacagtctcttctccctccagacacagtgggatcctactagtagatcgacctagcagtgcatagc

SEQ ID NO: 688245 - DNA, 716 bp, Homo sapiens
  misc_feature (5)..(5): n is a, c, g, or t
ctcangcaagctgtgcagtggtggctactgcctgtaggtattttccagtgactgaaagaggctgctagtggtcgggattagatatcatctgatgtcctaaaaagactgaacccttcatattccccagaagaataacagctgttccccacctcccacacatctgcatcaagctgaagttctgtgtcctcgtgagctgatttcacctttgcacagatcttgggggaggtgatgacaatacaccctggacctcaactttctctgtctgaagctgcagggggcccctgaagggtgggggagatggcaggcccaccaggataccctgtgctgatcaatcctcttctctcttctccagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagtta

SEQ ID NO: 688246 - DNA, 1764 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccaggtacatcagatccatcaggtccgagctgtgttgactaccactacttttcccttcgtctcaattatgtcttggaagaaggctttgcggatccccggagaccttcgggtagcaactgtcaccttgatgctggcgatgctgagctccccactggctgagggcagagactctcccgaggatttcgtgtaccagtttaagggcatgtgctacttcaccaacgggacggagcgcgtgcgtcttgtgaccagatacatctataaccgagaggagtacgcgcgcttcgacagcgacgtgggggtgtaccgggcggtgacgccgcaggggcggcctgatgccgagtactggaacagccagaaggaagtcctggaggggacccgggcggagttggacacggtgtgcagacacaactacgaggtggcgtaccgcgggatcctgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaacggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagttatctgtattctgaactttcttaattgagaagaggcaagaaatcactgcagaatgaaggaacatcccttgaggtgacccagccaacctgtggccagaaggagggttgtaccttgaaaagacactgaaagcattttggtgtgtgaagtaagggtgggcagaggaggtagaaaatcaattcaattgtcgcatcattcatggttctttaatattgatgctcagtgcattggccttagaatatcccagcctctcttctggtttgctgagtgctgtgtaagtaagcatggtggaattgtttggggacatatatagtgatccttggtcactggtgtttcaaacattctggaaagtcacatcgatcaagaatattttttatttttaagaaagcataaccagcaataaaaatactatttttgagtcta

SEQ ID NO: 688247 - DNA, 1804 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccaggtacatcagatccatcaggtccgagctgtgttgactaccactacttttcccttcgtctcaattatgtcttggaagaaggctttgcggatccccggagaccttcgggtagcaactgtcaccttgatgctggcgatgctgagctccccactggctgagggcagagactctcccgaggatttcgtgtaccagtttaagggcatgtgctacttcaccaacgggacggagcgcgtgcgtcttgtgaccagatacatctataaccgagaggagtacgcgcgcttcgacagcgacgtgggggtgtaccgggcggtgacgccgcaggggcggcctgatgccgagtactggaacagccagaaggaagtcctggaggggacccgggcggagttggacacggtgtgcagacacaactacgaggtggcgtaccgcgggatcctgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaacggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagttatctgtattctgaactttcttaattgagaagaggcaagaaatcactgcagaatgaaggaacatcccttgaggtgacccagccaacctgtggccagaaggagggttgtaccttgaaaagacactgaaagcattttggtgtgtgaagtaagggtgggcagaggaggtagaaaatcaattcaattgtcgcatcattcatggttctttaatattgatgctcagtgcattggccttagaatatcccagcctctcttctggtttgctgagtgctgtgtaagtaagcatggtggaattgtttggggacatatatagtgatccttggtcactggtgtttcaaacattctggaaagtcacatcgatcaagaatattttttatttttaagaaagcataaccagcaataaaaatactatttttgagtctaaatgatagaagcccaaatatattttgttcatggtaaaaaa

SEQ ID NO: 688248 - DNA, 840 bp, Homo sapiens
gctcgcttattcacttctgctggaacgacaggacgtgcgtgggaacgtggaagacgacttgatcatcttccctgacgactgtgagttcaagcggggtgccggagtgccccagcgggagggtctacgtgctgaagttcaaggcagggtccaagcggcgttttcttctggatgcaggaacacaagacagaccaggatgatggagcattgccggaaagtcaatcggagtatctgaacaagctccccgatgcgctggggcacttgggggccagcggaagcagcgggcacgaactcgtcttgccgctagtgctgagtgacgggtggcgctgctatgagccttgctgggaaatcatgaagccacaagccagcgtcatgcagcgtcattccggaccacgccgtggctacggagggacgtgggttggtgcgtgggggcccttgtcttggacctgggccatgtgccagcttacatggtggaagcagttggtgcctccaggggatgcagctccttcctccagactcccggagcctgtcggcagcaggtcacgcccgtcatccaccgaactcatttcacccgtgcctatctccagtcccttactgctccagcgagcgtgactcgagtaagataacccggagccctcgagccacagttaccgggaatggagccagcactagcaggcagcccgacccaggccatccagcatgaacgagctccagagcatcctggccacgatgaacgtaccagccgggccagcaggcggcagcaagtggacctgggcagtgtgctgacgccggagatatggtcccatctcgccaacgcggatgtccaggatcgcatgttcccta

SEQ ID NO: 688249 - DNA, 767 bp, Homo sapiens
taataaagcaaaaatcaggctagtacgaggctccgtgtttatgatggctacatgctctcatcagctgctctagtacagtggggctcagtgtcctgcgtgctctccgacaccaccccacttccattttggccaaaccaaccgcacccctgaatttctccgcaaatttcctgaccgtgacaatggtcccagcatttgatgggtgatgataggatatcttgtgtgttttgagatgcaacgccattgcctactattgtgagcaatgagtgagctgcgtgtggaagtactccagagtgcagcagcccagtgtggttgcagtgggttgagctttgctcgattcctgatatagtgcccccagccagtacctgtggtgttccccacctatgtgtgcatcatgcaccacaccaaacatggccactgatgaatgcaaagtgatgtgaacgtgatggctgaattcttgtgtggcttgctgtgatgcattacttgaatgacgagttgacttattctagtgctgggcgaacgagtgacattggctgacatacacagtttgtctgcaaccctgtatgtaggctctataagcaggttctagagccttcttacctgccatggccttttcacccaataccaaccgctggttcctcacactgcattaaccagccccagttcctgggctgtcttgtggcgatgtgaaactgtgtgagcacgatggccagtttgatgctacaacagtttgcatgagatccaaactaaaagtgaccacaatggaatgc

SEQ ID NO: 688250 - DNA, 1828 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccaggtacatcagatccatcaggtccgagctgtgttgactaccactacttttcccttcgtctcaattatgtcttggaagaaggctttgcggatccccggagaccttcgggtagcaactgtcaccttgatgctggcgatgctgagctccccactggctgagggcagagactctcccgaggatttcgtgtaccagtttaagggcatgtgctacttcaccaacgggacggagcgcgtgcgtcttgtgaccagatacatctataaccgagaggagtacgcgcgcttcgacagcgacgtgggggtgtaccgggcggtgacgccgcaggggcggcctgatgccgagtactggaacagccagaaggaagtcctggaggggacccgggcggagttggacacggtgtgcagacacaactacgaggtggcgtaccgcgggatcctgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaacggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaaggacctcaagggcctccaccagcagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagttatctgtattctgaactttcttaattgagaagaggcaagaaatcactgcagaatgaaggaacatcccttgaggtgacccagccaacctgtggccagaaggagggttgtaccttgaaaagacactgaaagcattttggtgtgtgaagtaagggtgggcagaggaggtagaaaatcaattcaattgtcgcatcattcatggttctttaatattgatgctcagtgcattggccttagaatatcccagcctctcttctggtttgctgagtgctgtgtaagtaagcatggtggaattgtttggggacatatatagtgatccttggtcactggtgtttcaaacattctggaaagtcacatcgatcaagaatattttttatttttaagaaagcataaccagcaataaaaatactatttttgagtctaaatgatagaagcccaaatatattttgttcatggtaaaaaa

SEQ ID NO: 688251 - DNA, 367 bp, Homo sapiens
gatggtcaccagagccaatggaaaggggctgccgcgcgccgtaaagagttgtagaggcagttcgggtgcggtacgttgcattccggtaccgagccgagagcggttgtctccgtctctggagtgcaggcgagaggtgatcatgtccggtcgcgggaaaccaggcggcacaagtggagcaaaggccaaatccgttcttccgggcggccttgcaagttccccggtggccgtgttgccaggacttgctgggacaacagggacctacgcggcaggcaatttgggcccgtgcgtcgccggttttcacctggcagggatgtagacacataccctacagggcgacaaattttcttgacttgcttgacaaacagca

SEQ ID NO: 688252 - DNA, 1370 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccaggtacatcagatccatcaggtccgagctgtgttgactaccactacttttcccttcgtctcaattatgtcttggaagaaggctttgcggatccccggagaccttcgggtagcaactgtcaccttgatgctggcgatgctgagctccccactggctgagggcagagactctcccgaggatttcgtgtaccagtttaagggcatgtgctacttcaccaacgggacggagcgcgtgcgtcttgtgaccagatacatctataaccgagaggagtacgcgcgcttcgacagcgacgtgggggtgtaccgggcggtgacgccgcaggggcggcctgatgccgagtactggaacagccagaaggaagtcctggaggggacccgggcggagttggacacggtgtgcagacacaactacgaggtggcgtaccgcgggatcctgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaacggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaaggacctcaagggcctccaccagcagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagtta

SEQ ID NO: 688253 - DNA, 701 bp, Homo sapiens
tgttctttcatttgaactgcattcccactggcccttgtaattccctggtgttgctatcctcctatcataactgcctaacaaaacctcaaccatggcttaaggctgcacctagctcttttcaatcctatattgtgccaattgcatagtactaggtaaatcagactgtgaagattatgtagtctacaaattcatggccttgatcttagtcaggctcctagccctgaaggcacttcttttgtgtttcattccctcttccattacgatattccagacctttaccactctcctcaagatgcctactgagtccctgcccctccatctcctttcctatgacctcaagcataaggtgtccctgctccccctaggtcctggattccattttctcctaaatctcactcttctgtacctttacctcttttactttactggatccttcagcttcactcccaagttttccccattccaaagaagcaaagaaaataaaactttctcttaatcctctgtccttctctatctaccatcccatttccatgcttttcaattaaaactttccaagaagtccaaattaccacttcccagtcagttctctagtcacggtaatctggcttctgtttcactgaaaccacttttacccaaggccacctctaatttccaaatctgctgttcttgatagactataccctctctctttaaaacattct

SEQ ID NO: 688254 - DNA, 1697 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccaggtacatcagatccatcaggtccgagctgtgttgactaccactacttttcccttcgtctcaattatgtcttggaagaaggctttgcggatccccggagaccttcgggtagcaactgtcaccttgatgctggcgatgctgagctccccactggctgagggcagagactctcccgaggatttcgtgtaccagtttaagggcatgtgctacttcaccaacgggacggagcgcgtgcgtcttgtgaccagatacatctataaccgagaggagtacgcgcgcttcgacagcgacgtgggggtgtaccgggcggtgacgccgcaggggcggcctgatgccgagtactggaacagccagaaggaagtcctggaggggacccgggcggagttggacacggtgtgcagacacaactacgaggtggcgtaccgcgggatcctgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaacggtgactggaccttccagatcctggtgatgctggaaatgactccccagcgtggagatgtctacacctgccacgtggagcaccccagcctccagagccccatcaccgtggagtggcggagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagttatctgtattctgaactttcttaattgagaagaggcaagaaatcactgcagaatgaaggaacatcccttgaggtgacccagccaacctgtggccagaaggagggttgtaccttgaaaagacactgaaagcattttggtgtgtgaagtaagggtgggcagaggaggtagaaaatcaattcaattgtcgcatcattcatggttctttaatattgatgctcagtgcattggccttagaatatcccagcctctcttctggtttgctgagtgctgtgtaagtaagcatggtggaattgtttggggacatatatagtgatccttggtcactggtgtttcaaacattctggaaagtcacatcgatcaagaatattttttatttttaagaaagcataaccagcaataaaaatactatttttgagtctaaatgatagaagcccaaatatattttgttcatggtaaaaaa

SEQ ID NO: 688255 - DNA, 148 bp, Homo sapiens
gggattgatctttgcagacaccttagccaaaccatttaccaataaagtatagtgcgatagaaagttgaaacctggtcgcaatatagtatagtaccgcaagggaaagatgaaaaattatagccatagcataatatagcaaggaatcgtg

SEQ ID NO: 688256 - DNA, 1728 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccaggtacatcagatccatcaggtccgagctgtgttgactaccactacttttcccttcgtctcaattatgtcttggaagaaggctttgcggatccccggagaccttcgggtagcaactgtcaccttgatgctggcgatgctgagctccccactggctgagggcagagactctcccgaggatttcgtgtaccagtttaagggcatgtgctacttcaccaacgggacggagcgcgtgcgtcttgtgaccagatacatctataaccgagaggagtacgcgcgcttcgacagcgacgtgggggtgtatcgggcggtgacgccgctggggcggcctgacgccgagtactggaacagccagaaggacatcctggagaagtcctggagaggacccgggcggagttggacacggtgtgcagacacaactaccagttggagctccgcacgaccttgcagcggcgatggcccaagatcaaagtccggtggtttcggaatgatcaggaggagacagccggcgttgtgtccaccccccttattaggaacggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagttatctgtattctgaactttcttaattgagaagaggcaagaaatcactgcagaatgaaggaacatcccttgaggtgacccagccaacctgtggccagaaggagggttgtaccttgaaaagacactgaaagcattttggtgtgtgaagtaagggtgggcagaggaggtagaaaatcaattcaattgtcgcatcattcatggttctttaatattgatgctcagtgcattggccttagaatatcccagcctctcttctggtttgctgagtgctgtgtaagtaagcatggtggaattgtttggggacatatatagtgatccttggtcactggtgtttcaaacattctggaaagtcacatcgatcaagaatattttttatttttaagaaagcataaccagcaataaaaatactatttttgagtctaaatgatagaagcccaaatatattttgttcatggtaaaaaa

SEQ ID NO: 688257 - DNA, 81 bp, Homo sapiens
  misc_feature (73)..(73): n is a, c, g, or t
tacgaaactactaaaagaaaacattggggaggccggcagccatgagtcagggttggcgtggtctgtgcagtanccggtaaa

SEQ ID NO: 688258 - DNA, 398 bp, Homo sapiens
  misc_feature (269)..(269): n is a, c, g, or t
  misc_feature (357)..(357): n is a, c, g, or t
gagtgatctctacaggatccctgctgcttctcctcctcactgaacgctgacttttgcagcatcgaacgctcgcgtaaagtctgtcgatcttgcgtgtctggcatgtagcttcacctccagtcttctccttcttgccctctgcttcccggattcctgcgtcccgttcatccttggccacgccaattttcgcatctctctgcaccacagccgtctgggtcttgcccagagagctcctatcgttcactttgtcatacacgtccttgatgctnacgttcaggatctcaatggccatacggccatactcaaggtctgccacctcccgcaccagcttgttgctgctgctcccggtcctgtatnaatctgctccactgtccggctcccgaggaggaaaagcagca

SEQ ID NO: 688259 - DNA, 497 bp, Homo sapiens
  misc_feature (57)..(57): n is a, c, g, or t
  misc_feature (115)..(115): n is a, c, g, or t
  misc_feature (369)..(369): n is a, c, g, or t
  misc_feature (448)..(448): n is a, c, g, or t
gagcctccaatggtcctcataactgttggtccatcgggcgaagtcccaccctggagnggaacccatacccaattttgaggactgtggggaaggcccaacattagtgaagtcaggntcttgacttccaccatagaaccccagctcgggagagagatccttatgcctgtgatcactgcgggaagacctctagacatgcttctaggatgttgaatcataagaaactccactgccaaagaaagccattgaaatgtgaagactgtggtaagaggcttgtatgccggtcatactgtaaagaccaacgaagagaccgcagtggagggaacccatccaaatgtgaggactgtgggaacccctccaagaggcgcttgnatctggatataattttatcattatttttaaatgacatataagttatacatatttatggagtgtgaaatttgatacatgnatataatgtgtgctgaataaatcagtttaatttcacctgaaaaaaaaaa

SEQ ID NO: 688260 - DNA, 244 bp, Homo sapiens
gtatcaatgttggtgtttttaactgacacttaaaaatatgttaaaatatgtaatggcttgatttctgaccagactaaactctcagcctgtctaagtgttaggcagcttgatctaatcgatctcatccttttcttttcctcagtccaattttgcaattgctatgtcagtttcagttcacaataataccagtgcagacatggctccttaagattttctccttttccctcacgcgggtcgcttttaa

SEQ ID NO: 688261 - DNA, 894 bp, Homo sapiens
acacaaaataaaacactaaatcataacaaacaacaaaaaaatgcactgcataatctcgtatatagcactcacagcttactttgtaagtctcttccgaattttctttgccatataccatctagttttgtcccccatatttggttcccatcgtgtaccaacgatttcgcgaattgaccctgtggccttcctccactgggtttccttgtatttccccgacattgtcccccggcgattgtttccccgttaccaagactttttactaggcttttatccacaggcgctttcaagggattttggttagcggacaacccttggcaccccttggggcaagacacaactatgtgcgttcgacccggtgcgcctgccaagaaccgtctttttgggcatctccgtatatgactcgtgagtacgcaagctactgttcgctgcgtgtttcacagaacgacctccacaggttgtccggggtcttccatcgtgaagcccgcccgttaagtacgagaacatttcccctcgggggcgtgtaagatcacacacattgttgcttgtgagctgggccactcaccgggtaattatgtgttgacacccgttttgttggacaccctgcgccctttctctccaactatgtccataagagtgtttacaagcccccacgagaacatacaaatggtagatttgtgtagacgcgccctccccatgagtcatccgtcgtatcctactcccccccctcaataattttcatgtttcccaagacctgagtacattttaccccctctgttagattcacaactccacaaataatttgctgctaaaaaaagacttctttttattgtagatttcaacaccccagatcaagggttccaatcccctcggaaactaccggcccgcccacataac

SEQ ID NO: 688262 - DNA, 175 bp, Homo sapiens
tacggttgttttataatatagattcttcatagaggagacgccacctagtaagttttttcagttaattctgcatagaagtattttctttttcagcttttcttccttcttcatcttccagactgtaattctaagagtcttcctcctgatcgcttgaagttggttctagcaaatcagt

SEQ ID NO: 688263 - DNA, 152 bp, Homo sapiens
tatcacaatcagtcagtaaatatatgctgtgacatggtttctcctggtgggaaggcactgggaagtgaagggctcggtgtggtggtaccattttctttcttctttaagactgtgtttaaccatgtgtgcagtaacacatctctttcgttcat

SEQ ID NO: 688264 - DNA, 116 bp, Homo sapiens
gggaatccttacttcaggaaccgcagccgcggctctgtgttttgagagtgcaaatgtcatttgtcagagtgaaccgctgtgttccccgagttggtgtaagaaagacaccgaaagta

SEQ ID NO: 688265 - DNA, 155 bp, Homo sapiens
ggacagagccaccagcaggggtgctaaggggctctcccttttattaatgacagcggttctctcaaggaagtgtagtgccctcccctttggatagttgcctgacccttttcatcagtccttcaagtaccctcatcagtatagagcccgtgcattct

SEQ ID NO: 688266 - DNA, 876 bp, Homo sapiens
gcgggagcgaggctgcaaggaagatgtgcgtgacggcgtggaccacatagacatttacgcggatgtcaggtgcgaagagttcaaccaggaagctagacagtatggtgggcatgagtcagatagagtttgtagtgacgagtgtcatatctccatctgcgaaataatggatgatgccccagaagaccgagatgacatggctagctctccgcagcgcaacatgtatggtgatgatgtgggtaagaaggagcagcaaccgaaactgttgtctatatcatatacctggcaataggagaattgcattactatagtatggaaatctaatcatggtggacaacgagatgaaggacttaactccgaagcgagtgtcacttctgtgagcggagtcaaatgtgagtatgcctcggaagatcaaagatactactatgcgacaaatccggggcaaaactgggcccatgtgcgaaaggggggtgttagcccgtatagtcagcgaggtccgcgatcatcgaacgcaatcatggcaagacagaagcgtcacaaggggactcaagcgcacgcgtcaaacagagcaagctaccagagcgtacagaaaatccctgataggaacagcataccacgacagataaaaccgagaggacgcttgaaggatcaaagcacgcaaaagcagggaccacagggaaaacacgtcacgcacaaagaccagggacacaacaatggtcctggggggacaagggtcaaagagacatgagctgccgtaccaccgggaggggcaggactacacggtgacaggagcaatcaacctcagcaaagggtgggacaaagggaagggacaaccggcaaaaaccagagggagaatggaaccaagagaggcggacacga

SEQ ID NO: 688267 - DNA, 273 bp, Homo sapiens
  misc_feature (9)..(9): n is a, c, g, or t
  misc_feature (14)..(14): n is a, c, g, or t
  misc_feature (20)..(20): n is a, c, g, or t
  misc_feature (25)..(25): n is a, c, g, or t
  misc_feature (34)..(34): n is a, c, g, or t
  misc_feature (37)..(37): n is a, c, g, or t
  misc_feature (44)..(44): n is a, c, g, or t
  misc_feature (72)..(72): n is a, c, g, or t
  misc_feature (83)..(83): n is a, c, g, or t
  misc_feature (85)..(85): n is a, c, g, or t
  misc_feature (87)..(87): n is a, c, g, or t
  misc_feature (96)..(96): n is a, c, g, or t
  misc_feature (105)..(105): n is a, c, g, or t
  misc_feature (113)..(113): n is a, c, g, or t
  misc_feature (118)..(118): n is a, c, g, or t
  misc_feature (127)..(127): n is a, c, g, or t
  misc_feature (142)..(143): n is a, c, g, or t
  misc_feature (147)..(147): n is a, c, g, or t
  misc_feature (153)..(153): n is a, c, g, or t
  misc_feature (156)..(156): n is a, c, g, or t
  misc_feature (158)..(158): n is a, c, g, or t
  misc_feature (161)..(162): n is a, c, g, or t
  misc_feature (168)..(168): n is a, c, g, or t
  misc_feature (178)..(178): n is a, c, g, or t
  misc_feature (186)..(187): n is a, c, g, or t
  misc_feature (191)..(192): n is a, c, g, or t
  misc_feature (196)..(196): n is a, c, g, or t
  misc_feature (199)..(199): n is a, c, g, or t
  misc_feature (202)..(202): n is a, c, g, or t
  misc_feature (209)..(211): n is a, c, g, or t
  misc_feature (217)..(217): n is a, c, g, or t
  misc_feature (221)..(221): n is a, c, g, or t
  misc_feature (224)..(224): n is a, c, g, or t
  misc_feature (238)..(239): n is a, c, g, or t
  misc_feature (241)..(242): n is a, c, g, or t
  misc_feature (253)..(253): n is a, c, g, or t
  misc_feature (260)..(260): n is a, c, g, or t
  misc_feature (265)..(267): n is a, c, g, or t
  misc_feature (271)..(271): n is a, c, g, or t
ttttacccncctanaaaccncaaantacttcgantcncccttcnccatttccgacggcatctacggctcaanattttttttancnanaggcttccncggacttcncgtcattnttggntcaactttncttactatctgcttnntccnccaacnaananttnnctttanatccaaagancatttttnncttnnaatnccnccncctgatnnntggcantttntanatgtgtggtttgannanntctgtatgtcnccatctnctcannngggnct

SEQ ID NO: 688268 - DNA, 376 bp, Homo sapiens
ctctacgaggatcttactacaggcacgcaccaccatgcccagcatattttgtatttttggtggagacagggttttgccatgttggccaggctggtcttgaactcctgacctcaggtgatctgcccgcctcggcctcccaaagtgctgagattacaggcatgagccactgcgcccaggcaaaaaatttaaaattgtaaaaatcagccaaacatggtggcattcatctgtagtcccagcaacttgggaggctgaggtgggaggatttcttgagcccaggaggtcaaggttgcagtgacctatgactgcaccactgcactccagcctggacaacagagtgaggccctgtctcaaaaaataaataaataggagtttgagg

SEQ ID NO: 688269 - DNA, 160 bp, Homo sapiens
gaataaatagcggtacctctctccacactggattcttctgtttaccatcatagtataagattttccagcaccagtctgcccatacgcaaaaatacagacattatatccctcaaaggcgtgtaagtagcatttccttgccaatgtcccagtgtggagagag

SEQ ID NO: 688270 - DNA, 462 bp, Homo sapiens
aggacgaccactatcacggggggccgacgcacacggaacaacacactatagcatcggaggatcagagccaaatggggactcgcggatgcacagccacgcaccccacgtgttagcgtgcgtgagatacagtaggcggaatataactaggtgcgtgtaggtagagtggggctgaggtactcttactactgtggatgtcatacgaagtcaaaggtcctgcccaagccgtgcggtcccctcagtcaactctgtttcggagacttaacgattgggcatggctacacaagtcaagaaatgttcaagcccttggatgtagggaaaagaaagcagcagatcagactgtcactgtgtactatctcgaaggggaagacttaagagactaccatttgggaaaagacctgtactttaaacaaatagcttagctgagatgtaagtaacatatgtagctatgccccaggcactttg

SEQ ID NO: 688271 - DNA, 230 bp, Homo sapiens
aactacctaaaggttctttcagagcacggcttctgccccattacttccgacatccggtatggacagactttctactatgcggaagactatcaccatcagtacctgagcaagaatctctatggctactgcggccttgggggcaccggcttgtcctgcccagtgggtattaaaaaataatttctccgatcatggtgggcctttgatgtttcagtaaaaatgctttcatctaa

SEQ ID NO: 688272 - DNA, 1381 bp, Homo sapiens
  misc_feature (396)..(396): n is a, c, g, or t
  misc_feature (668)..(668): n is a, c, g, or t
  misc_feature (1381)..(1381): n is a, c, g, or t
ggtatactgtaccgaggttccacgtgatgctgtgcgagccgtatcgctctgtctcctcccaatctgggaggcgctggatgctatgggctcagtggtgaacaatggcagtctacgggtatgggaaggaaggaacccgaaggtgagagcacctggaatgtggctgtcagtgggtctccattctgaggggagatgcgtgcatcgacgctcgtgcgaagaatgatgtgaggacagagcgactgtcatatggtaccagagcatgcttgagcatgcacgattgccttgcatgcttgagggaaagaggggggactttgggtgcgctgttggacctctacgctgtcgctaccagtggttgggaagtcggtcgagttagcgtggaacaatagggaaagcaccaanttcctattcgtctgacttcacggtacaaagcccacgactacattcccccagagacgtgctcaatgtagctagggtcgcgtatgtatcaccccaaggaccaattagtggattgagttatagaacgcgtatataccacaatctagaagggaggacgtgcggaaggaagcgattggctacttatcccgagtgattgaatctcggggaacccccttgacttggtcttagcttagtatctcgcattcggatgcggtctgatcggaagctcgcgaganacataggtgttctggaagggctccccgtggttggcccgcgggactcgtcttaacgagaacatatgccgtaacgatattagctcctatcgttgtactcatacaagagtcaacctttgattagtaaacttaaaaagcagcatgtaagtggaagggtgcatgtgtgttacaagggttatctatcaagacgagataggaaattaacacattcacagggaaacccgaatgggcttgcctccgtggggcgcttccaagtgttgaggagggcgtggtgcagataaacaaggacgtgcgttgaaactataaaagaggggcgtgggccatgggggacccccttttgtggcgttgattaccatgtggaaaccgcgtggggggttaatgaaatgaggggctcgcggaagtggggggatatacaactaggtcgaaagggggtatgtcatcatttacacgtgtggaaggggggttggtgaggggaatttgggagattaaggcgcatgggtggtttaaaccgggggctgagatatagaaagagcagagggggagaacaaaaagagttgctacaaaagagacttgtgacagttttcacggaattgccaaaaggaccgttgggagaaaggaaccccgcagggaggagggaactagcacacacacgagtgttttatagccattgaacgggtgcgcataggagaattcagagtagtagtcaatgttacccn

SEQ ID NO: 688273 - DNA, 269 bp, Homo sapiens
agcgagagagagagggagagagagagagagggagagagagggagagagagagagacgagagagagatacaccctagtgggcctaatgcccttatatgggtcaagggttctattcaaacaggttctctgtggagacttataagtggtgggtttatatcacgcaggcacagagttctctggggctcacagtgatgagtgtagcaggtgagacactgtgttccatgcagggtgtgtgggtgttccaggtctctatgtcaagatatattgtca

SEQ ID NO: 688274 - DNA, 654 bp, Homo sapiens
acttttgcggaggtgacgacctacgcacacgagaacatgactgtggaacaggatatccttcatacatctccagaagaggagaataggaaccacaagacgaaacgcctggagcatagctcaaaattctacttcatggatgcgaaatgcccacaatgctgtacaagcaccacgtgctctagccatgcacaaacggacgattcgtgcgagggctgctgcactgaacattgacagcctacactaggaaaagcacggtttacagaaggatgtgcctataagaggaagcaggactgcactctgagctaagaagagtgggaaaccatctcaatgaacacattcaggatgatggatggcgacgtgaccggggcccaggcctatgcctacaccgacaagtgcctgaacatatcatgtcggacgcttggcactatcatgatcagagtagtcctgttaccgggctgccgcaatgcgagctactacgccaatatgccctagagagagcaggataacaagtcactgtacgaggctgtacaagtctggactgttagaactcagtgtgaaccgatgtaactgcactgtaggacatgccgcttttggcagcttgtgcaagcctagatgcaccagacgtacgcactaccaagatcggtgacctgtgagagg

SEQ ID NO: 688275 - DNA, 212 bp, Homo sapiens
gacctccttatgctgcttcagcagaagaagtggccaaagaacttaagtcaaatctcgggatcgaagtcctctgctatgtcttcagacgggtcctggctgaaacggatactgccgaggagaagccggctcccagatgacgggagcacgggtacgcaggcccccagccactctgaaagtgccttgaatatgactctaaacgtcaatcaaatctc

SEQ ID NO: 688276 - DNA, 1302 bp, Homo sapiens
gggcttgatcttgtctataacacatgactagtgcctttcagctataatgtctgtcagattacacgacgttgcccttaatatctcgttgggaaggagatgtccacgattattgcaaatcttcttattatatgttctccctttctgtcgtatgcacatcagtggagacaatgtatcaactaggttcgtagtgtacgaagtgggggtgtctacgaaacgatggaacgtgtatatcccctaaacgacctattggaatagatgtaaccatcctggtgaaactcgatattaaccagggcattactgcgagacctgttagcaattctcaactgtctgcacatccacgttgtgcgtttgacctgccatgactcactcaagagtgttcactctttgcacaaatcacgccgaaacatcatcacggaggataacccagggtcattgcgccagtgcgcggtggctatccgcctgcaactgtgtatttcaccgaacggagtttgacttgcgtcacaacgggctctcatctgcgcctcgtgcaacgcaactggctctcacaacaccttgcgcatgggtggaccggcaagcgctacccttgtgtcgcgcccacttggattgccacatctgctcggcgcgccacaaccgcctcagaactcatctcctccccctcttccacctcacgttggtcctaacgtcagctcgcgacgcgaaccccaagcagggggcgccacggtgcaacgagcctctgctgcacaacatagatagtcgcaccgcctctaacttacaggtctgcctggccctcttcccatcacaccatcgctggcacaacctcatcaaacctaggtgcacaccaatgcatgacattccgccctcttatgccgccgtacccctcggcccaactatacacgactcgtctgaacattctcacgcgcctacactttggctctcaccaacccggcacatctcatggcacccgatctcggtcctccgcagtaatccttcccacgtcatctagtcctcagcagacgggccaccgtcctcccgactcagaggtcagttttcactttactcatcacacaagacgctatcgcgtaacgcatcccatgcactcagctgcctaaatcgtcttgccttttgaaacgagacaccaccgttcaagccgatcagtttctgggccaaacgccggtccattggctgtaccgccttaccgccacgggtctttgcgattagtccaacaacgcgcgctatcacgcgctactcatcatcctcctatcactctccacgtaatgtatcctgaccaataaacgtgcatgc

SEQ ID NO: 688277 - DNA, 238 bp, Homo sapiens
tctgccggtctctagtgagatctgctagacctggggacactggcagctctcacaacgactgctgtagaggtagtcaaagcaattggatcaaattcaccttctacttcaagagaaagagaccgatttatctttctttttttatattcatgggaagaacaacttccattagctgtataaaaacaaacctctgatatgacggtagacaataggtttcaatcacatcattcagtcaaagcaa

SEQ ID NO: 688278 - DNA, 239 bp, Homo sapiens
agctgacatcacatggcgtgagccaccgtgcctgggctgatttctttttgcgatgacctgctgctgattttttttatggtgactgtgaattctgcaactttactgaaacctttttatcagttctaatagttttcttgggggagtctttcagtttttcccaatataagattgtcatctgtgaataaggataattttgacttcttcctctccaatttgggtgactgttatttctttctctt

SEQ ID NO: 688279 - DNA, 126 bp, Homo sapiens
gtccgacgacagggcgactccagaaggtattcggagaagcgataaacattaaaaaggacgttatgagcaaaccaacaacgtacattcttgctgtgacgaagtgagaatacacaatgcatcatgggt

SEQ ID NO: 688280 - DNA, 1822 bp, Homo sapiens
  misc_feature (894)..(894): n is a, c, g, or t
  misc_feature (1043)..(1043): n is a, c, g, or t
ttgtttctcatgtgttgtgttgctcatctggagcgcggctgtctagttgcctccgcttcgcgactctgttattgatgtcgcgcgttggctgctattgtgttgatccgctctaccgttgtactttgatttgatctgtttgtggtccccacctgcgcgttgttgtttatccttctgttgcgttgttgctttgatggagtgaggggtccacctgagttgccacaccgtgtgctgtatgatcgcttgtgcgtcatcgatgttctcccttgtgttcgccgcgccttgtcacggagtggggggggggaaccaggcccgtggacacccacatgggctaaccaggaacccttgatcgttcgtgggtccgctatgtgttgtggttttgttaacacgtcggcgtgtcccccaccttgggggggatctctactcactgctttctgctctcctgccccccctttttggggggttggttcctgtgtaggtctttttactcagggcgccccatcttccccgagtgtttggtgtgtggataacttgtgtggctagagacgccctttgctggtgaccccccacgttcgtggtgatccactcccccccgagttctgtgtgcgcgcgccgccaatctgtgtttatgtgttggtgggtgctttctctctgcggccccgcgctacaattataggaggaccacagtcagtttgaagtatgtttgttgtgtgttgggtcgtcccacgttgcccccgagcgcactacatatatagtttgttgtgcccaatatggttgtccctgtgcaccccccgtggttgtgtggcccgccccccgacgcagtgttgtttggcggccgttcgccatccatgggcgtagtagctttggctgtgttctaccaggaggggtattatttcnttgttgggggacgacttgtgttcctgccccagcagccgccccgctgttgtggtcggcgcccccagccgccccttttggtatggtggtttctttagtcgccacacccttcttgcgtagtatacgcccccctcgctttctcggcggagagngttctttatatcctttccccccctgggcctcccccaacaggtgctccctcataatatctttctacagggggcgttgtttactcacacagccgtgttatattgtgagaggggcgcgagaacacacaagctgagaggcgcgttattataggcgcgacaccttgggagaaggggcgtctgccgcgccccctctttgttgggggtgtcacctctctggggtggggcctctatgacagagagagagtgtgtggcacccaccgcggagaaagaggccgctcctcggacgacacactctgtgtgtcacacacagcagagagaatagcgagagtgtgtcacaccctcttcctctgggtctctctctgctgtgtgtgggggtgtgtgttgcacagagagtgttgctcgtaacacggtgtgtcacgagccacactcgggcggcccacacactcgggagacacacacacatgggagattttctctttgttgtttttgctcttcttctgaagaccacactctctctggctctctctattgtgcccacgcggctcggaagtgcccacactggcccgccgatttcacgacttcactgcacacatttccgccctctcccggggttcacagaccgatttcttctggcccccgacttctcccgaggagagcttaagaagagcgcggagagatcagacttgagacccagcggagatttcgcagaacctcgccctcgggccaaataagcgagacccccttttcccagaaaaagggaaaaaaaaaaaaccaaagaccca

SEQ ID NO: 688281 - DNA, 100 bp, Homo sapiens
gatccacgtgccattgtggaaaatggattgtaaatcaaagacctgagctttagtcctactacctttgctgaagtttcttgtgtgatactctgcgtgctcc

SEQ ID NO: 688282 - DNA, 369 bp, Homo sapiens
ccgcgtcgacctatgactgatatcacctcgttgttctctatgactgatgtcacctcgttgttctctatgactgatatcacctcgttgttctctatgactgatatcaccccgttgttctctatgactgatatcaccccgttgttctctatgactgatatcaccccgttgttctctatgactgatatcacctcgttgttctctatgactgatatcacctcgttgttctctatgactgatatcaccccgttgtcctctatgactgatatcaccccgttgttctctatgactgatatcaccccgttgttctctatgactgatatcacctcgttgttctctatgactgatatcacctcgttgttctgtcgacgc

SEQ ID NO: 688283 - DNA, 779 bp, Homo sapiens
agcggagactgcccggagagcgcgctctgcctgccgctctgtctgcctgccactgagtggttcccagcaccagtgagggcctgagatcttctttctcctttgcctggtccgggagggccttggcagccccgtcagcatgcaggccctgcctgcatgagcacagaggtggtggaagaaactgtggcaaacgtgactgagcgtatctgtgggagctaatcctgtccaatggtggaagtaggagaatttgatgatgagtgcacgagtgaaaccgccagaggaggtgtgtggcggaagacatctcctgtccagaaccgatcgcactgacaaacagcggcaaggtgctgccgaggctggatgagaacgaacagcaccatgtgcgtgtgccatggaccccagcagttgtgaccctaacctctattggcgagtctgagaccggtgtgcagcgaattgatcgagacagagacctgtgcgaacctctttgcctgaccgacattcgtattgcccactaaaagtgtggaccctggaaggggcaccaaagaaagggccacgagcttccaccgtggactacactctgtgcctcgtcgcattacatcccgccttgatctgtgacgctgagcctgatccgatttccctcctgcgcatgcttggactggtctctagaacgtcctggtcaccctgtgatcagagggatgaggacaagcatcttctgacttgataagcagaagctgcgggtgaatgaagatccatgagaatgagaagcgcctggaggcaggagacca

SEQ ID NO: 688284 - DNA, 322 bp, Homo sapiens
tcacagcactggcagatactccccattatctaccatgggccggcagacttctaagctggcccctaagacttcctgcaccctcatctacgagccctgcacctactgaggaaatccattgcatcagatggcatacaggatccttaagggtcatttcctggattccagagctcaggttacctgacactaattcaagcacctcaagctcacgtaaactggtaatctgagccttagcccaagctaatttccaggtaaaatctgtcccttaattcattaagtttagaaatctgcattccatggtaaatatagaagagtagcactttag

SEQ ID NO: 688285 - DNA, 777 bp, Homo sapiens
  misc_feature (372)..(372): n is a, c, g, or t
gaagcgatcgcgagaatgactagtgtatctaccatgcattgtctcagaaagagacaaatgattccaatgtcggccttcagtgatgcacagcagggccgaggaccttcgtgatggccttcctgaagctgcagctactccctcgtcatgatgcaccgctagaggtgccagacgcatggtaccattctgactcgtgcaagtgggtgtggttctggaatctactttcagctcgctcacaaaagacgacgataaggtagaaggaataggaaggagaagcctgaaaggccgtcttcatgactccggacgatggcgatgcggataggctgtggcctcctttgaccattaaatccatgtgtatgcagacatacgagcgcnttgtcctcccgtcgtcctatgaatgtctgtaacactggtcatatccggaaccgtggtgcacttggggctcaaagcctagaaatatctggcacgtgcgagcacgcattgattccattggtgctacgcatccttaagggggcagaatcgttgcaccggggaggctagttgacttcgcgatggtgcatggaaagatctcaaaattgacgcccctactataagttgtggtgtcttaaccagggagagtcccctatcatactagcgtagaatcatatggcacattgtgcatccaattaatcaccaacatgaagtacccgcctgagacacgttatctgccatggtctaagacctgcgtgtttcattgtgcgaaaggcgaagagctttattgccctacatttaggggagcaa

SEQ ID NO: 688286 - DNA, 235 bp, Homo sapiens
tttttccccccctgggggggctaaagggccccccccattaaggagggggtccgggccccccccccccccctgaaaaatccccagccaaataatggggcccccccccccccagggggccctttttcccccccttagagggactaaggggggggtaggggccctggaaccctttcccccgggctagggcgggggggggtttaacccctgggcgggccatttccgggcccatttttta

SEQ ID NO: 688287 - DNA, 165 bp, Homo sapiens
ctggaaaaaaagtgaatagggtaggttttgtggggaaagttaccctttgtcaatgcccagccttaaggccccctaataaagggtagccaaagtgataaatgaaataacccctgatgaaactcctttcaatatggtaaaaacccttaaatttagggttttctttta

SEQ ID NO: 688288 - DNA, 365 bp, Homo sapiens
  misc_feature (5)..(5): n is a, c, g, or t
  misc_feature (7)..(7): n is a, c, g, or t
  misc_feature (15)..(15): n is a, c, g, or t
  misc_feature (34)..(34): n is a, c, g, or t
  misc_feature (38)..(38): n is a, c, g, or t
  misc_feature (62)..(62): n is a, c, g, or t
  misc_feature (65)..(67): n is a, c, g, or t
  misc_feature (77)..(78): n is a, c, g, or t
  misc_feature (88)..(88): n is a, c, g, or t
  misc_feature (122)..(122): n is a, c, g, or t
  misc_feature (127)..(127): n is a, c, g, or t
  misc_feature (136)..(136): n is a, c, g, or t
  misc_feature (152)..(152): n is a, c, g, or t
  misc_feature (167)..(168): n is a, c, g, or t
  misc_feature (182)..(182): n is a, c, g, or t
  misc_feature (187)..(188): n is a, c, g, or t
  misc_feature (211)..(212): n is a, c, g, or t
  misc_feature (221)..(221): n is a, c, g, or t
  misc_feature (240)..(240): n is a, c, g, or t
  misc_feature (248)..(248): n is a, c, g, or t
  misc_feature (255)..(255): n is a, c, g, or t
  misc_feature (260)..(260): n is a, c, g, or t
  misc_feature (297)..(297): n is a, c, g, or t
  misc_feature (299)..(299): n is a, c, g, or t
  misc_feature (314)..(314): n is a, c, g, or t
  misc_feature (341)..(341): n is a, c, g, or t
  misc_feature (356)..(356): n is a, c, g, or t
tcaantncttctganctcttctagcctggctaantatnctcctaagcactatggtcagcagntgnnnttgtctatgnnacatcaactncccaaaatgaagacatttcatgaacctaccacanttttnggtaatagnttacctaaatgcactncacttaagccagaanntaacacattgactncagannctaaattgtgggatgatgcaaannattgctttncacggtgtacagctgcggnatccaaanctttgcnttttntgctacagggctgttgtctcatgttgaagagggcttngnttccgatgcaactgntagcagctctgatgacgctttggatgntatacccttagaaanaatgtggca

SEQ ID NO: 688289 - DNA, 442 bp, Homo sapiens
gattcgacttgcaggtctacaaagtgagtccagcgctggggctttctagttgcttatattgtactccattgttaacaagaataaagttaggcatccttccctctattcccccagcaccctaactgttctctctattataggtcttaccacattttacgataactggcctgaggaccttgagaacaagaatcatttccatattttaaaatctgcaatgcttagctaagttcccagtacaaagtaggtaatgttaggccaggcatggtggctcatgcctgcaatcccagcactttgggaggccaaggaaggtgggttatctgaggttgggagttcgagaccagcctgaccggcatggagaaacctcgtctctactaaaaatacaaaaattagctgggcgtgttggcacgtgcctgtaatcccagcaactcgaaagccccaagcg

SEQ ID NO: 688290 - DNA, 185 bp, Homo sapiens
agctgctccgtaacgagcgcctcctaacaccctaacgagcgcttcctgtaacagcgcctcctaacacgcctcacgtaacactcccctgactcctgtaagttaggcatggcgctcgattacgggagggctactgatagggaacacggtgcttcgtttactggagtgctgcatctgattcaagaact

SEQ ID NO: 688291 - DNA, 680 bp, Homo sapiens
ggtcagctccagctcactggctggcaccgagacttctggacaggaaactgcaccatccggtcttctcccagtcaagggggctccagagactgcccacccaggaagtctggtggccgtggggatttggacagtgccttggtaatgagccaggctccaggaagagatgtccttgtggctgggggcccctgtggctgagcattcctccgtgacgtctgcggtggagcttgtggaagccaggcgcacaggatgcataggcatgcctaggcccagggaggccagcagctgcatcctcgagagaggaagccaggagtgccccactctgctgggggtactgcaggggtggggctggaggctgcagagcccacagaccctggtcaccagggcagagcccccttcagtaacccagcagagatccgtccacaaaagcggtagaagaacagggggcagtccccaaaatgctggggaacgagctatgcagatgtgtgtggggacaagggcctcgggacgttcgacctacagaggttctgagctgcgaagggctgcaagggattcttccgccggagcgtcaatcaagggagcgcactacatctggcacagtgagaggcaagttgccccatggacgacctacgatgcgtcgcaaggtgccaggaggtgtcggcttcgcaaatgccgtcaggctg

SEQ ID NO: 688292 - DNA, 420 bp, Homo sapiens
cgtagaacacagtgatgtcaatgagtacacgagagaacagaagtgagattagcactaatcacctctaatgccatgatgtccagtaaagtttagagaagaggaatagctaattggctgctccttctgaggctttgtgtctcgcgaagctctggaattaaaaggtagaggagagatgctgaatgatgctttttttcttcttaatcttggggggtcattatgattaagttattgatatcatatcaccgtatgacagcacatgatgaaagaaaatcagatgtttgtttcaatcaaagtgaaacaaaatgagaataactatttgggcaaaacacttttatcactgctaagatactactagaactgagcagagaaatactcagagagagccatggcatagtactaattaataatggggtacattta

SEQ ID NO: 688293 - DNA, 520 bp, Homo sapiens
aatgctgtaactaagattagtatgtgtataggaagatgagtagatatatgaagaactgattagggttggggtctgagtatatatatcacagtgagaatactatgatggaccatgtaacgaacaatgctacagtaatgaatattatggagaagtcgtctagttggaagctaagggagagctgggtggttggggtggtggctcagtgtcagtccgagataataacttcttggtctaggcacatgaatatggtggtggggaagagacttgataataagggtggatgcgagaatggatattacataaggggggtatgagtccttatggtaagggtaaacgagggtggaaaggatggggggaattagggacgtcagggttagggtagtcatagtagtgtgcatggttgtaactattatgagtcctagttgacttgaagtggagaaggctacgatttatgggatgtcatttttgtgtaagggcgcagactgctgcgaacaggggtggtgatagcgcctaaagcgat

SEQ ID NO: 688294 - DNA, 138 bp, Homo sapiens
atgctcatccctcctttatataaatgcttaggggtatagttcccctgtcttctgaagtatacttgatgccggtagacgtggcggtgtgtacactgctaatagcgctgttcatctacgcactctactctcaatgtactg

SEQ ID NO: 688295 - DNA, 112 bp, Homo sapiens
  misc_feature (23)..(23): n is a, c, g, or t
  misc_feature (64)..(64): n is a, c, g, or t
  misc_feature (67)..(67): n is a, c, g, or t
aattctttatccaaatgtagtgntacaaaactagttgctactccatttgtataaagaattgtgnggnagcactacatttaatgtaatgagatacctttgttcatttttttaa

SEQ ID NO: 688296 - DNA, 155 bp, Homo sapiens
cgaggactcgaaatggacgaacatttttatgaagaatttttgtctaggagaatataacagtgttacccacaggttgtgtctcttaagggtggttcatatttctctgtaccttttgtgtactcacacaggaaagtactaggagtcctaagaaatgt

SEQ ID NO: 688297 - DNA, 393 bp, Homo sapiens
ttagtccaaaagccaaaaatatttatcttggttttacattttaatttccattcttaattgtaatttttttctttaaataaggaaaccaataatctcatgtataaaaacttaaatattttacaagttacatatagcatcattctaaaataagaattttttttgttttctgtctgcttttttgcatatgtctcgtggttgaggtttaatatgttcaagtgcgttatttgttgctgtgtgttagagtcattagttaaaatcatatccagatgtcccttgtgatacttggtgctgctgctgagaaatggtacgtgttgtgcatataagacagtcccgagtgtcatcattccattcgagtgaatgtttagcaggtgtcaattgagaagaaaggggaga

SEQ ID NO: 688298 - DNA, 780 bp, Homo sapiens
catttttactccctctcccttttgttctctacactgtttagtcccacttcaccactccgtcgagcccaattttcttcatattgtaccctaccccattctacccatctcctctctccgcccagggctctatctttctcctctctcacaatacgctcgccccactgtgctaaagctagttctcatatagagacacaacattacacatacatggtatctcccctcgaagtgctgttcttcttttctaaaccacgagccccttcatcgcccagccatcatcagcgggaccttagtctgtgggtggtagagcacgggtccccccgcttgcgggtgtcgcggctcgtcaccatcaccaccccccgcgtctgttgttgagtactacccccccgccacgactccacatcttttgtgtgagcgagagtgcgtcgcggaaatgatttaattatcatgcgggtgaggactacatgcagagagagtgtagagatacagaagataagaacatagagcgttatggatatatgatttgtctttcacttacgcacccacccccccaagcggctgtctagttagatataataaaataattcatttccaccgtggctctactgccccttctcccgcatctgtcgctgcgcgacatcatatcacgaaaacctcccccctccctccttcgtacttaaagcgacaattattttgtttctattccagaaacataattatttttttcatagccaaaaacaaaaaaccaataatcaacaacaacaaacacaatcaatagtcaca

SEQ ID NO: 688299 - DNA, 179 bp, Homo sapiens
tgaattggaagctatcattgaagaagctgatggtgatggcggatgggtagatacatatcacaccacaggtattaccggaataacggaagccgttaaagagatcacactggaaaataaggacaatataaggcttcaagattgctcagcactctgtgaagaggtaggtatgctgaaggacg

SEQ ID NO: 688300 - DNA, 539 bp, Homo sapiens
  misc_feature (442)..(442): n is a, c, g, or t
gaatcctgaacgctggctgctgaggcacagctccatcgttacaatggcctctttagacccttttcctgcctcccagccttctctccaggccctgaacattctcagctgaagcgatcctgccacctcaacctcccacgtggctgagactacaggtgcgtgccacgtatgcccaactaatatttggaattttcatatacgtggcttccagaggggtgacagcgaaacgtgccaacatccagatgcaggaaaccaagcttaacacgcccactgattctacattatgctgctacctcccggtagcctgtccaggcccagaactttctccagtcagcctctacagaccaagctcatgactctcaatggcctatttaggcccataccctacgtcacggccagctccgcagatgaggctactgcctcacaacagcctccacaggcacangctccatcgtacaatggcctctgtagaccccagctctgcctcccagccttctctccaggcccttgactttctcaaggtgacctcaccaggcccaggt

SEQ ID NO: 688301 - DNA, 720 bp, Homo sapiens
gcatcccccacgcccacgcccaggaactggtggcgtccaaagggactgcgttggggtgaggccggggttgagggcctagggcgcagagccggctggaggcgccggcgtggggaagggggccgagggtgagtagtgtagctctgagtaaaagagccatgggctgcctgatgtgggggaccctgggaggcattgacttttgctgctgtttgccctgcggctcggagcaagcagactgccatctgttttgcctggctgcgacgcgtcccgtttaattaccctcccggcagcctaatagagatgatattaaactaaatctttctgacattaaaagtaattatccccaaacctggtggctcccgtggacggaatggcccctccctgcacccaccccttccctgtgcctgctgccggattcctgttagtttgagctgatactctcctgcccgcggaatggtggcgcagaggacaacggggggaaagtgcctttgggagaatggaatctccactgggtttgcctaaaaccgcgttttcccgcgacaaacacagactctcctgtacctatgtgaaacacacgcaccgtgtacacacatgacacgtagcgacattttcctccagatcaactcatgagtcatgctgatgaagaccctcagccggcacaccctctgtgggcagggagacgcgcaagcttgggtttccttgtcccgttcctctgacaccgta

SEQ ID NO: 688302 - DNA, 169 bp, Homo sapiens
tctagaggatcccgtggggtctcggtggattaatttcaaggttttcttctgactcgcatagcaattggtagagatgtcctggcccgttgggtacgctggtgctttcatgattctctccaggtggccagaccatccgtacgggcgggccaccaaagcacacggagattct

SEQ ID NO: 688303 - DNA, 121 bp, Homo sapiens
gagcccccagtgccggagcaaaaaggaccctggacccaaaggcaaatactgcggggtggtaaaaaaggtaaagtaggctgtggcaatggaataaaacccgattaaaaacgttaagaactga

SEQ ID NO: 688304 - DNA, 222 bp, Homo sapiens
agacgtccattctaggcatagactcattcttgcatacagcaaaatgtgctcaatgtattggcctgcttacaacacggggagatgtgttggccagtaagttgctcatcacaagagcaccagactggggggtgtaatctccggcaactggcatgccctctgaaagaagggttttctgtgctgtgagatgcatagaactatactttgccatgcaggaagggaggt

SEQ ID NO: 688305 - DNA, 111 bp, Homo sapiens
gggtgtgagtgctctttgcgtgcgtggtgtgttggatgtggggggtgccgttccatgcttcaacccaccccaccccccagtgaataaagactgaagttattcattccaata

SEQ ID NO: 688306 - DNA, 396 bp, Homo sapiens
  misc_feature (215)..(215): n is a, c, g, or t
  misc_feature (242)..(242): n is a, c, g, or t
gggttcacccccaggccccgggggtgcaaccagcagcccccgccgttctccctcaggccccaggggtgcacccaccagccccagggatgcaccctcaggccccgggggtccacccccaaccttccggggtccatccgtcggctcctggggtccaccctcagcctccgggggttcacccctcaaattttggggtgcaccccccaattttcatgccncaaatgttgaggcccccatttccctcngaagggccagggaacatacctccccctcccccaaccaattgagaaggtgctccctcccccagcaagcccagggccaggtggttttgccttttccccctgaaagaagggtgcttttttgtactgccccccgctcattaaacagcctcccccagca

SEQ ID NO: 688307 - DNA, 148 bp, Homo sapiens
  misc_feature (55)..(55): n is a, c, g, or t
  misc_feature (84)..(84): n is a, c, g, or t
  misc_feature (91)..(91): n is a, c, g, or t
ctaattggttcttcgatgacgacctgtcattaagtgactctgtgtgtgtgtgtgncagtattgtaatatggagaggccatttcngcatggntaaatgtgtagacttaagaatcatacccaacacatgcgtcatcgaagaaccaattag

SEQ ID NO: 688308 - DNA, 85 bp, Homo sapiens
gaccgtaggatagagttccatacaagcgctaaatgaaacagcgcatcaattaaaaaataaacactccattctaggagaaagacag

SEQ ID NO: 688309 - DNA, 428 bp, Homo sapiens
  misc_feature (35)..(35): n is a, c, g, or t
  misc_feature (398)..(398): n is a, c, g, or t
gttggtcgatcactgtactatatgcctgtttcaantctacctgagcaattgtggtattttttaatctactctttttttttaagaggtgagggtcttgctatattgctcaggctgacatcaaactcctggactcaagcactctttctgcctcagcctcctcagtagctgggtattatggtatgtgtacatatatacttttagagacagggtctcgttctgttgtccaggctggactacagtggtataatcatggctcactgcagcctccaacacctgggctcaagcaatcctcccacctcagcctcctgagtagctagggactacaggcgtgtgccaccatgcctaatcttcttttttttttttttggaaagggagtctcgctctgtcacccaggcggnagtacagtgatcgaccaaggggtaccgagc

SEQ ID NO: 688310 - DNA, 231 bp, Homo sapiens
ctagaggatccccacccgggtcctttctccaagttctgtttaatctggatcacgggttctttttaaggcccgggcagtttttggggtcccggctccttgcccatagtaaaacagcttgaaatatcccaggcaagagagtagtttcaggtgggcaactctgctctctaatggagagggcgtgcacaatcaaaagtactatgcaatgtcaggacaataaagaacatacagttt

SEQ ID NO: 688311 - DNA, 390 bp, Homo sapiens
tttgatacagagttccgctcttgttgcctagcctggagtgcaatggcgccatctcggctcactgcaatctccgcctcccgggttcaggtgattctcctgtctcagcctcctgagtagctgagattacaggcacctgccaccatgcccagctaatttttgtgttttagtagagatggggtttcaccatgttaaggtgggaattctcaaagcatggtccctgtaccagcaacatcagcatcacctgggaacttgttagaaatgcagactttggctgggcacagtggatcacaaatcctgtaatcccagaactgagggaggctgaggtgggaggatcttctgagcctaggagttactggacaacatggcaagaccgtatctctaccccccccc

SEQ ID NO: 688312 - DNA, 204 bp, Homo sapiens
cccccccccccatttttggggggggggaaagggttttttccccccttgggcccccgttcccccgtttgttaaaatttttttataaaccccccccccccggggggttgggggggttttaatttaattttgtggcaaaagggcccccccccgggcccggccccccctaagggggggggcccctaaatggggggtttttttttttta

SEQ ID NO: 688313 - DNA, 193 bp, Homo sapiens
  misc_feature (185)..(185): n is a, c, g, or t
attctgtgggcatgaatggaaggaggcaggagagctagaaaaagggatagatctaatgttccctacggaacctggcttatgctggcccttcacatactgtgacatgtaatccttactactgttctctgaggaataaggctgtcccctcttccaggtaagaaaacaggctttgtgtgacttgcccnatatcctt

SEQ ID NO: 688314 - DNA, 890 bp, Homo sapiens
ggctaatggtttatgagaggggcggggagaagccgagcctcctcgacggactaagagaaaaattcccgcggagcgctcatttgggtgggccggagaacgccccatcagcacctttgcgcctctaaccctcctcagctgagctgcagttgggcgcggtgcccgtatatttccagccattggggcaggtgcttggacactgcatgtagggcagctcggttaggtgcattatctccgggtttctggcactttccagaccccattgatacattgatttatctcgagtgccagacgctcatttaggaggtctcggcgggatttccgatcgtcactgacgacgacgtcactcgcgaacgcttggccatgaggggtccaggatttccatagctactgatgccccatcccttcctggagggcagagatgacggacctagatggcgctatgcgggcagctggcgttccatgcgatcccgaccaacagcagccgttcatctgtgtggccacctggaccggcggcaatcacagagacccggctttcttaatccctgcctctggtcactaaccagacttgcgtgatcttcgagaaccaaccgctccatcctcctcgcgcaacgcctgggcacacctagttcccgaaggctttacgctgccacctgcataccatggtcccgcacgacccttgacaccccacggacgacacttcctaccgagtcccgctcgccatgcagccaggcaaaattctcggacgctgggcaatgggcaggggcgaacactcacccagcacgcccaccaatcctccacacatataccttggccactagcggcatgaccgcccgctgccaaagtgacacgcaacctcgcacagcggatgcaaccacgctggaaacgggacg

SEQ ID NO: 688315 - DNA, 467 bp, Homo sapiens
  misc_feature (15)..(15): n is a, c, g, or t
  misc_feature (125)..(125): n is a, c, g, or t
  misc_feature (136)..(137): n is a, c, g, or t
  misc_feature (154)..(154): n is a, c, g, or t
  misc_feature (217)..(222): n is a, c, g, or t
  misc_feature (238)..(238): n is a, c, g, or t
  misc_feature (269)..(271): n is a, c, g, or t
  misc_feature (273)..(273): n is a, c, g, or t
  misc_feature (284)..(285): n is a, c, g, or t
  misc_feature (297)..(297): n is a, c, g, or t
  misc_feature (304)..(306): n is a, c, g, or t
  misc_feature (309)..(309): n is a, c, g, or t
  misc_feature (323)..(323): n is a, c, g, or t
  misc_feature (346)..(346): n is a, c, g, or t
  misc_feature (354)..(354): n is a, c, g, or t
  misc_feature (396)..(396): n is a, c, g, or t
  misc_feature (400)..(400): n is a, c, g, or t
  misc_feature (402)..(402): n is a, c, g, or t
  misc_feature (434)..(434): n is a, c, g, or t
ggacatatatatttngttacagtaattcctgcatctcaaaaataatacaaaaagtgaaaataagtttagaccagccttaaccttagctcagtgtgctaatttatatataaatctatgtgcattcntttcaattttnncttacaaaatctaaagngatgctgttataatactaaaagattccactttaaacagcagcagtttcagaataattaaaaannnnnntcaggcatggggctgntaaagaccgaagttctcccttccccccttannntncgtcgctttcnnctattgcctccnttgccgnnnagnctgtcctgctggcntggccacaggccctttaggtggntacttttngtaaactcttcattcatcctggcattcttgagaatgttcgtnaaananaggggaagactcatcttcacgttcctttggtnctttaaattctaggtcttctccatattgaatgg

SEQ ID NO: 688316 - DNA, 158 bp, Homo sapiens
aagggggaatgataagcattgaaggacctccggaggaatattctaacaaggcaataccctgatccgctaccttcggcacttagtttctcgggtactattgcatatggttccaattatcaaaggggaatgataggcattgaagggacttcgggaaaatc

SEQ ID NO: 688317 - DNA, 808 bp, Homo sapiens
gatttcaggtttgttctctttccaaatgttgaatgaaaaacaaattttccaatccatttatccctggggaaggattcatttgttgcgagtgccagtatacttaaatgtatactttatatacatttaagcagaaatttaaaatgtggtctttgttctctttaaaagaaacacttctgtgtcagaaatgaaaataaactcatgtccttttactttcttaaatagaaagcacttcaaacactaacaataccacgaaacttctacaacaaaacgaaaaattattgactaagcccttgcctcttacttctctgggcacgaactaacaccatttgattatagggcttgagggctgcaacggactgcctttacacggtgcaccaatgaacgctagagtggcccatgcattgctgtgttctcttctaaaacaagctactaacaagagagagaacacatgcaaatttattaccagtaagcataagtcatatttaacattggaataactaagcattttatacaaagacttttcctcttgacccagcttgtgcacttgtgtacatcttcattctatctcagattcaacagcgtgctctgtcacataatactttgtaaatactagtgtgaaaaacagataggatgccttttccagtggtaggagcatctgtaagtgcattcaactcattacgaagctttttatccataaactagaaacccttatcaaacaacatagaacattttctttctacaagattattaatctcaccatacctaaacagaagtccttagaagtaatcattcaaccaaatgaattcca

SEQ ID NO: 688318 - DNA, 104 bp, Homo sapiens
ctagcggatcccttatgtaagatttgaacagcataatgaacaagcttgatttactgcacatagcagaatgctgcatcctataattaaagaatgcatattctttt

SEQ ID NO: 688319 - DNA, 512 bp, Homo sapiens
tcttttgttgggcctgtagggattttcagaaaacaggggtgtttttttgtaagacagggagcccagcttctggggccagccttgttgtaccgtctgggtcggaactatgcttttgttgtgcaccgaatgggctgagggatgcttaattcatgctaaataatgacagaagtaccccgtttgcccgagaaaatagccttcctcctgagggccataaccgaatatgtccacttgtttttaagacggacggaagctgaaggcatccctcctgctcactggtccttccactttagatgaacaggtggaactcacataacacaacctttttcgacaagatttcctttagagagagaacattctagggatgtgatcagtgggcatccgggctccaagcgaaaaaggcaacctgttacatagggcagttcccatttagccatgcaggcaagagacccattaaaaccttatgtgagggaagaggtcccagagaaaaggttcctctctgcgtccctgagaaa

SEQ ID NO: 688320 - DNA, 831 bp, Homo sapiens
  misc_feature (42)..(42): n is a, c, g, or t
  misc_feature (65)..(66): n is a, c, g, or t
  misc_feature (68)..(70): n is a, c, g, or t
  misc_feature (91)..(91): n is a, c, g, or t
  misc_feature (95)..(95): n is a, c, g, or t
  misc_feature (97)..(97): n is a, c, g, or t
  misc_feature (100)..(100): n is a, c, g, or t
  misc_feature (105)..(105): n is a, c, g, or t
  misc_feature (112)..(112): n is a, c, g, or t
  misc_feature (117)..(117): n is a, c, g, or t
  misc_feature (128)..(128): n is a, c, g, or t
  misc_feature (140)..(140): n is a, c, g, or t
  misc_feature (146)..(147): n is a, c, g, or t
  misc_feature (164)..(164): n is a, c, g, or t
  misc_feature (169)..(169): n is a, c, g, or t
  misc_feature (177)..(177): n is a, c, g, or t
  misc_feature (184)..(184): n is a, c, g, or t
  misc_feature (200)..(200): n is a, c, g, or t
  misc_feature (202)..(203): n is a, c, g, or t
  misc_feature (218)..(218): n is a, c, g, or t
  misc_feature (252)..(252): n is a, c, g, or t
  misc_feature (258)..(258): n is a, c, g, or t
  misc_feature (326)..(326): n is a, c, g, or t
  misc_feature (339)..(339): n is a, c, g, or t
  misc_feature (422)..(422): n is a, c, g, or t
  misc_feature (424)..(424): n is a, c, g, or t
  misc_feature (444)..(444): n is a, c, g, or t
  misc_feature (452)..(452): n is a, c, g, or t
  misc_feature (459)..(459): n is a, c, g, or t
  misc_feature (461)..(461): n is a, c, g, or t
  misc_feature (471)..(471): n is a, c, g, or t
  misc_feature (484)..(484): n is a, c, g, or t
  misc_feature (487)..(487): n is a, c, g, or t
  misc_feature (496)..(496): n is a, c, g, or t
  misc_feature (498)..(498): n is a, c, g, or t
  misc_feature (507)..(507): n is a, c, g, or t
  misc_feature (534)..(534): n is a, c, g, or t
  misc_feature (540)..(540): n is a, c, g, or t
  misc_feature (574)..(574): n is a, c, g, or t
  misc_feature (587)..(587): n is a, c, g, or t
  misc_feature (590)..(590): n is a, c, g, or t
  misc_feature (594)..(594): n is a, c, g, or t
  misc_feature (608)..(608): n is a, c, g, or t
  misc_feature (610)..(610): n is a, c, g, or t
  misc_feature (623)..(624): n is a, c, g, or t
  misc_feature (634)..(634): n is a, c, g, or t
  misc_feature (666)..(666): n is a, c, g, or t
  misc_feature (795)..(795): n is a, c, g, or t
  misc_feature (809)..(809): n is a, c, g, or t
  misc_feature (828)..(828): n is a, c, g, or t
tattcgttcatggtaactgcatgacaaaacatttcaggaggnatttacaatttccagcttaaagnncnnncccaccaacataaccaatttntgananccncttcnctacccngcttncccccccttcncggccctgccgnccaggnncaaagctacaacttggnctgtncctttggnggctggngttgggggtccatctntnntcaggtgcctgatancagcctgggcaacatagagaatccgtctcaacanaaaatnttttttagccaggtgtgctgtgagctgtagtcccagctacaaggtgggaggattgcttaggcctgggngattgaggatgcnatgagctgtgattgtgccaccacactccagcctgggcaatacagcaagactgtctcaaaaaaaaaaaaaaaaacccaaaaaancncaagaatgtaatgaatgatncccaatgngcctttncnggaaaaagtngccaaatatatcnctngggtctgcngngcatgtccnctgatacataaggcaagcatgtttctncccccngtgttgatgccagttagttttcagaatccaaacngggggcggccacnggncctngggactgacatccncngggaatataaccnnctcttgggcngagatgctgctgccagctctaaaacagcactntgttctcaaaacctcatggcaggctcctggctccaatactcagctgccaaacatgatgctgattcttcacgaatttgcaacccagttctctcgggtttgcacacccccactgtgggccggggaacgggncccggccttcgcanactccaggctctggcagangtg

SEQ ID NO: 688321 - DNA, 115 bp, Homo sapiens
tcaagatgaagaccatttgcttttctcgggagtctggcggtttttattaaggctgttcatgtgaaaggccaaggaggatgaaaggggttgttcttgttgacaacaaatgtaaggt

SEQ ID NO: 688322 - DNA, 126 bp, Homo sapiens
atcttagtgtttggatgaaaacctttgtgttgtttagctttcatttgctttgtatatttaataatggacctttattttccagtaagccaacattttgtattgcacaataaatttattttaaaatga

SEQ ID NO: 688323 - DNA, 873 bp, Homo sapiens
  misc_feature (70)..(70): n is a, c, g, or t
  misc_feature (873)..(873): n is a, c, g, or t
acacgccgtgtcagtactaacgctgtccaatggacatcgatggttttgcaggcccacctcataatcacancgacagcctttggatactaatgaaacaccgtattttatgaagagcatagactgcatccgagccttacgggaagaagccattaagttatcagaagagcagcgctttatcaccttcctgaaagcccttgaagagaaagtggaaattaactattacatcattggtgggaaaccgtggaccaggatggaattactctgatcaccataaagggagccgttggaacgcctgtcctaccctgaagaggccactaagtccctggcccccacgcacgcacacgtggcaaccggcgggtggattcaaacaaagcggtgagcgccacgacttattgcccagatgacccgcgcaccgtagcgccatataagaaatataccaagtgtaggtgcctgctcgccttaccaagccacgaagatctcgcatcgcatagcagtaccgaccatcatacaatcaccaggggataaggtaatttaagaactacgcccagtatagaggaccaaaaaccggccacgatataacatggcctccccccagaacgtaaatcgcctggttaacagtagcggcggtgactagtggagtcagctcacagaagtcggccccgccgactatagcatagataacattacaccagcgtccgttccgaatcacaatggagtaaatgcaggattacacgggcgaagttgctttctcaagtcactatcagagaaaccactcacgcgcactcgatggcctcagaagaggcatagaaatatgactactgtaccgcagcactacttgccacaacgatatttgcgtaacacgacttccaagan

SEQ ID NO: 688324 - DNA, 439 bp, Homo sapiens
  misc_feature (173)..(173): n is a, c, g, or t
ctgtccgattgccatgcctgcccaatccaactgaaggtgttttagagacttgagaaaaactagtttatagactactctagacattaaccttagtttttcctttgtttccatagacatacctcttactaacagacatcttacttacaagcatattacttacaaacatctgttgncctgtatcatatgtagagacttggctttgagatcccatctgcaatgccacctcctggaatggggcacaagtgtttaactgaaccgacttataagagactgattcaagaaggtatcagctgcttggtctaatgtatgctttttccccttcccctttgccagtctcttatctcacaacctctgacccaaacctcttcatagctaccaaccccattttaatatgtgaaactttctaaacacgaagtttcaaatggggggactaaaaaaa

SEQ ID NO: 688325 - DNA, 364 bp, Homo sapiens
tgtatcggcgtgtgagtgtataccagaagtgggagttaccggcccctcgatatgtaacaggaagacgggtgtaacggcagcatgtcattgctctcttatcggtcaggtcgagcgccatgacattctcattcccttaaaaaaacactcattcaaatctaggtcgaacttccacctttcatcatcaaaattatcacacaacatttattttgttttattcacgaatgcaaaagaaggccaataagtatatcttaaaatattatcagcagtccgtttggtgtggttttacatttttctgtctgcccataataaagaaatcttgcattgatttcatttgccccccttgtcatagcgacacggtctctca

SEQ ID NO: 688326 - DNA, 111 bp, Homo sapiens
cgaatccgcgtgctgcttctctttcttagccagctgttccttcacttgcttcacggtatgccgaagtacctccagctctcttatctgggctgcctccagagcacgaagata

SEQ ID NO: 688327 - DNA, 423 bp, Homo sapiens
aagctggagatcaagtatctgtaatcccaatgactcctgacccgaaaatgttaggctgagacaggagaatacttagtagtgcttgggccagctaacctggcttagatagcagcaaagagacctgtcttaaacaaggtaaaaccagattacaacgcaggagccatagctccacatgcttaccatgacatggatgtgcacttctctctcttgtgctctgtgtctctgtttctctctctcagcctctctctccctgtctctctctgtgtgtctctctgtgtctctctctgtgtctctctctgtgtctctctctgtgtctctctgtctctctctctgtctctctctctgtctctctctctgtctctctctctctctctctctctctctcacacagacacacacagagacacacacacaggtcgacgc

SEQ ID NO: 688328 - DNA, 136 bp, Homo sapiens
catacttgagctggtaccctcgataaggccaatatgagcaaccatgtccatctggtattcatgttttcaccaattaaggaactggtagtttgtgtgaagttacgcaaggtatgtgcttgattgtgttctgcagtcc

SEQ ID NO: 688329 - DNA, 131 bp, Homo sapiens
ttagttctactgtgggacaaaagcacagtcagtcacttgtggagacataaaaaaaaaggtcgcgattcaagggttgcggggtagtgtctttaaggcttgaggggttccggagctcgaatttggtattctgg

SEQ ID NO: 688330 - DNA, 423 bp, Homo sapiens
gtgtgtgtgtgtgtgttgctataaatgtccagcccagtgggaatacaaagagaaagcatatgagaattactgggtcactgcctactggagttgtgagaagagggccacagtcctccagaccccagaatggtagatccaccgacagcttgcactgtattcctggaaaagcctcagacgttcaacgccagcctgtgaaagcagccaggagtggggctgtaccctgcaaagccacagaggcagagcctcccaaggccatgggagcccacctcttgcctcagcgtgacctaaatcacttctcctttctgccgttatgtgaagaaggttatgtttgcttccccttctgccatgattgtaagtttcctgaggccttcccacccacgcagaactgtgagtcaattaaacctctttcctttataaattaaa

SEQ ID NO: 688331 - DNA, 244 bp, Homo sapiens
gcacgaggctgcttgtggaagtaataccaaaattgcaggaaggtatcgcacaaagatggatttgctaaaggaccaatctcatttgaagcaccatctgacacctgaccctcattaagaagagaaccattctccaaaagtcattggaacctgaagtttgagaaacagagaactacttagaaaaagaaatgctgaagtgcttgaaaaggaaacatcacaatggctattgggagaacataaataacgc

SEQ ID NO: 688332 - DNA, 1073 bp, Homo sapiens
ggggaagtggagtgctcccccaccagacagcctggagagtgctctgcagtgcacaagcatcagctgggaacgcagccacgagctggccagacatgtgaagtgagacgtgtggctgtgtgccccgagaccggagtgaagcggagtgtcccggtccccaagctcgcgagcacatgggcactgggagcacagtgcgtgcctcggtccctgtgagaagtggccgcagacccggtcccattccccagagaggaagggggctgtgagggaggctctaccccagcaccccttgcacagggggagccagtggcgggcaagacctcccacaccaggttgccagaccatatgggcggaagcacatgtctcgccggaggtggctacggccgacaaggcccccctgacaggcatcccccatgatcctggacggatggccagctgagtgtgagccggacgacctggacctggatcatggcgactccgtgagaggccggacaccgtcttcagactgatccctcacaccgacgccgtccacatccagctcgatgacatcgagctcgcacaccttctcccgcaaagccacagactcttccccagagcgagacttcccactgaagcctgcgtagcccccagcaactggacgtgaccgccatccacaccgcacgtagtcatcgatgcacgatgaaagacccttcgacaggccgcacccctccaagagggcacccaggacccacattgctcaggcggagcgcctgccaggtgacgaccaaatcaccgatctgcgctgtggaacgaagcgccctctccactgtcaggcaagggagaccgaccgcgcgtgagaacggtgccacgcaagcccccgcagcgcgcaccagagctcgccagcggccacagaaagctcgatagtggaaccgtcccccccggcggacgcgcggcggtcgagcgaggcgagacaacgccacggagcggccccgggtggccgagcgcgaagagcacctacaacacagaccacgcagccactcggccgcggggcgggacccccccagcgacgtcgggcccctctccacgcaccgctccccccc

SEQ ID NO: 688333 - DNA, 378 bp, Homo sapiens
gagctggccccgtctataatgtgtgccattttactgttttcctaaaagcacatattgacaggctacttcttttgaataattcagtattttaaaaatgcaagccaggcacagtggctcacgcctgtaatccagcactatggaaggccgaggtggggggatcacgaggtcaggagttcaagaccagcctggccaacatggtgaaacctcatctctactaaaaatacaaacattagctggccacggtggcgcgtgcccgtagtcccagccactcgggaggctaaggcaggagaattgcttgaacctgggaggcgaaggttgcagtgagccaagatcacgccaccgcactccagcctggcaacagaggggaagactctgcct

SEQ ID NO: 688334 - DNA, 637 bp, Homo sapiens
cgttgatgtacactgggggttgacccccgcaatttgttgtaaggtggtgggggaaacacttctcttgctcagtttcccaaaataaataggtgcttcaaattaccacccctgttatgtccgcgagtgactggcagcggggatcaaatattaaggttggtatgttttagcaccggggttgtcctggataattaatcttcttctccgcctctgttagtcgctcgcccctacgcaaaatgttcgatgtgagatggtaggcaccatgtgcccctcatgtatgcaccagcgggcggtgttctacccctcggtgtgtaaataaaaggtctccagtgctacttcttgtgcgaaacaatgtggcgcagtcgccagcagttcttgttgccgagcaggaacgtacactcacgggggagccccgttgatagaagttcccccaaagaattgtatttcggtgcgcaaggcattcttgcgacaaaggagttgttgtatttttgcgagaacaaatttcccagtgtgcgtgaccttcaaccaatagaatgtgtaaacaggcttgtcacattccctcacactatgtgcgccgcgcccttatccccaggttatacccccgacacccccccttacccctgcccaagttatcaaaaca

SEQ ID NO: 688335 - DNA, 338 bp, Homo sapiens
cgccaggttttccccagtgccgaaagagaccatttctgaacctgggaaggccgctatgaggggaggctggttatggagtgctggactgcaagacatttcaggcctacaaaggctgccagtagctgtgtaggagccgattcaaaagaggctctttggaggcagtagctggtcctgtagacacagctgctagagaggactgtgacttggagaagaggccgggagtcagcaactgcgttggtgtaggccgacttgaggaatttcctcggcctggagagtccaccaaaagggaaaagctgcgcctaaggtgtcctgtgggagaaatgagctgggcctttagc

SEQ ID NO: 688336 - DNA, 192 bp, Homo sapiens
ggcgaataaaaaacctcttccttctttaatccggtgtccgaggagtttgtgtgcgactcgtcctgctacatttcttggttacaaaaacctcttccttctttaatccggtgtctgaggagtttgtttgcgactcgtcttgctacatttcttggttccgtgaccgggaagcgaggtgattgaaggacggtcgag

SEQ ID NO: 688337 - DNA, 990 bp, Homo sapiens
taacctaggttggcaaatgcaggtttatacaggtctattagtgtcttgggcatcagacactcagaaagtcataggtatcaccttactccttttggctttctggacggggctagaatgttgagtatgttacgctcatcctatatcttgccgtagcatgtgaattctggcattagctctgatatggagaccctatgtgcttccttgctcaagtgccaaacgtgatgattcgtacttcgctgtagtatgtagtgggttaaacgacggagcctaggttacaactagtgccttattgttgttgcctagtgagagccgtccgaactcccgtaatgcctacttgggtacatgtgtggctctagagtattgccaagcaagctctcgtagtcggcctcttaaggtcaactattagacctagaacatcgctagtacctttgatctctactaacctctgggggcattggataacggtaatgtgtagtttatgggatatcacatccctgcccggttagtggttgcttccagtagaaatctttgctctggaaatgaaggcacgtcattgcttacgcactggtgacagcttgagttcagtggctttattcttctgctagccagtctctgtcccctgggccatgccatgtcgataggtttttggataggagtctaaaacttgatcgccagtagggcaagtgtcatgtggaaagttattcagagtataggctctcgccggtccagaggccctgaggattacttggcatgtcatgaaggcttttcgtgttagacatacagaaattgtagaccagttatgctttggccagaaggatgaatatcttaggatagttagctgataagggaggggtggagaatgggtgtggcagtgtatggtgtgtgatttttattttcttctttggtcatgggggcacaaggagcaaggcatgagtcttccctgtcaggctctaacagccaccggcacctgtgtccactgtctggaagaca

SEQ ID NO: 688338 - DNA, 113 bp, Homo sapiens
attcagtcatgcttcagtctattcaactgtgaactgttgaacacgtcttccaatagatgaaggcacacactacattacagagctacattagaacttgaaacacgtattaccaa

SEQ ID NO: 688339 - DNA, 204 bp, Homo sapiens
  misc_feature (191)..(191): n is a, c, g, or t
gcgggcgcctactactactaaattcgcgggcgcgtcgacaaatgaacgtgtgtctaataatttatatgagttctcatattttaaagatctgcaaatgtctgttgtagaaattgcttcatgtggtttcttttttactctgaagtactcctttttttagtcgtgggaaggtcgacgcggccgcgaatttagtngttgttgtcgacc

SEQ ID NO: 688340 - DNA, 287 bp, Homo sapiens
agaggatccctggggtctttcctgacaggtcacacgtatatcccttggtgtcctttagagggctgggaagctgtgggagatgacacacaccaagctctcagccatccggatgtgcaggaggagggatggggaatgacggtagaggcaggagggaaataagggggtgaggggagaagaacaactgtggctccagaaggaggaggcggcgtgaatcagcaagtggttaagtggtggggaggtggcaagggggaagcagtttctcatcttcgctgatttccaaagggatg

SEQ ID NO: 688341 - DNA, 541 bp, Homo sapiens
  misc_feature (521)..(521): n is a, c, g, or t
gttagtgtggtggtgtgacttgccgtcctagctactctggagtgctagcatgaattgcttgaacccagagggcagaggttgcagtgagctgagattgtgccactgcactccagcttgagcgacagagtaagactccatctcaaaaaaaaaaaaaaagaagagagatgaaggaggaggaggaaaagaaagaggtgggggaggggaaggaagagaaagaagaagaaggggacaaaaaaatttagctgtcatctgggctctgatagcataatactgatgatgaagacaatggctaggtgggtgagagagggctatatacacaccagaaactctccaggttatttggcaggtccaatatattgggttaagttatgtctcatgggagcaccttctttcccggtaactataaccagggctctgcaagctcagtcaacaacaacatggcatgttggctccataccgggactctgggtccattgggtaatgaaaccatcccaccagtgtcttcataatatatttttacncacacggggttaagtaagcg

SEQ ID NO: 688342 - DNA, 292 bp, Homo sapiens
gcaaagagacacacacaccatagacacgagcgatctgcccaccatatggacctcccaaaatgctgggattacaggcataagccaccgagcccggcactctgcataatatatatactacagggcagatataacttcccataattatatttttaccatattatatatataacctaggtacactaaaatatactctgggtgtagacacaaatacacggccctataagcaccaccacaatacaagacagcgaacaataccatcaccctcaaaatgcactatgcccccctttggccg

SEQ ID NO: 688343 - DNA, 1516 bp, Homo sapiens
  misc_feature (643)..(643): n is a, c, g, or t
  misc_feature (670)..(670): n is a, c, g, or t
  misc_feature (1516)..(1516): n is a, c, g, or t
tgagagctagaattagtggcaagggcaaaaagggctgactagaggagaaaactcatcccgggtacatctggcataggcgatttcggtcagtcgacgagtgggagctgacgcccgtatagataggtggaacttaactctgtgcgcagaccagggtccaaagcggaagtgttgcttgtgataaggcgatctcgagatcatgggaaacggaagtgggacatatcccaagaggaatagggttgggatgcgagggagggaagaagaaggtgtcatggcgagtaacagccttggcacaaggtcgtacttggagtgctgggagcgatggttggcatcgtgcaagaagaatccgtagatctcattggagtgtatgtaaccaggaagagacatggtggtatctattgaaatactgctagttgtatagtggccgtattggtcatgcaagacgcgtgcatattgtagaatgagcgtttatatagcgacgcgaatcaatatcgatggaatgatttgtgacgcgatgtgcatgatacctaagtagaacgtttgctggagaatgtatgcaaaggagtattcttaaatcttatgcgttgcaatattgcacataagtcgcgagtgacctaagtgtgtcggccagtaatcactgtaagcncattagtgagagggaaaggctcagtcnattagaagagactgactatctaaatggctgtcttttcgtggacgcctctgtgttgcgggacgcaggttcaactccgaggcaaacgaacctaggactcgttgcgagcacacatagtccattctcgatcacacatttcggtgtgaatagcaatctgaacctggaatttagcactggggaataacttccttaggagcagccacgaggagtggctgggggagccccaggttctaaaatggcggctaacgaaaaccatgagatgacgaacacatcgggcgacctcttccctcgggtaatacccccaaaatactttaggagagacagggtacgcacaaccgggaccctgcgtcgacaattcagcgcgtcacacgcgccaacaaacgcgacgccccggcaagacaagcggcaccacagacggcccagcacagctactcccaaaagagggcaacagccccaacaccaacccaccagagtcgggggccaccagaaggaggggcggaccactacccggcacacacccggcgtaacaccaagaagcacgaccagctggcgaccaaaccagaacaccccagggagaacaaaatctacgagcaggaacagaggcatcggacggcggagaaacacccgcagacaagcagagaaccgtatacgacacacaaggaggcggatcaaagggacgaacgaacaagcaggagcaacagagaccgagcgcacaccaagaccagcagcaagaagaaataaaagcacagcaaagacgacacaggaagacagcgagaaggacgaaaacgacagcaaaggggacggacggaagagctgagtttaatacgtaaacgcacgcgaaggagcacn

SEQ ID NO: 688344 - DNA, 422 bp, Homo sapiens
tttacggcatcaccgaccattaagggtgataacgcagaatggtcagctgctatctgtaattcactaggttgccgaatcacatcagtctagagcgctcgtaagatgctagtactcgcacaactggcaatatagtcgaaatagctgaaggtagcaactcatacaagatgctatgacatttatggcatacgcgaacggtaagcgagtgtccaccactggatgcatgcataaacactgacatctagtatatgcccaggcgttgggtccatgaaagactgagccagtactgagatatgggtaatcatagacatggctgaacgtgcgctgtcacagaatcatcacgcgttcgcaagtccttgcgatggttcatgacgtcgttgtacttcagcactaagtataggcgctcgtacagccgcatgtggtag

SEQ ID NO: 688345 - DNA, 305 bp, Homo sapiens
ggactagaggatcccagcggggaacaaagtgagagtcgctcagacagaagaaagaaaaaaaaaaacaggggggtactttttttagttataagtcatagatgtggaaagggataccggaaggtattttataattggtttatgtccatgtagaaggggatggtcccccagtcactggaacaatcactggaacaatcactggaccaatcactggaacaatcacttgaacaatcactggaacaatcactggaacaatcactggaacaatcactggaacaatcactggaactaggggatggtccccggcg

SEQ ID NO: 688346 - DNA, 1307 bp, Homo sapiens
ataacaccgaaattggtcgggattgacggccgggtgacagcgtggggggccctgagtggtgcctcgtgcgttgtgcccatgaggaatgtgggaacacagcggatgagcttcgcagcgagaggttatcgggcagtgggtcatccggcgagcctggagttcgtagtgccgtagcgacagagtgtggctgcgggccgaagcgccgtggaagcttcgacggaagcgacaaggtccgcaggagtactggaggatggaatagcccagtttactcacagttggcgccagcattggtacaccggagcattgactgaactcaatgatgcccgtggaaggacgagtctacctgctctatgtcaccgtgggcccagtgtaacggagcatcaggagattcagttgcagtgtttcctctacctggggcgggcccttcgtcgtgcaagggaattgaagggtgtaatcgagaggattgatgccgggttgcgagaaagcacgaatccggtgccgtgccagcgccacctaggattcaaccggcgaattttggtgagcgtatcgaggagactacagagtaggactcgacgtacggtcatgggatgtaaacttgctcgcaacggcagtgtaggggcacacggcaatccggtcgagggcgcatacagtaccatagggcacagaggcattctccaatactgatcgccactgtgcgcaggagagcatattgaggcggggaagcgaagagtcgagcagaggccccaagcgactagttcgcctatgcagatggtcgacgggggtcccgcgtgcggggacttcctgttgcttgtgtaactgggccctcgagttcctcggtgcagctccaaggggggcagcgtggactactctgtgctacccgcgaccctggtagccctataggaaaaggctagattccattgacttggcggttgagttattccggagttggagcgcttggggtacagagccttcaaagtgcccggaggggggttatgaaattgagcctaacacctgtgggccagagactttcggcccgacggaggccgaccccttttgggatgtggccagttatgctaaagaagacttaaaagggtaacagtaaacgcccgcgacaacttcttgtgtaggggagacacttgtgatttccaccagcaggattggtcccatacaaaggagggaggttcatgtgggatgacaccgtgtgtacgagaacgaccagccagagattttccggttgcacagggagacatacgagggccagccaggtggtacaacatcaggcgggtgtgttctacaagacagcaagcatg

SEQ ID NO: 688347 - DNA, 384 bp, Homo sapiens
  misc_feature (1)..(1): n is a, c, g, or t
natcgccttcgcgttgaaattattcccagagcccacagtctcccaatgtgtgtagttagcagccccacagcacttaaaatctgcttgcatcctgtccaggttcgaaccagtgtggttgtttttcgggtaattctccttctgctaccgaaagtggttattaacttgtgacttcactttatctctaaacacatagccacgcaatgtctgcggccacctccaccacctattataagagacagaatatatggcaaactgtgtctcataagcacatatagtttcctccctgtgcgagcgcccacgacacacgagccacacaatgagccccacgagataatgagaaagcacacactcgtgcatattatgccctgcgtgccatattcctac

SEQ ID NO: 688348 - DNA, 425 bp, Homo sapiens
atgtgtgaagagaaaaaattctctaaagcaggtgagctttaatgaacaaatgtgtattttatctgagtttgagtagggtgcgttgtggattttgtctcttgggttttttttttttctttgtaattatatgaagaaagtccagttctcatacatattgatcacttacaaaccttactctctcttgaaaaggtacacatgtccactttaggaacataactcaagtaggggctgcccccccaacaagaatgtttctccgcccgttcattccttatttcggacctggcactcggcttctgtttttcaatagtgacaagcacggttcagttctaggaatgttctggcagatgctgttaattttactttaaaatgagaatctggtgttactgtatttcatcgttttcaataaaacttcttaagtgttttgg

SEQ ID NO: 688349 - DNA, 140 bp, Homo sapiens
ccggtaccgaccaggatgtttaaaaaactagaaatgtgtcagaaattaaggtcacagaaggagatgatagtgaaatgtttcgagggtgaaggaggacattcagcattccagagaatcctgggtaaagtaagagaggaaag

SEQ ID NO: 688350 - DNA, 114 bp, Homo sapiens
cggccgatcaggatttattaagcaggtgcttctgggcagaaactggtaaaaaagtagggataactatagcatttcaagtgaagtcgtaggataagccgggtactgctgatagct

SEQ ID NO: 688351 - DNA, 186 bp, Homo sapiens
atgatacgacatcgagctggtacccccgctggcgcactgcaccgcctgcggcgctccacggtcctgctgtccatatgccaccgttgcacctccaccactctggtcttgatttgccagcgggacttgctgaagccaacatggtcaccccaggccatgttgacttcagaagttttctcatgaggagat

SEQ ID NO: 688352 - DNA, 244 bp, Homo sapiens
tccgcgtgcagttctacacaatcaatgggaatcttgatagcacagatgaccagaaatgcgtacaacctatttatgacaggggctgcagatagaaatcaagcacatccttgctaatttcaaaaactaccagtactttataggtgaaaagatgaatccagctggcatggttgctctattggactaccgtgaggatggagtgaccccagtatatgattttcttataaggatggtgtaggaaatagaa

SEQ ID NO: 688353 - DNA, 829 bp, Homo sapiens
tcaccccgttcccaggaattggaggagccccccatcccagaagtggggttgtttttttgttgttccgccttttttgtcggccccaaacacagcctcaaactcaaccctctctatgccatatcgctgtcttctcccccggtggcggcttggggggaccacaaagagcttgggggtcaccaaaagaagtgtaatagggggaaaaacctacgggcttttaatacctcggcccaaagaagctcggaagagaccccccacacacccacccatatggggcgcacacaacacacgcgcttatattcttggagagacaccccgcgtgaaactcggttcttttctttccacagagatgggagtctccctccctcggtggggctcttctgggaaggcaccatagggattggccacggcccactcgtttaatgggaagtttctcccaacgaaaaggcacaaacacccctcttaacaccgcgctaagaatggtggggacaatttatcaacagccctgtgcgttccagccctaaccgctactggctgtgtgctgcccaccaggcccccagccatccaagaatactgggatatttagaagggcaaagaatcccattgttagaatgaactgaagccaagaaagattataccagtacccagccagcaaggccagaacccacccccagtgcaacttcctggcctggtttgtctgatggcccggacgtctgtttgctggctacacaggacaaacactggtgcgagatgtggccggtgacccaatggccaccacacctagaaagttttatggccagaagcctttaccaaattaaaaaaaaactggcca

SEQ ID NO: 688354 - DNA, 99 bp, Homo sapiens
ggatttgctggtgcagtacaactaggcttaaatagggacatgccaccacctgaactccacgcctgggtgataagagcgaaactccaactcaaaaaaaaa

SEQ ID NO: 688355 - DNA, 403 bp, Homo sapiens
ggcccagagaccgagaggccggtacctgacaagtcacaacaaacccagacctcctcgcctgttcatgtctcagaccgcaaacctaccatgcatactgtctgctggcgataattacccgagctctgatgctccccgctgctcctggattatcgggccataagtcatggaacaactgaaagaacatggctcgatacagagagtatacgtgtaacgggcaccaaagctgatgtcgctttaactcacagttatgctgcctgatgccgatgaacacacagacattctccgatgttcaaggaaagttcacgtgccattgatgatagatttggaaagcgatgatcatcgaaggctttgccaacagtgattgtgatgtactctgacgtactgcagagatacgcgtctgtgt

SEQ ID NO: 688356 - DNA, 730 bp, Homo sapiens
cacagtttctccctccagcttatccggctctcatggctggcaaagcgtgacaccagtgccacaggtaaactgcaatcctgcctgcctctcttcccaataatgtggggagagcacggttttgctatggaagatagtcggctttgacctgaggctgacttgagagtcccagctgtcatgtctcttccaaataagctgctgaacttggaattatcttggctgaataattaatcaggactgtaaatgaacctcaaactgcctgggctttgcttaaatcctacacaggcactagcgatcaccttacgatcgaagacagattctgacgaatctgcctctcatccataggtggccactaggcaactcctctgggaccatttcttcctgctctatgctcccatgaccttcagtcataactccctcttcccctgcgtggaaacctacttctttgtaaccgtcctcataaggtaaaataggacccaggctggtgaacaaatagaatacatttgctctattctaaagagaagcattagagaagggatggtaaaactgatgcagagacataatcgagcttctgggctacatcatgaaatacttgagcagtcagcagacatgtaagaagagaattctactccccaccacacactataaccatctgcaaacctgaatgccgagacttagcctcaccagacgccagcagcataaatgagaggagtatatcaccctgggaggctca

SEQ ID NO: 688357 - DNA, 439 bp, Homo sapiens
  misc_feature (265)..(265): n is a, c, g, or t
gtcgacgcccgccgcgtcgctcgcgttgcacgacgacgcacacgcgtcgcagcattcccgcatacaacgctacctgcaactgctgctgctcgtgatcgccgcgggcgcgatctacccgatgctgtatctgcggcaggtgtaccagccgacgatgctgcaattcttccggatcgacgacgtgcagctcggctacctgtactcgtcgctcggcacgatctttctcgtcagctatctgccgagcggctggctcgccgaccgcctgtcnccgcgctggctgatctgcttctcgctgctcgcgacgggtgcgctcgggctcgtctacgcaaccgggccgtccttcaatacgctcgtgctgatcttcggcgcctgggggctgaccaccggcctcacgttctgggcggccgtgatcaagcgcgtgaacatgatcgccggccccgac

SEQ ID NO: 688358 - DNA, 202 bp, Homo sapiens
ccccccccccccccccccggggggggggggtttggggcatttttttggggggccccccccccccccccctttccccccccttttggagagaggggggccccaaaccccccccccggggggggggtttttttttccccccctttttttgggggggggggggttgggggccaaaaaaaggggggggttttttttgggggggtta

SEQ ID NO: 688359 - DNA, 207 bp, Homo sapiens
  misc_feature (134)..(134): n is a, c, g, or t
caaggatttgcgacacctcaagctcgaaggtacgccgcagatacgccggaggccacatcatcctcgacgtggactcaacaaggacagccgggggagaccacgcctgcgggatcgcgaatcacaccaagcacgtnaagacccaggtactgctcgagaacggcggcacggtggtaatcgggggcatcttcgagcgggtcgaccgggatg

SEQ ID NO: 688360 - DNA, 164 bp, Homo sapiens
ttgatctagaggctcccctcggaagaggggaagcacgggtcttaaaatcaacgacggggggtggccacgcagggggaggactccagtaaggggaaactatagggccggaataataaagaacagtattttacaattatatacaccaggtccttacctcgtgcgga

SEQ ID NO: 688361 - DNA, 628 bp, Homo sapiens
  misc_feature (203)..(203): n is a, c, g, or t
  misc_feature (286)..(286): n is a, c, g, or t
  misc_feature (315)..(315): n is a, c, g, or t
  misc_feature (359)..(359): n is a, c, g, or t
  misc_feature (384)..(384): n is a, c, g, or t
cggtcaaggggccaaggcttacttgaagaagaagtcccttggatcttttgggaaaaacttgaaatccggcaaaaatttcgtggccgggcaagatcttccctcgggggggtcacaagccacgaggcgcaggaagaaagaagaacttgagggcttggctacgacttctacccaggaaaaatgatgtgcacggacttggggccgcnaaggtcaagaagcttgagttacgggaaaatgttcttcacaatggaatggcacttaccagtcttgggtgtggttgcaagtgccnccgcaggacacagccccctactcctgcancgtgcagcacacaagcctggccagccccctcgtggtgccctggnaggccagctaggaagcaagggttgnaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatc

SEQ ID NO: 688362 - DNA, 222 bp, Homo sapiens
gtaattctgatttcgaacagaggagggtggtgcttctgcatggaggtggcagaggaccttgattgattgccgtcacggggctcagtggcagcgtgcccgtctacgcattcacagccctggatgccctggctgatgggggtgtgaagattgggacttccaatggccgccatggcatgtcctggcctcggtggcccatggcccatcctggttggcttgccaatg

SEQ ID NO: 688363 - DNA, 115 bp, Homo sapiens
  misc_feature (107)..(107): n is a, c, g, or t
ggcttttgcaaggctgtggtcggtggtcatcagtgctcttgacccaggtccagcgagccttttccctggtgttgcagctgttgcctcaccgccgccgttgtcgccgncgccgcct

SEQ ID NO: 688364 - DNA, 468 bp, Homo sapiens
ggtgaaaccccatttccactaaaaatacaaaaaattagctgggcgtggtggcgagcgcctgtagtcccagctactcgggaggctgaggcaggagaatggcatgaacctggaaggcggagtttgcagtgagctgagatgggcgccactgcactccagcctgggcgacggagcgagactctgtctcaaaacaaaaaaaaacaaaagacccaaatctggagtcttaatcggtgtgtactggatagaagggtcagatatccccactatggagttgagtggcgagaaagaggatctcaccttaaggagaaaataaactttccccttttaaagaaggaacccaaacgtgggtcctgtgggtacggcaaggggttgttacaaggcactctgtggtgacaagttatggacgctctgaaaagacctgaaggggccaggacagtttggcatggggcttgagttataccagtctagacc

SEQ ID NO: 688365 - DNA, 150 bp, Homo sapiens
cattactgtatctgtactgatcgtactcggccagaggtagggattgcgtttcaaacatctcccctaagagcaattgccttagagcccatggctgtggtcataatatacttcgagagtagaactcctgatgccatagttctgctatctacc

SEQ ID NO: 688366 - DNA, 906 bp, Homo sapiens
ctctagcaggacctgacacatagaatgctagaatagaataattattggatcctctaaagatgtctctgggggttttatatgttccggtatataattgatggcttataggtttatcattatcccaccacttccggtatttttattattgttcaggagtttaagactagaaagactagagtgctttctagtcccaatagaggtccgtgaaacagcttttggcatcagattttcctttggagaggggagagctgtggtactggctaaaaagaaagggagataacatccagtaaccacaggaatatattctctgtgaattaaaagtcttcaaagttatcatttctctgacatatgtaggagtagtcatttccattctttacatagtcatgaactggattgataaccctcatcatgcaatattttcacgcccgtacaatttttaacaggggtatccttatttgatgcatcacgcactatttacgttgtcagattgcgtccattattaacatgaattaagtgcacatttgaagttctcatggaatcaattatcttgacacttgggcctagacttcgacatgtccaaggtggctgtctataaagttttgactatcattggacagcaggatgaacgcctacagccagcatgagtctctatccatagctgaaccctgaggacagcctcatagctcatgtaatcagggcactattgccacataacacgaaggcaatagcatgaaccaaaggtcaacaattaaaggccaaagacactaaagcaagaccggaacccactggtacccataatgggaacaaacagaacaaacaagtacaacggacccacaaaggtcaccctataaacaatcctggaaccacaataaaaacatcaagaacaaccaagcacacctgcacgga

SEQ ID NO: 688367 - DNA, 137 bp, Homo sapiens
tttttcatactggcaaatgagaatgacagacaggttctttgcatgatcgccactagtgagggagtagggtgtgcctgaagtatagaggctccccaggcaatcaggagaccagctgccaggcacccctaggctggccc

SEQ ID NO: 688368 - DNA, 286 bp, Homo sapiens
  misc_feature (57)..(57): n is a, c, g, or t
  misc_feature (156)..(156): n is a, c, g, or t
  misc_feature (204)..(204): n is a, c, g, or t
aacatttgaacacactgctttaaattgtccaactctccatgaatattgaaagatttnctgatgcatcaaaataaatcccactgggaccaaaagatatttccctgcagactaaccgaaacatcttctaatatgatgacaacagtgccaaatttgcanggaggttgatttaacttccttttcttaaatccaaatcagcctaaagtntttcttatgccagagctacaaatgctttctccttttttttttttttcctgagtctcgctctgtcatccgggctggagtagca

SEQ ID NO: 688369 - DNA, 316 bp, Homo sapiens
tctagtggatcccccgtccgtcgaccgctggatctgactcaaagtaggacacacagaggttgtctacatgtttcgtatgtatcttcaggcgtggagggctccattgctgatcaaagccaagaggcctcaggaaggtgacatactcctggaagaaaagcgtctggtactggttgcggcgcaagtcttccatcagccttgcaatttcagaatcctgcagcttcgagccaatggtgagctccttctggatcagctccttcagctccttcttgctcagggtgtgcttgtcaccctccctgccggagtacttgtggaagat

SEQ ID NO: 688370 - DNA, 344 bp, Homo sapiens
  misc_feature (293)..(293): n is a, c, g, or t
  misc_feature (305)..(305): n is a, c, g, or t
tgtttaagacttagcaacgaactccctttccctctcttttcttccccttcctttttttctctccttctctctctcctttccccctttccttccttcctcccttccttcctctgtaatatgcaatgatagataaatcgctatgccatttattacatgtaaacctaatgagactgatttgtgaatgtcatgagaagaaatacccaagttatctttcttttttttttaaacttataaattgtttatttctgtaaattttccatttaaagatttctggaccatggtttgaccatggnaagtgaaactgnaacataaaggggagggactattgtacctaaggttaaata

SEQ ID NO: 688371 - DNA, 530 bp, Homo sapiens
  misc_feature (416)..(416): n is a, c, g, or t
caacgatggtcctcagctggagcaggacaaaaattaggaaagtgtctagttattaaccagtcaacgggctgcgtggggccaatggtcacagaagtaatggtttttacttggtggatggtttctagagagagcaatgggacctccaacaagtctgactggtagcatgctggcttcctgagtggttatgtgcagataagggttgggcttccttccggggcttgtggttaccggtggtgggtgagagttctgttggtgtatatggcctggccatggtctgtatatttggtctctcttttttttttggagagggagtctcactcggtcacccaggctggagtgcgggggcgtgatagctcattgcaacctccacctcccaggttcaagcaattcttgtgcctcagcctccggataggggngattacaggcacacgccatcaggctaactttggtattccaagtagagacgggattccccatgttggccaggatggtctcaaaccctgacctcagatgaccaccatgtcgaatcc

SEQ ID NO: 688372 - DNA, 367 bp, Homo sapiens
cccccccctagtttttacccgtgcattttccctataacatgccctataatggctgcatcccttttgggccccctccaaaatttacatttacccagtaggtaaattagggatgcctgcattatcaaaatactttcagggttcctataaatggcagctttcctgttgtattcaggtgttgtttacagactaccaattggtttggccaatcccctggttaaatgcccttcctggggttgaaatgaacccgtcgatttttccccaatcgatgaacccatgttttgcaatgccaatattaatttgatccccccctaacattttttttatggaaaacgtatgttgcataaaccaaggcccccttttgttttta

SEQ ID NO: 688373 - DNA, 440 bp, Homo sapiens
  misc_feature (317)..(317): n is a, c, g, or t
  misc_feature (343)..(343): n is a, c, g, or t
  misc_feature (359)..(359): n is a, c, g, or t
  misc_feature (369)..(369): n is a, c, g, or t
  misc_feature (426)..(426): n is a, c, g, or t
  misc_feature (433)..(433): n is a, c, g, or t
gtttcctggggctgctacgacaaagtaccgcaactgggaggcttaaataacagaaagttcttgcctcacagttctggagatgagaagtctggcatcaaggtgtcagtagggttggttccttctgagggctgtgagggagagtctgtcccatgcctcactcctagcttctgctggcctcaggcattgcattctttgttgtaggggatagtgttcttccctgtgtgtttcacattgccttcctctatggcatgtcggtctttcgtgtcccaaattttcccctcttataagggacctcagtcatctgggggatagggggnccaccttagggggacctcgttttcantttcatcacccacttntaaagacccnatctttcccaaggaagggcacattcttgagggacttggggggggcttcaacaaatcnttttttnagggggg

SEQ ID NO: 688374 - DNA, 721 bp, Homo sapiens
  misc_feature (7)..(7): n is a, c, g, or t
  misc_feature (67)..(67): n is a, c, g, or t
  misc_feature (95)..(95): n is a, c, g, or t
  misc_feature (105)..(105): n is a, c, g, or t
  misc_feature (243)..(243): n is a, c, g, or t
  misc_feature (256)..(256): n is a, c, g, or t
  misc_feature (267)..(267): n is a, c, g, or t
  misc_feature (347)..(347): n is a, c, g, or t
  misc_feature (392)..(392): n is a, c, g, or t
  misc_feature (424)..(424): n is a, c, g, or t
  misc_feature (446)..(446): n is a, c, g, or t
  misc_feature (469)..(470): n is a, c, g, or t
  misc_feature (528)..(528): n is a, c, g, or t
  misc_feature (573)..(573): n is a, c, g, or t
  misc_feature (588)..(588): n is a, c, g, or t
  misc_feature (719)..(719): n is a, c, g, or t
gctctcncccctccctcttgccaatacaactcctgacccatttcctcagggccagttcaaaactgancctgttcactgctgttttcacagaaaanaaccagtgcnagggatgtaggggaagaggattggaagagggcaacagtactgtccagcttctacccaaagataggcaaggtggagattcacagaattcaaatgaatggactggtggcctcacaatgacatagtctaattaaaatgggntggaggggatctnggtgggttaangccattgggggctttataagacatgtcatgggtctgtgtcagactcagaataaccaacaggggaagaatggggggggccnggggggcagtctgatggaaagttcacaattctcccatgttgggangtgggaaagtccggggggcaccaagcgcctcnctcattttggcaggaaaacttnttctagtgctggggagtccccannctgccacggaccctgagaaaggctaccaggggatgcccagtttcccaaagcccggtgntcctagttcgccccttgcggtggggttcatgctactgacagaganactttgaaatccaanggccgggagagtggccttttaggaagtccctctgcaccagtcacccaaacttgaccccaggttagacaacctggctgagtttcacaagcagctgacaacattgggggtagggaatgtcacataaaaaggantt

SEQ ID NO: 688375 - DNA, 763 bp, Homo sapiens
gacaacacttgagaaatgggcaaacttaggacaatccacaaagcatcctgttaacgtgaatatcagcatagaaaagaaatagcttggcactattctccatatgtgtatccaatagattttatatgggcaaaatttacaatattacacataacatttaatattgctagggaaaagcagaccagcatattttagctgtcagagcacattcgcttcatggcatgtcctcttaacatgcactatgagggcataggtcgaactcccacactgcttctcctaacatgtacatgacacacaacatcacaaagcaaccgcaacaagacatgagagacctggcagctacatacatgcgctacgtaggaactgcacacactggacacaagccatttctggaacaacacgtttccgtttccttgtacaagttaacaatatactcataaggacccggacataccactcccaattatttatctaagcagctaaacacttatattcacacaattcatatgccaatgtacagtagaatacatctttaatctttcacataactaaactgggagcaacccaaatatccttcactgagtgaatgaataaactcaggtacatccatatactggcataccactcaacaatgaaaagaaaactattggctgaaacaacactggctaacagctcaacatgcataatagcctaacctgaaagaagccagaatcaaaagggtatacagaataccggtaacatcccattagacatcacatactggcaa

SEQ ID NO: 688376 - DNA, 277 bp, Homo sapiens
gagaaccccctagcacttccctggatcattggtatcaaattgacctacagcggtaagggcgacgccaactggacgcagacgattaccgttgcgcaagacggaaaggtcacggagagaagggtggactctggtccaacatactataattcaagcgacttttctgcctaccctcaaatacagaatgggagagttttcacggatgcgcccggaatgaaccctatatcgggactgtccaaaacatacgaattgtctctcattgttcgtagtggatcggcgg

SEQ ID NO: 688377 - DNA, 1479 bp, Homo sapiens
  misc_feature (978)..(978): n is a, c, g, or t
agcggactacgtgaggggaggcttccctcccacaggaactcacacctgtgggcaggaagccgggaggcccgccccctgcctgggttcctgcaggggaaggcgagggtggctggatagagcgtgccctgtagaggtggttgggcacggaggctgggcatggtgtggcacgctgcgcatgggtggaccgggagggagggcaagaatctgcggggggcgcccagatcacttccctccacggtttctcggtgactgggggcggggaacgagcgggaatgtggggcgtttggggaagaggcgagaaccctgtgttcgttccccacgattcccccgttattattcaagcccagcagggctattacaccgaggggtgccgcgaagaacaggggacaatttattcttcgaagtagagaaattttcgccctgggggttttaacaattacttttctttttaacaagaaaacaccggaagaaagcatttttggcaaaacacgacagtcgggaggtcgttatagtaggcgaccccgcgttccgcagaacaacaatttgaagccccctatttgtgtaagttgggccgtctctgcagaacagcacaggtagttgtggggcgaaccccccgaagtcggagatttaaggagttggcggatatatagatgtaccggtatttatataggtaccagtaatacggtggtaaatactcgttaccggcaagtagagaactttgtatgacaaggcggccttttttccttttttcctagaggagaacacacgacaggggtgcgcaccaagggcggtgttcccccctttttgtgaacacccccacgcggccgtttggaggaagagtcttcctgtgggaagtttggtggccgacaccgccgacaatttaacgcgttaaatttataggaacacgaggcagaaggcccacggcgcacacttttggggagtcgccccttatagtaggtaggcgcctcggagaagaangcccgcgaaaaaaacagggttatcccaacaagtgtgccgttgcggagaaaacactttcctaaaagagcaatttcccaacgcaaagcgaggtacctcaacaaacgattctccgacaggacgaagacgggcggctggacacacacaaccaggcgttaacaaagttctcggcgttttttcccccccttttgaaaaacttggcgggcggaagagttgggggcgaccagcccaccactcttagggttttggtagacccccccacatggagaaggaggcagaacccacatagctgtgtgggggggcgcacagcacattaatttctcagacgacctgtgtgatgtccacccagataggcgtggccgtacccccctttttaagtttagttcttgaaaagtggaaccgctttttcacaaaaacacaacattatgataagaaggaggacagaagttatggagtataatatctcccgcggaaacgcacactctttggttaaggacccccgcg

SEQ ID NO: 688378 - DNA, 299 bp, Homo sapiens
  misc_feature (3)..(3): n is a, c, g, or t
  misc_feature (6)..(6): n is a, c, g, or t
  misc_feature (52)..(52): n is a, c, g, or t
ttnagntatgcttttggagtcctggatgggaatctggggggagaaaggaagnacaggtcaggtctcccccagccccttctgctcctgtctcctcgtgtccgcattgctggagctccacctccctcttggtttagccgcacccgcccattttccttctgtctttacctgcttcgtatcctttcccagataatgtgaataacccctttacacacccctcctatcaaagtctgtccaggtgacagtgtaccaaccgtatctgtaaataaagcaatgcagcttatgagctggttaaaagaaaa

SEQ ID NO: 688379 - DNA, 418 bp, Homo sapiens
ttatggaactagattgtggactatcacctcatccactttgaccgccgtggtacgtatgtgtgtagagcagggaagggaactttcctgcctatatataaaccctgggaccgagaattcgatggaatctagcttgatcatgagactctgagagccaaacaacgcatcaatacctcttggccagcattcttgaccagatattgtactacttgtagacgttttttcacgcgcctcgatgtaccatgtgggggatatccacgtgccttagccttcgtcacaagtgctgctggtcccccagggacacacacagcagaacttagggcggggagtggacttaagcctgacggtgcccgagaagcgcttgtccttctggggatcatagttcttcaagctgatctgcaactccaccgtctccaggaac

SEQ ID NO: 688380 - DNA, 964 bp, Homo sapiens
ttacgtagtaagtaggccgctcgtgtgactattaatatctgctgggcgctattctgcgggtgtctatagcgacgacgccttgttagaaaagttgcgcagaaatatctgggtgtaggaccgctgtccaacaagtgcatggccgcgggaacggttaaaccggggcgtacccccccaggcaccttaaccccttggggagacctgctccctccgcccgggggcccctgaacctcttacggtgcactcttgctctcctttgccgttcgcagaccaaccgtgttgttgggataacgcctcccgttaaacacggggcgcccaaagtattggccgggaaacacccgggcaccggtcctaccgcgggcacataagctgcgcccaggtggtaaaaaccggcgagcgatcccagcggtcaggggaaaaatttcccattcaggggccgcctaccctagcgagctgcgtatgttgaacccagcactgggcccaaaacgaggtggtgccccgcgggaacgcattgtgtggcattgagttttttcaaaagtgacctctgtttgttggattacacgacattatatcgggcgctttcagcaacggaaaatggcgcgcaaacagcccaaacgatggtgatctcaaacacctcgggccccccttgcggaaagtctctatgatgtactcaatatgttctccacttgcgcttggtacacatacgcgagaactttagcgcgttcttccaagcaatcagtaaaacaaatgtcttgttcccggtgactagcgattgcacggcatatgtactattgctccacgaacatgaggcgaacaccacagagaggcggactagaacaacacattgaattcagggcgtcggcgatagaagtcaaacgaggaatattggagactaacgacgcacttgtgtactatcaatgggaagaagcagttttaaaacaatcaaacaagggcgacccaaatgaca

SEQ ID NO: 688381 - DNA, 235 bp, Homo sapiens
gtttagctgggttttctgaccaggtatccctgctgctatgttgttcccgtggtaaggttggacgcacggtctaagctaattccgatgggctattttaaagagagcagaggtatgagccagagtggcgaagtgagtagttgggcaggaaggacagttaggaacgggtaactaaaggtgacttacatcagagcaggtgaccaggggtgactcaggtcaaagcaggtgacggggatga

SEQ ID NO: 688382 - DNA, 300 bp, Homo sapiens
cttctctgtccctctggattttctccctcacacgtaccccggtctaggactcgaaatgttacaccgggcaggtctccaggccactcacctctgcgtacgctcgtggttgtatacactctatatcggaccgactccaagagctgccaccgctcggtgctgcactgcggccccccacgtgaactcggttgtaacggggcttggaagaaaagctagagagagaattgcggagaatcagactccttttccagggcctcagctccctcctagtgttgccgccctttactccctttctggtgcggt

SEQ ID NO: 688383 - DNA, 116 bp, Homo sapiens
  misc_feature (11)..(11): n is a, c, g, or t
gtcagatatgnatcatagatatcgtacgagaactagcgcgaagagtgatcaggtatgcagttagatatccccgagtctacaatgctatcattacctttgatattgggggctcaggt

SEQ ID NO: 688384 - DNA, 191 bp, Homo sapiens
  misc_feature (38)..(38): n is a, c, g, or t
gccaccgaggccccgccctcgccaaacgcggcggtggnttcgggcaaggccgacgtggaggggggcatcatccagatcgcctcccgcaccgccggcatcgtccgcgaagtgatcgcccaggaaggcgatacggtgaccaagggacaggttctggcccgcctggaagacgatcagcctaaactcgccgtgca

SEQ ID NO: 688385 - DNA, 500 bp, Homo sapiens
ttcaaagacagcgtgtggatgctttactcatagaccttagacagaaatttccacccagatttgttcagcaaaagtctggagaaaagcctgtcccagtggatcaggcaaaaaaagaggcagagcctttgccagaaactgtaaaatctgaggagaaggagagcacaaagaacattcagcagactgtgagcactaaaggtccccctgagaaacgaatgagactccagtgaatgttggacgaggaagaagctggccagctccttgtcagtcgctatacctcagcaccgtgggaggctcttgagcctggaaacactatcgcagtttgtacggaatgcacttgttctttacaaaaggacgttctccctaccatgttttctatgtgaatatttcttaaatatcttttgtaatctttcctctactggacttgggcagtgcacctaactcacagatatgccagtatatatctttaaaacaataaagttatttgtatatattaaaaaaaa

SEQ ID NO: 688386 - DNA, 1432 bp, Homo sapiens
agaggagctcaagcccggaacaatccccacgttccgggccgcgacacctgaccctgcagcgtaccgggaagcgaaaccggccggcatgggccgcatgagcccgaatcgggcacatgatgtggagccaccctgagagctgagatcaggatgttccgctatcatgagggacgctggagcctgaggactcccatgcttcctgcatggcatcccattatggcatacttcacacgtcagccaaatatgagccgatatgattgatcagcgctggccttagcgatacctagcccccttccctcaggccatcacagactgcgcacaccatgccagggcaccagagccatgccccagcccgccggcaattgccagacacggcctcggcaagctgctcatcaccccccttcggcgcatgcctgcggcaactgtccggcgctggacctcccaatggacacactgctcaaggcgaatgcatgcacctgcacactgacttgggcaacagcaagtgcgcaaccacccgctgcaacacggcctcgcgcagcgccccactctgcaccatgcacgcctttcgtccacctcctttcccagctggtcccaatcctcccttactacccaactacacgagcgatgcactgagcatgcccccccccccaggctactaggaccaagagaagcaaccactccacgcaggacctgcacgcccccgcgccaacccagcggacggacaactcctagggccacgacccacgcacggggaacctggcgaccgagcggaaaccccagccaaccagcaggaaacatggagcagaccagccattgctgcccccagggcgcaaaacgcacagatccagggggaaaccaccggccaccaaccaactgccgacgccgacggcctcccccaacacagaccaactgccacggggcgcggacacacaggacgcaacaccgcgcaagccacactcaacaccaccgcgctcgcctgcgagcacctcacagcccgcacgccgggctaggaaccgcaccgagacggcacaggcgagcagaaagacccagcgcgacaccagccaagacaccgagcccccatgcgacaccctaccgcacgcaacgcaaacacacgtaaggagacagagaaggacacgaacagagaagacagaagaagcacacacaccgcatggcccaaaacgagagaccccgaagagagcaacccgccatcgccacgaacagcgcaccgccagcgcagatcctcgtgacagaagcaacgccgagcacatagccgacacaccggcgcacaccgccaagacaccgccaactagcgccccactaccgagccaagcagacgaacagcacacaccaaccacgcaccgaccatccgtacacaacagcgcagcgagtgaccaccaactaggagggaatcaagaaacagacaaacgacgagacc

SEQ ID NO: 688387 - DNA, 668 bp, Homo sapiens
ccccgaacactgagtcttgtctatcaaatgtataagatcccttggttcacctgcaatttactctacctcctcctccctgaaatcaccccaggcaaataaaggactccctgccctatttactcactgttctgtcagaggttcatactcatggtgccccatcattcttcaaacacttacttgtaggagccagtactaggaggtgagtagaacggaagaaagcttgggtcttaagaatcaaacctacctaagttcaaatttcagttctgtctctgagacaatagggagctttgtcaagggatgacctgagtcccttcctcaattataaaaagacaccaccgtgcccagcctaaatccattaacttctgtttggatgccctgcccagctcaggctaccatcggcaaacaagagaggtgctccagaattgaggaagcactgggcaaaatgcaggcatgatcgttaacctctgtaaggtggacccaggttcagctacatgagccaaacatgaaaggtgagggctggtgggaagaaaagcaggtttaattggagagccggcaaatggagatgtcaaacgagcgtactaaaggagcatcttaccttttcaaattgaccataggggtttaaagcgaaactggctgggagattgggaatgtgcgggccgagctggtct

SEQ ID NO: 688388 - DNA, 256 bp, Homo sapiens
aactcgagctcggtaccgacatatgagtctcatttacgtactagacgaggttaaaggttgccagtatatgacaacaagtagatttagtaagatctactatcattgattacagcttagtgttacaattcatagatgaagacttcttaaaaacaagtgagcttgttaaaagcccccctgaagcattacagatggcttatagctgtccacggggttggtagaggtgggaaagggaagggttctaggacacgaatgttca

SEQ ID NO: 688389 - DNA, 850 bp, Homo sapiens
gtagctgttctcttctgtcaaccccacacgccttaggcacaatgaagctgggtaagctctatttcccttctttttctcgtttagctcggtttattccaggtgtgtgtatcgtcgagatgcacacaacgagtgaggttgctcatcggttataagagatttgggagaagaaaatttcaacatgccttggtgtggattgccttagctcagtatcttcagcagtgtccattggagagatcatgtgagaattagtgaatgaagtaacctgaatttgcaaggaacatgtgttgctgatgagtcagctggaaaattgtgacaaatcacttcataccctttgtggagacgaaattatgcacagtgtgcaactcttcgtgaaaccatatggtgaaatggctgactgctgtgcacatacaagaatctgagagaaatgaatgcttcttgcaatacaaagatgacaatgcaaatctcccccgatcggtgagaccagaggtcgatgtgatgtgcactgctttccatgacaatgaagagacattattgaaaaagtacttatatgaacatggccagaggacatccttactgtatgccccggaactccttattctttgctacaaaggtgatagagctgtttaacagaatgttgccaagctgctgataaagctgcttgctgttgacaaagctcgatgaacttcgggatgaaggggacggtttcgtctggcaaatagagactcaagtgtgcaagtctccaaaaatttggagaaagaagctttcaacggcatgggccaagaaatacgcgtgagccagaagattcccaaacttgagtggagaaatttcaagtagtgacagaatttacaag

SEQ ID NO: 688390 - DNA, 110 bp, Homo sapiens
  misc_feature (31)..(31): n is a, c, g, or t
tcagcttgctatgtgcttgtccaggcagaangcacaggagtgccaagtttctattagtgtaacatgtattgatttaaaaacaaaacaaaacaaaacaaaaacaaaaaaaa

SEQ ID NO: 688391 - DNA, 236 bp, Homo sapiens
tctagaggatccttagtttagggcgacctaagatgaaagttagaaccacccccttttgaccaggcgcggtggctcaggcctgtaatcccagcactttgggaggtagaatcgggtagatcacctgaagtcaggagtttgagaccagcctggccaacatggtgaaaccccaattttctactaaaaaaatacaaataacttagccgggaagtggtggtagcgcgcccgctagctcccag

SEQ ID NO: 688392 - DNA, 548 bp, Homo sapiens
caccctcatcctgatcaactacatcttcctcaaggaatatggaaacttcccttcagcccagaaaatactagagaggaggacttctatgtgaatgagacaagcacagtgaaggtgcccatgatggtccagtcaggcaacattagttactttcgtgattcggcgatcccctgccagatggtacagatgaattatgtgggaaatggaactaccttcatcattcttccagaccagggccagatggacactgtcgtcgctgcacttaatcgggacacaattgataggtggggcaagcttatgattccaaggcagatgaacctgtacatccccaaattctccatgtctgatacctatgaccttcaagatgtgctggcagatgtgggcattaaggatttgttcaccaaccaatctgatttcgcagacaccaccaaagacactcccttgacattaacggtactccacaaggccatgctgcaactggatgaagggaatgtgctgcctgctgccaccaatggccctcctgtacacctgccctccgaatcattcaccct

SEQ ID NO: 688393 - DNA, 142 bp, Homo sapiens
gacgtgatacagtgctgctggataaatctggaccttggaagttagcagatttggtacttgtctgaagataataaggaaggcatggtacgatgtgatacagcggttggaacacctgattatatttcccctaaatgtatcgtga

SEQ ID NO: 688394 - DNA, 243 bp, Homo sapiens
aagctgttgatagaataatgtcctcgaccgaacaatgaacttgtaacacgatattcgcaaagccttcaacgttcttagtgattgggtcacgattgtctcccctctgctggaggtatccaagtaagtcttcagacactgtcatcaatttcttgtaagccaaggtcgcacggggaatgctgtaggactgtaagcctccaggaacggtgttgtaaatgctgaaatttccgagtctgcaatgagtcc

SEQ ID NO: 688395 - DNA, 837 bp, Homo sapiens
gcgctgttcagtgcctgtgttgcagagggtgagggcagctggagtgcgttctgcgcgaagcttgtggttgcacgcccatcgtcttagggagctaccttccgtgagcgatgttcaagtctctgaatgaaggttggtggaggagagccgcgagaagaaccgagtcctgaggtggacatgagtgaccggggcatctccaaacatgctcggatgtcaacggacctctttaccttatgccatatcacacaactggtcctcatgcgatatgcaaggctaacaatggtgccagcgaaacatcgcagaactgaagaattgggaggtgctcagacttttttactaaccaagatcgaggagctgcccactacagatcacgtagccttcagaaactcaaacagcctgaaccttggcatgaagcaggctgaacactttggcacgaggcttcggctccctgccagctcttgaggttctggacttgacgtacaacaacttgagcgataagattctcttcctgtgacacttcttctagctgaagcacctgcgtgcagtctatctaagtgacaagcgattttgaacatccttggcggcagatatcgggaagctcaacacagttgcagatacgtcaggcttagggataacgacctgaatctcgctgccttaaggacatcaggggagcttaccccagcttaaaagaggctccacattcagggagaagctgctcacccgttgtggcccccggaagtagtgaagacttggacttgtaactgggcaggacgcaggtatccaaagccgagaacaatccctgggtgaccccattgagaccagttccagattgcggtgtcc

SEQ ID NO: 688396 - DNA, 978 bp, Homo sapiens
aagaaattgaaggctcatgaagaggatgatatgacgaaaatgataagaccgaagaaatgtccaaatgattcagtccttgatgaacaagtctcttcgaagaaaatgaggaggaggagattgggaacctacagcttgcctgggatatgctggatttagcaaagatcatttttagaaaggcaagagacaaaagaagcacagctttatgctgcccaggcacatcttaaactacggagaagttgagtgtttgatagtctgaaagactatgtgcacagctgtgcgaggagttccagtcctgccttaacctgcaggaacagtacctggaagcccgacgaagcgtctcgcttgctagcagacccactacctagctgggcttgtgcttatgggtacaactctcagtatgatgaggcagtggatacggagttcagcagaatctattgaagtcattgagaacagaatggctgtactaaacgagcaggtgaaggaggctgaatggatcgtctgcttgaatacagagaaagaaattgaggaagtaaaggatcttgtacccgaaaatttagagagaatgatagaagatgcaaagtgagtctcagcggtagtgggaattgttagctgactggtctgaaaggtactctggtggaaagttctcacttgagtttcaatgctggtggaaagaagtcattattcttcatgattgccgttaaaaagccaaagacggggcgttttcattaaatggggtgatggattttccaccgggtggaaaggagaggaaccaaagggatatgactcctggaagattagtgaggaggcaaagaagggaggtaggagaaggggagtgttcccggaatgagattggaaacgggaggggtaatagtgaaggacatggaggggggacaaaagtgtttggggccggaagaggtgataggagggtagtaaaggataggcactgatagtttgtcatatttatatatgttgtgacga

SEQ ID NO: 688397 - DNA, 240 bp, Homo sapiens
ttaaaaggagctctgaggtattccagagatttaattctgacgcagtcatctcgaccccaccattcatttaagacccctagcgaaagtactttcttacatgttaaatctgagaattaggaaatccaatcgctttatgagaaattaagtagaatttgattttcgacttctaatttcttcaagattactcacggaatctcaaagccaggcgttgaaatcatcggccgctacatcagcatgtga

SEQ ID NO: 688398 - DNA, 142 bp, Homo sapiens
ctcttcccacagacggtggtatatcatttaatgtgtatggctgcacaggaattctagaccagcctgggcaacatgtgtaaaccttctctctacaaaaaatatttaaaaattagctgggtgtggtggtgcacgacctgtggtc

SEQ ID NO: 688399 - DNA, 288 bp, Homo sapiens
ggcctttctggggaatcggtcattacatcccatttatttgttgtaggtcatcagcttcaactgaagctgaaagaccatcttcagctttggtcagcctggtctggatctctgtatgccattcgtggttttgctatgattcaacctggagtctaaatgaatttgcacccactagaagtcaatgacatatggacagtatgtaagatcattaacaaagaatgggctgggcatgttgaagagaaatacgttactgcttcagagagctatgttgcctagcctgaatcatctcaa

SEQ ID NO: 688400 - DNA, 463 bp, Homo sapiens
  misc_feature (94)..(94): n is a, c, g, or t
  misc_feature (231)..(231): n is a, c, g, or t
gaccatttttttagttttcctgcgcgtgaattgacgcgggcttttctttgatttgaggtcaggcaatgaaataaccaattttccatatcaaaantgattcttatagagtgactgaggggaccttgtattttgaagcagactaaaaatctgaccagccgccaaaataggtataaaattagaaactttaaaaatcaagctaaatttcagctttgacccacctaactccagtgnaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtaa

SEQ ID NO: 688401 - DNA, 325 bp, Homo sapiens
acttgcaattcactaagcattcggctgatcaattatataagaggtttttggggatattgttgaagtgttttgggccatctgactttaattggtgctacttttctaactaataatgctgtgaaataggaccttataaagaaggttagttacctccctcgtcttgatctcacatctcctaataagccatatagattcttggtatatctgtgtctgtccctgtctttctctcactttctctttctgaagataccaaaaaatctgcagtttaagcttctaaatgtagcataacatcatagataaaagtagaactcttaatctcaccatt

SEQ ID NO: 688402 - DNA, 154 bp, Homo sapiens
agcttcgagggcaccttgtttaactttgccaagtaatcttctctctgcccctggacaactttggaaatgcccaatataaatgcctcccttatcccccggttatccctgagtattcgggcaggagcacactctcccccagccttccttggtccca

SEQ ID NO: 688403 - DNA, 259 bp, Homo sapiens
tggcccatttttcccggttggggggcccccgttttttttttgggggtttttttttttgccacccccccttggggggccgtttttttttaaattttcccccggggtttttttccccccccggggggggggttttttttttccccccgggggggggtgctttttgggggttcccttcccctttttttttggtttccccaaaacccccctttttttttttttttttttcccccccccccatttgggggattttttcccccca

SEQ ID NO: 688404 - DNA, 331 bp, Homo sapiens
aatgatgatggtggggaaaaaaagcatccatatagtcaccccaaatttatggagggtttcttctacaattaggactttcgcttcgaagcgaaggccttctccaaatccatgtaaaattattaatattacctgcctgtttagaagaaatgaaatgagccctaccagatgatagggatgtttcatgtggtgtatgcatcgggtagtccgagtaacgtcgggcattccggataggccgagaaagtgttgtggaagaaagttagatttacgccgatgaatatgatagtgggtacacggacctccagaaactagctctgggaaggcaggccccaat

SEQ ID NO: 688405 - DNA, 202 bp, Homo sapiens
ccccccccccccccccccctttgtttttttttataccccgggggccccgggggttttttaggggtttttcccccagagatttgaaaaatgggggtttccccccgagccccccccaattttttttttgggggagaaaaaccccttttttttttctttggcccccccccttttttgggttttttttgggggggggggggaaaga

SEQ ID NO: 688406 - DNA, 112 bp, Homo sapiens
gcttgtggttcctcatccatggcctggaccgttatgctgctcggctccacaatctaactgtacacggctgtgtgatctccctatgtctccaacttaaaccaccctacgggtg

SEQ ID NO: 688407 - DNA, 190 bp, Homo sapiens
gctcggtccgcctgatgactggtggttgcggttcatgtactgtcccagatctgggtccactgaggcctctgtccaaccagcttgtcccctcccctagctcttgagtctctgttctggtccctaccagtggctttgctgtgctgatgccttatcttcctctatccaccagttcattcaggctggggatcca

SEQ ID NO: 688408 - DNA, 140 bp, Homo sapiens
aggatccctgcggttctacctgaccttctcgagggtctgggctttttatacatcaaaaaatccatgctcacgaaaatccccaaaaatacaatccaggtaggaaggcatccagttacagcacttccctttctggaagtcag

SEQ ID NO: 688409 - DNA, 442 bp, Homo sapiens
gatcctattggtgcggggctttgtatgattatgggcgttgattagtagtagttactggttgaacattgtctgcagatgtacagaactgaaattcgaatggcgaggatggcaagaaaaggttggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaagacggcaagcgg

SEQ ID NO: 688410 - DNA, 264 bp, Homo sapiens
cagcagcactatgcatacatcacacatagccacaaaccaccaattgtaacccaacaaacatcaatctgtggtcctcttcaggccaatcccacactggattctcggccgcagtacaagttatcaaacttcagtaatggtaacagaatcattgacgttcatggccggaaccacagagattcccagctttggagagctgataccgcctgtgaacaacagtcacgctctcttccacaatgactcggatcttcttagcatccaggggct

SEQ ID NO: 688411 - DNA, 270 bp, Homo sapiens
atcagggataataggaggtatgaagattgtaacaggatccaggtagtaaagtcccaggatcataactggagctgccagtgtataaactctagtagatggtaatatgccggctcaagggggtgtgtggaggaaggtcaggaaacggggagggaggaagtcagccttattctgagagctgtatgagtctgggggtgccctccccactagaaaatgttccccaatctcagcagggccctcaatagtcccattctccaccccatctttctgcaa

SEQ ID NO: 688412 - DNA, 234 bp, Homo sapiens
tccaggtttgtggagggttcctcttactcttgggactttccgcttgtgagagcgaagcttctcacatcatgataattattaatattactgctgtgagagaaatgaatgcgcctacagatgataggatctttcatgtggtgtatgcatcggggtcagtccgcagtcaacgtcggtgcattccggcataggccgtagaaagtgttgtgggaagcacacagttcagcattcgcaccg

SEQ ID NO: 688413 - DNA, 267 bp, Homo sapiens
  misc_feature (151)..(151): n is a, c, g, or t
acgtctaaaaagttactagctagaaagacaaaccattgtgcaacaactgcctacggcatttagtacagcaacatgctgtacaggcccgaagcccaggagcaacaggctggaccatatagcctaggcaggtagtaggccgtgccatctaggnttgtgttaagtacactctgtgatgctcacacaatgacaaaatcacctaaggatgcatttctctgaatgtctccctcatcattaagtggggcatgactgtatttttttttctctata

SEQ ID NO: 688414 - DNA, 126 bp, Homo sapiens
ctctagagtgtatccccggcagcccccgcaagccgctttcacaaactcctttcttaccgtaggtttctcccctcccgccgcccgggcgagcgacacggctgcggcccccccgtcttgcggggtctg

SEQ ID NO: 688415 - DNA, 107 bp, Homo sapiens
gttggtagcagagtgtaccttggatttcaagcccctggcatgtgctgcatctcctggagagaaaggtgcttttctgatttgcacagagaccccttgtgggctgttct

SEQ ID NO: 688416 - DNA, 635 bp, Homo sapiens
  misc_feature (229)..(229): n is a, c, g, or t
  misc_feature (267)..(268): n is a, c, g, or t
  misc_feature (276)..(276): n is a, c, g, or t
  misc_feature (291)..(291): n is a, c, g, or t
  misc_feature (293)..(293): n is a, c, g, or t
  misc_feature (317)..(317): n is a, c, g, or t
  misc_feature (373)..(373): n is a, c, g, or t
  misc_feature (454)..(454): n is a, c, g, or t
  misc_feature (462)..(462): n is a, c, g, or t
  misc_feature (464)..(464): n is a, c, g, or t
  misc_feature (487)..(487): n is a, c, g, or t
ttcctacccttgctaggggggcttagtaagattacacattcaagcatacccgttccatgaagcttaccctctaaggaaccacgatcaaaaggtatcagcattaagcacgcagtaatgcacatcaaaacgctcagcatagccacacccacacgataaacagttttgggaagctggtcccaataaaggagagcttaactaaggtaggctagccccaggtttttatcaattncgcgcctttcaccgttttcaccacgttaacccaagacnntaaaattngttataatgtgtgcntnaggaccacccctaaccaacaaagnttaaacttatcttatatgtccaaaactttccttaacacaaaatacgacccggtaancacccacaaaattatttttcaaaaattagccaatctcccgacttggggtttgttaccacattttctttatcttcttttatnaaatcttntnaaccaatattacattatttatanataatatacaacccaactatctatcttataccactcacattctaattttatccatctttagtgcatcatcaccatacttcatcacctcctctttctccaattccttataattgttatactttttatatcgtcttattacccccaaaat

SEQ ID NO: 688417 - DNA, 344 bp, Homo sapiens
gtaatccgaatgtgtttagaagtggcacttctagggtattaagcggggtaatgcctgttgggggccagtgccctccaaattggggggtagggtatagcctgaagtggtaaaaggctcagaaaattcctgagaatgcacagttggtgtgtggtgcccttggtatgtgctttctcgtgttacatggcgccatcattggtatatggtaagtgtgttggttagtaggctatagtatgaggagcgtatatggagtgaaagtgaaatcacatggctagcccggaggtcattaggaggtctgagagggcccctgttaggggtcatggtctgggttttactatatgatagcc

SEQ ID NO: 688418 - DNA, 407 bp, Homo sapiens
  misc_feature (37)..(37): n is a, c, g, or t
  misc_feature (60)..(60): n is a, c, g, or t
  misc_feature (65)..(65): n is a, c, g, or t
aatgtggggaggtagagaaacagtcaccctttgtgtntccaatacccctttccctcacantgacntgtgttccttccctgttctcttttttattaaaaataagaacctgggcagagtgcggcagctcatgcctgtaatcccagcacttagggaggccgaggagggcagatcacgaggtcaggagatcgaaaccatcctggctaacacggtgaaaccccgtctttactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattga

SEQ ID NO: 688419 - DNA, 366 bp, Homo sapiens
actgctgacatatttgtgcaaatcagaaggagcagagaagcaggcagtctcatgcatgaaaggtaaccctatcaggatgacagagctgagggtctcttgtaggagttgctcttgttgtgtaaagcactattgtcttggggtagagccctaggacagttcttggtaggtactgctgggcaaaacatatgggttccatctcggatagaggagtaaacctcatcctctatccgtaagtgtccttccatgcaaggtcccacatctaggtgatagacagggaccccttctaatgaacctttgaggaacggaggaaggaagaaatgcgtatagatctaggatgcagcccttacaaagggtacaatgtaccca

SEQ ID NO: 688420 - DNA, 580 bp, Homo sapiens
ggagtttgagaccagcctggacaacatagtgagacccccatcgtgtacaaaaaaaacaagtgctgctgtgggaggctgaggtgggaggaccacttgagcccaggaattcgaggaggtcatagtgagctatgattgtgccgcgtgcacctcacagcctgtggttgacaagagcaacaccttgccctctaaaacaaacagtctccaacctaatttaatttttacaattttcctggagacaggcatgtcgctctggtcacccaaggctggcagtgcagtgggtataacacatgggttcaccttgcagccgaactcccaggctcgggtgatccttcctcctcaagcctcccaagtagctgggaccacaggtcattggccaccatgcctggcctaatcttcaatccggtagaagacgaggtcctcgctatgtcgcaagcagggagatcaccttaagtgatcttccctcatgggcttcccaaagtggtcgggatcccaggcgtgagccacttgaacccggcttgacctaactatcttaaaccactactcatatgggcatcatctacacttcacaacaatttgccaa

SEQ ID NO: 688421 - DNA, 116 bp, Homo sapiens
agcggggccggagcctggagcgccaccagtgcagcagccgccgcagccgccgcgctgggcagaggagccggagacgcgagcgggcgaggtggcgtgcggcggcggagcgggagcgt

SEQ ID NO: 688422 - DNA, 837 bp, Homo sapiens
ccggggtttttccccgagctttttggtcccccccgggcaccttcttgggatttttgtttttcggcccaggatgttacttcttttctccggcatttttgggtgcgcgcgccccaactcgggtgcgtttgtgtggggtcacatcatcgtccttcccgttgccgcatgatgctctgctcgtaggccccccccgcggggtgctctctacgcctcgcgcttttgtagtaggaggtccccccgcggcttgttttttttcgatgtagtgcccctccccctgttagggggcggtgtgtggtcgcccacctcttggggtgtggcttgtgagtgtatggggggcccacattgctgagttggtgtgtttcatcactccttggcgtctcgtgataaatatagagagagctgtttcttcaagagaggaggacccgctcctccgtgccccgccgttttttctacacactatctcggcggttggtcccaccaacatcactcctacccacaggatctgctggtggtgtacccgtccccgccgcccatcttctattggtgtgctgcagccaccgcggcgggtgctggcactaccgtgccttcttctttgtctcccccgcggttgtctcccgtccccccccttcagtctttcttcttttcaggatatctcctccctacgggggggtcccccccccgcgccccgcatagacaaagaggagagaatccccccaacaggcgccccggggggggggggggggaaaaacacgcaagagggggggttaaccccccccccccccctcgcggggtgggtttttttttttttttcccccaaaaacagggggagggcctttatta

SEQ ID NO: 688423 - DNA, 719 bp, Homo sapiens
acctttatgtcctagagcataaaggtggtcctccgatatagagttcataagcagagcttgaattgcatcatgattgctcatccggctagtgcgcctctagggctcaagagaatgagactttcgggtcctcatgctatcgatagcatgaaataattcatgtacagtccaggtgaagggcattctggaaaaaataattaacacaagcaaagcgatatttttctaaggagtagagctgctgcacaccagtatgagcgagcttagcaagccgaattgaggatcctcagatacaaggctcattggtcaaatatctagatgatgtttatgaatctagtgtgaaagtattaagtcagcatcacaaggtctatgaacaatatatgcaagtccattcaatcgtgcaattgaactattggagttgagcagattcgagttgtacatagagatggaagagtaattacactgtcttatcaggagcaggagctacaggattttcttctgtctcagatgtcacagtcaccaggtacatgcagttcagcaactcgccaaggttatgggctggcaagtactgagcttcagtaatcatgtgggacttggacctatagagagcattggtaatgcatctgccatcacggtggctccccaagtggtgactatgctatttcagttcgtaatggacctgaaagtggcagcaagattatggttcagtttcctcgtaaccaatg

SEQ ID NO: 688424 - DNA, 565 bp, Homo sapiens
  misc_feature (67)..(67): n is a, c, g, or t
  misc_feature (135)..(135): n is a, c, g, or t
  misc_feature (233)..(233): n is a, c, g, or t
  misc_feature (386)..(386): n is a, c, g, or t
  misc_feature (390)..(390): n is a, c, g, or t
gaggttcctgcagagggagcgtcaaggccctgtgctgctgtccctgggggccagaggggttgcccancatgcccactggcaagagagagggaactgacccacttgctcctaccagcttctgaaagtgacactganccccaagtgacaccacaccaccaaagaaggtgcttgtgtttgtcaaacaaatacagccagacctgccaccccttaagctccaaagtccagaggtgcanaaagccaggaccaagagacaagcagctcaccagggtggacaaatcaccaaaaatatggtgcattatcctgttttcacttttaacatgggtttatgctgagcctaccatatatagagagatcctatcccctaactatcctcaagcatatcccantaangtatagaaatcttaaaacatagaagttcctgaaagatataaaattcacctctacttcacccatctaaacattgagctatcagagaactatacatataactcagtacagataatctcaaaatacactaaagaaagaaagctctaatgacaaataacagtaacaatccccactctcc

SEQ ID NO: 688425 - DNA, 143 bp, Homo sapiens
catgagataccgtgggagatgtatagctgatcagtgctatcccagacacctcctatcccaaacacctccttcccaacacctccttcaccaacacctcctatccccaacacctccttccccaacacttgcaactccaacagcct

SEQ ID NO: 688426 - DNA, 906 bp, Homo sapiens
  misc_feature (187)..(187): n is a, c, g, or t
  misc_feature (384)..(384): n is a, c, g, or t
  misc_feature (456)..(456): n is a, c, g, or t
  misc_feature (495)..(495): n is a, c, g, or t
  misc_feature (518)..(518): n is a, c, g, or t
  misc_feature (703)..(703): n is a, c, g, or t
  misc_feature (711)..(711): n is a, c, g, or t
  misc_feature (713)..(713): n is a, c, g, or t
  misc_feature (753)..(753): n is a, c, g, or t
  misc_feature (756)..(756): n is a, c, g, or t
  misc_feature (769)..(769): n is a, c, g, or t
  misc_feature (771)..(771): n is a, c, g, or t
  misc_feature (777)..(777): n is a, c, g, or t
  misc_feature (798)..(798): n is a, c, g, or t
  misc_feature (820)..(820): n is a, c, g, or t
  misc_feature (834)..(834): n is a, c, g, or t
  misc_feature (843)..(843): n is a, c, g, or t
  misc_feature (846)..(846): n is a, c, g, or t
  misc_feature (856)..(856): n is a, c, g, or t
  misc_feature (882)..(882): n is a, c, g, or t
  misc_feature (901)..(901): n is a, c, g, or t
gtgagtagctgctttcggtccgccggacacaccggacagatagacgtgcggacggcccaccaccccagccctccaactagtcagcctgcgcctggcgcctcccctctccaggtccatccgccatgtggcccctgtggcgcctcgtgtctctgctggccctgagccaggccctgccctttgagcaganaggcttctgggacttcaccctggacgatgggccattcatgatgaacgatgaggaagcttcgggcgctgacacctcagagcgtcctggacccggactctgtcacacccacctacagcgccatgtgtcctttcggctgccactgccacctgcgggtggttcaatgctccgacctgggtctgaagtctgtgcccaaaaanatctcccctgacaccacgctgctggacctgcagaacaacgacatctccgagctccgcaaagatgacttcaanggtctccagcacctctacgccctcgtcctggtgaacaanaagatctccaagatccatgaganggccttcagcccactgcggaagctgcagaagctctacatctccaagaaccacctggtggagatcccgcccaaactacccagtcctggtggagctccgcatccacgacaaacgcatccgcaaggtgcccaagggagtgttcagcgggctccggaacatgaaatgcatcgagacgggcgggaaccantggagaanantggctttgaaactggagccttcgatggcctgaagctcaantanctgcgcatctcanangccaanctgactggcatccccaaaaanctccctgagaccctgaatgaantccacctagaccanaaaaaaaancangccatcgaantggaggacctgcttcgctactccaanctgtacaagctgggcctangccac

SEQ ID NO: 688427 - DNA, 388 bp, Homo sapiens
atgagtcaacaggtttcactaatatttgtcatgctgtagcatttgtaagatgggtaaatgatgaaattcaaagaaaactttttctattggtaggagcctgccagaacaaaggccaatatataatgttgtgacatcatatctgataaccagaggtctggtatctacactcctggtgccccatcagtggttgtctccataagtcattttgcgttattaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgtaaaaaaaaaacataataatgaaaaaacatgt

SEQ ID NO: 688428 - DNA, 190 bp, Homo sapiens
atccccacctgtgtgctcagatgtacgccgaccgttgactattctactacaaatcacaaagacattggaacactatacctataattcggcccacctgtgtgctcgtgtgtctacgtctattcctactgtaaactactgtggtgtgctcacacgataaatccctagtgaagccgattgatatcatagctca

SEQ ID NO: 688429 - DNA, 385 bp, Homo sapiens
  misc_feature (182)..(182): n is a, c, g, or t
tctccgtgccgttgtcggggttatcccgtttgctcctcgcaggtctgcttgtctgtgatttcgtggttcgcgcgctttcattcgttcttgcgtccgggtttgattccgggtaatcgctggcgcaaatcggcggcatccgccacggtggcggtattgcaggcaattaccagcgccttggcgcnttgctcgcgacagaaaccggagatcaccgcgcagcgctggcgaatgtactccgggcttttttcgccgtaggggatatgcccgcagtcggcgacatagaacagcgactcattgggcagcagggcctggatttccttgagcaccgacaggccgccgacgccagagtcgattaccgcgatcggtgcgtcacgcatcgcgtcgacgc

SEQ ID NO: 688430 - DNA, 232 bp, Homo sapiens
atgggtgctcatcccccacgcagatctccactgaggacatcaacaagcgctatcactaccagctgacattcggctgctgagggctacctggaagaagctgaccctcaataggcccattctttggaaaaggcccttcaaggcggcggctccggtcgtgtcaagcctaattctgaggaattgggctttggggaaactgggaagaacctacattaaagctggaacaaaactgggg

SEQ ID NO: 688431 - DNA, 617 bp, Homo sapiens
aatcccagcatttaaggaggtgggaaaatgcttgagcccaggagttcaagaccagcctgggcaacatagggagaccctgtctctacaacacataatttaaaaaaattagctgggtatgttggtatgcacctgtggtccctgctactaggtgtgtggtatgcacctgtggtccctgctactacagaggctgaggtaggaggattattgagcccaggaggttgaggttacagtgagcaataattatgccttgcaacactctagtctaggcaacagcatgagaccctgtcccaaaaaaaaaaaaaaaaaaacaaaaaaaaaacttgttgctgggccggctccgaggagccccagaaaaaagggtttctaaaagaccacctgcggtgggagccgagcgggcggccccaatatgcgacagtgtgacaatgtgcgcaaaagcagtggtccccgaaagagagacccggtggctaaaggacaatgctcgcgttggtatcccaccacaagtaaaaaaacgcgcggggaaaccagatagggtccggacaaaccccaagatggagtctgaggcaacagggactcaacacaggggctccaaggagccagaataatacacgcgcggggat

SEQ ID NO: 688432 - DNA, 767 bp, Homo sapiens
gcagcactcattactacctgctgccaccgtcagacctatgcctcaggccgccccagacccaaaggccaacttctccaccaataacagcaacccagggcacggccaccatccctgagggccacggctcggctgccacagaggggctgcccaggggacgggcaagaggctgctcggccagcagacaaggtccagatgctgcaggccatggtgcatggggtgaccacagaggagtgccaggcggccctgcagagccacagctggagtgttcagagggctgcccagtatctgaaggtggagcagctctttgggctgggtcttcggccacgggtggagtgccacaaggtcctagagatgttcgactggaacctagagcaagccggctgtcaccttctgggctcctgtggccctgctcatcacaaacgctgatggttgactggagagcagtggtctgccctaaaagaacctcttgaacctgtctgtgggacaagggtgggggagctgccctgcctcaggcccgaaggacccacaactgcctgcggctcccaggggacagtgagacccaggcagcaggaggctgggagcctcaccttggcccacctcgctcacccacccagcgctgttctgcacaccttggttcagccctcagtgcccaagaggtgggacgttccagcttgtgaaggcagacaggaagctgctggagggtctgtgtgggctgctctggatcagatcaaaggtgggctggggtaaatggccaaggttcctgggga

SEQ ID NO: 688433 - DNA, 471 bp, Homo sapiens
  misc_feature (213)..(213): n is a, c, g, or t
  misc_feature (360)..(360): n is a, c, g, or t
  misc_feature (376)..(376): n is a, c, g, or t
  misc_feature (381)..(382): n is a, c, g, or t
  misc_feature (392)..(392): n is a, c, g, or t
tagaaatatgtctgataaaagagttactttgatagagtaaaaaatagaggttcaaaccctcttatttctagcacaataggactcgaacctaaacctgagaattcaaaattctccgtgctaccaaaatacaccacattctacagtaggtcagctaagctaagctatcgggcccataccccgaaaatgttggttcatacccttcccatactaatnaatcccattatctacactacccttatcataacagtaatatccggaaccatactagtaataatcagctcacactgactactcatctgaatcggattcgaaataaacctattagcaataatcccagtattaataaaaaatttaacccangagccacagaagcagncacannatatttcctnacacaaccacagcctccatgatactaataatagccatcatcatcaacctcctatattctggacaatgaccaggcaggct

SEQ ID NO: 688434 - DNA, 360 bp, Homo sapiens
cagcaggacgttgggatcgggctggcgcttgtcgaacgcgtcgggatcgaccgtcgtcggcacgtcgtcccggagcgtcaccagcttcttggagatgcgcgccggctcggcattgacctgcagtgcctcgcggcgcttgggctgcttgatctctccggcgcgcgccaacagcgtctcgaggtcgccgtactcggccagcaattgcgcggcggtcttgatgccgattcccggcacgccgggcacgttgtcggtcgaatcaccggccagcgcctgcacgtcgatcaccttgtccggcgtcacgccgaacttctccatcaccgcctcgggcccgatcttcaccttcttgatcgggtcgtacat

SEQ ID NO: 688435 - DNA, 260 bp, Homo sapiens
acgagcgcatgtgcgacagtgaagcgcgccatggcgattcgcatgatatgcctctagagctcggcttagttgagccacgaagttccgctgcgaagctcacgcggacataggctgctgattggctaagagacttgtgatagggctcatgtttgagcttgctgctgaaggtcttagcacagtagctactgtagagtacattggcagactatgagcaactggtgcgaggtactggatcatggtccctctagtgctgttgcatg

SEQ ID NO: 688436 - DNA, 471 bp, Homo sapiens
  misc_feature (213)..(213): n is a, c, g, or t
tagaaatatgtctgataaaagagttactttgatagagtaaaaaatagaggttcaaaccctcttatttctagcacaataggactcgaacctaaacctgagaattcaaaattctccgtgctaccaaaatacaccacattctacagtaggtcagctaagctaagctatcgggcccataccccgaaaatgttggttcatacccttcccatactaatnaatcccattatctacactacccttatcataacagtaatatccggaaccatactagtaataatcagctcacactgactactcatctgaatcggattcgaaataaacctattagcaatgagtgtggaaaaggttttacagtgaagcgctatctgattgcccatcagcgaactcatagtggagagaaacccttacgtatgcattgaatgtggaaaaggcttcacggtgaagagcaatctcattgtgcatcagccgctctta

SEQ ID NO: 688437 - DNA, 332 bp, Homo sapiens
cgtctgcgaaatcatatggctgtaccattcgtgctatcccgtgggggttgccacgctttgtatacgtttcgtgtggctgatcagaagaccgacggcatactgtcagatttctacagaaattacgatgtcatgcaacagatttggacgcgagatagagcgaaggctggtactcttttcacgcagtgtaagagtaactcttgcgacatataacagacctttccttcagtgttggacattaccctaagcaaccgtttgtcaacatgcacttgttgttcctgaaaactatgcacacattgaattactgttgcggctaatgaaagtagttccctctt

SEQ ID NO: 688438 - DNA, 179 bp, Homo sapiens
atatctgatgccacgtgtatagtggaatgcctgtgtaggcattaaaaagaatgaggtagatcactatgtgtattactatcttttaattttaatgtcttgaactaagacagaactttatgtatatttttcagaacagatgaccaatgttatagacaagagacagaacccaaggtttgaat

SEQ ID NO: 688439 - DNA, 767 bp, Homo sapiens
ggagagggaatctccctccgtcacccagactgaagcacaggggcatgatctcagcttactccaacctttgcctcccaggttcaagggattctcctgcctcggcctcctgagtagctgggattacaggcacccaccaccatgcctggctaatttttggatttttaggacagatagggttttgacatgttggccaagctggtcttgaactcctgacctcaggggatccatctgccttggcttcccaaagggctgggattacaggcgtgagccacagcccacagccaaaaaaaaaaaaaaaaaaaaattcttaaatgggtaatacatgcaaatagtccaagatttttaaagaacaattggggattatttgaaaaatcaagttttcttttcttcccttaaacaacccagatgtgtgccttggaccaaccacagttaccagttccaaggtttttttaacaaggcccttggtaattttttgaaattcaaaattttgccaccccacgtggggggggttaaaatttgggtgccgggaggaaaccatttggttggttggctttagattattccccaattacttacttttggactttaaataggaagctttttccttccccaaatggagggtaccgggccccccccccttagggtttttttaaggttggaagggaataccccctaatggccttaaaggtctcttccccagggttgggacacaccaaacaaccaaactcgagaatgttaactttggaactttttccaaaaccaaaagg

SEQ ID NO: 688440 - DNA, 400 bp, Homo sapiens
ggagtagttgtagacagcgttaatcaatctgagcagctagtgtctcagtatggttggcatacaggccgtatagtatatcacagcaagtgtcacccttggctcacactcaaagaagggcgatggctgtaaggatgctccctggagagaatacagagtgggtgctgttagactggtgttcaagctgacgatatagagtgaggtcgcactcagcaagaatatgggggtacgtattggaggttgcgttataatgctcatggtgtgatgtgtctatataaggagtagcatctacttgaagatgtttatcgagatagtgatgagatgtgttaacacattcatagcaacagaacaataccatacgacacagcagacgccattgtagagtgacggtcccaagtcagtg

SEQ ID NO: 688441 - DNA, 258 bp, Homo sapiens
cattcaggtaagggtcagctgcattgaattagcgaggagctggagtggtcctggtgcagcctgtccctaacacaatctacctccgagtcgtgactattacataccctagcttgaaaaggtgaacatgaagcacctgctacactgccctgttgccaccagcattgtcactgctctagctcctgtggcactgcacggacacgtggttgctacaagttagtacgcatatttggccttattagaggcactttcctattgtaa

SEQ ID NO: 688442 - DNA, 226 bp, Homo sapiens
gaaaatcacgtctataatctgttcctgggggtaccgctaggtagaagggctgagaagcgattcaaagtactagtagctgggcgagccaggttctgatgctgcgtctggagggcttggctcctgagcctccgctgctgcccttgcccagctcagtcgccctccaggtgcaaagagctggttgttagaatcgatggagccaggcttggtgatcttggtgagtcgttga

SEQ ID NO: 688443 - DNA, 375 bp, Homo sapiens
agacctggcttccaccccccagtcacccacttgggttatttgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgcaccgggccgtatgcttcagcccccccccaccccacccagaaggcaccaggcctcatcgccaggtgttcaagcacagcaatcccatttgggagttattttgatactgcgatgagtaagggtaagggcgcatggaatggggctaaggtgggagtgaacactggggtgaataaattttaaatcaattcaagtaaa

SEQ ID NO: 688444 - DNA, 351 bp, Homo sapiens
gatgagaaaaatagatgaagcactcgtgacagtgttcagatagcgtcacgattctgtcattggggagtcatgacgacgaattgatgtccggggctagattctgtgtagacggtgactttgaggatggaaaatcaccactcccgactgggttgtcctagctgtttccgggagctggatggcaaggcctgtgcgacagataatgcctgaggaaatgttcctgagtcacgctgaggagagccttcactcaggagttcatgctgagatgatcatgagttcatgcgacgtatattttcctttggaaacagaatgaagcagaggaaactcttaatacttaaaatcgttcttgattag

SEQ ID NO: 688445 - DNA, 151 bp, Homo sapiens
aaccagaacacggatccctgttatcaatcttgaagataggactaggctggtggcgggaagatgctccttaaaattaggatttagttgaatggcttaagctgcaccctacttacactgttgtatatgtccaagttatgtaccatagaatgca

SEQ ID NO: 688446 - DNA, 813 bp, Homo sapiens
gggatgcactgagtgctcctgcccagcaggcggcggcaagatcagctgacagttcatgctgtgcccggagctgcctgcccaactgcatcgaggctgtagtggtggctgacagcgtgcccacagtgcaggccagtgtgggctgcgtccacgcagggccacaagtacgccagcatggcacacactgttcaccgtgaccgccaatgcccagggcctagcacagcatgccactgactgccaggtggagaagtctcagtcttgccgtacgcaggctccccgggattggcccaccgaggacaactttctacacgaatggccggaggaaggagttgaccgccggaaggcgacgcacttaagcgaaggaatccgcctaacaagacatagtgacacaggggaaggggctggagacccgaagtacttgcgaaaacggaccagcacacaacaaggcaccccttgccacgagcgagtttgaaggggttcccccaagaggacagagagataggacagggatacccgaggaggcaaagaggcaggccacatgcggaagtgaccccccagaccgcacagccagtgcccatcccttggggcacacaagtgtgatgtgtcgacacacatttccaacgagcagccaacctatggcattacccaaaaccaaaattccccacagggggaacaaagccgcgcacaacgtgtggggcacccaaggacacgttggaaatcgcccattcacgccccaacgaagagaggacccccaccaaggacacaggaacgaagttacatagggcacctatgaacgcaaccctagaggagggatta

SEQ ID NO: 688447 - DNA, 213 bp, Homo sapiens
tgatcgatacaggccactgcgacataaagaggatcagagcttctttcccgtgaaacgcagtatagggcgccatatattagcctgggttaactggggggatctaaagctgtcaaataagacattctgtgagaggtaaacatcgaaacgggtaataagtaaaaccatcaagccaacaacagggtcgtgagataatccttgaagcttatagtactg

SEQ ID NO: 688448 - DNA, 107 bp, Homo sapiens
agtatccagaagaacccattgagtccctaagaatgacacacaggtgacagctgaaagaaggagggacacagaagatttagcagcatgattctctgggggaaaatgag

SEQ ID NO: 688449 - DNA, 420 bp, Homo sapiens
tgaagctgagtagcacaggctttgtaccaagggagaaggtaatttacgtcatccaaggtgccaaaggttatgggtttgctaccccattccgggtattaccccatcccctgctctgccaggagccaccctgaaggggtgccaaattatttatcactgtgctgttggagggtcccacatggaggtagagatgcagcaggctgggcctgaagtctaattcccagcccaggattctgcagttcccctggtgtggcctgtactagggaccacatgccagctctcctgctgagcttccctgaagtggtcatcatagcacttagtgtcccagacactgcttggtattttagtatcaacttatttaagtctcaaaattacatcaaccttatgaagtagaattaagtcaggcactgttctaagaacgtc

SEQ ID NO: 688450 - DNA, 428 bp, Homo sapiens
tctatagggtataacgatgaaagggatggcatttctacttaaaattaaagtttgctaattctataaatgagaaaaggctgaagactggatggcaaaatgtttttagcaggaaagaatttactctggtggcactcagacgtattagacatgttagactaatgtacaacaaattcagcaactgataggaacagaaagaacgtggagtaagataatgaactctttctctgttagtatttacacactaacatggacaaagctttgtgactatgaacttaacaaaatcatggtagatgcgcaggagaacagaactttgaatggttttattttggatttacttactgccattaacagagtctttgtgcctgcaacctagtggggtttgattttgttttaatccgatttgttggctgaggcagttttgttgttta

SEQ ID NO: 688451 - DNA, 438 bp, Homo sapiens
  misc_feature (6)..(6): n is a, c, g, or t
  misc_feature (31)..(31): n is a, c, g, or t
  misc_feature (103)..(103): n is a, c, g, or t
  misc_feature (114)..(114): n is a, c, g, or t
ccaaangagcttcaagcaacttgcccctaanccatatccctagcagacgggagaggccaggattcaaacccagaaattcttttctttttttgaaacggagtcntctcttcttcnttcccaggctggagtgcagtgcaaaggtcttcagataggtgcgtatcaggcctaaggaaggcaaggccaggagggctcgagtaaagagaacggggagatagaattaggagatgaggcgggagtggaaatggaacttctgaaaggccactggaggtgccttggctctagttcacaggattgaagtaaccttgagacttggttgatactaaaatgtcaaacagtgttcgggacactaagtggtattttagtatcaacttatttaagtctcaaaattacatcaaccttatgaagtagaattaagtcaggcactgttctaagaacgtc

SEQ ID NO: 688452 - DNA, 456 bp, Homo sapiens
atatcctagaattaggagtatccccttcttccagagttggttaggctctggtaaaactagacagatatgtacagagaacttggcaattagtaacaccttgaagtatagggccttgtataaggagaagagagagctctcagtagttagtacaaaaggttacttttcccctccctctagcatagggggatttttctccagtcctcacaatagagaacctggagagagtacaggagattaacctacttcaatagtatgagaggctaccctaaaatacaggttcccttagagtttttaaaattactcatgtatgtacacatagagccttcagcaattcatccatattagcttaaaacattcctatagatattagatatggcgaagggcttctgctccatgtaagctagtggttatctgaatccacctgtttgtctctgtagttatcagggcagcattgcc

SEQ ID NO: 688453 - DNA, 400 bp, Homo sapiens
  misc_feature (189)..(189): n is a, c, g, or t
  misc_feature (205)..(205): n is a, c, g, or t
gctctcgaggtccggtgttcctttgtctaggaaaataaacaaagcttcatagaccacaaagggaaattatctcggcaagtaaaattttagatggaaattatctactacaccacacttgggggaattgctatactcactctactgtttgcaatagggatacacacggtagcaccttctaactgaaatatnggacagagtttccatngctgtagtattttgcttaattattatccttagagcaggaataatagttactgacaaggaagcatgaaagttttactatcactgagtctgctaggactttttttgggtttaggggtgattaacacctctagtaaagtagagaaaaatctacaggtacttaaagatcaaatcaaaattattgacagacaaagggaaa

SEQ ID NO: 688454 - DNA, 173 bp, Homo sapiens
  misc_feature (10)..(10): n is a, c, g, or t
  misc_feature (34)..(34): n is a, c, g, or t
  misc_feature (123)..(123): n is a, c, g, or t
  misc_feature (135)..(135): n is a, c, g, or t
gccaagcgcntacgctcagcaggcggcaggcggncctgagcttcagggcagccagctccctcccggtctcgccttccctcgcggtcagatgaaagccttcagtcccgtgagtccgttagaagnaacagcctgtcngatcacagcctgggcatctcccggagcaaaacccctgt

SEQ ID NO: 688455 - DNA, 815 bp, Homo sapiens
cagttctttcgtcccgcatatccggtttccttcccgggttcctttccaacgccgcggcccgattcccggttgcccccttctcaaggttaaccttgttggcaattgaacatgttaccccaaccgccgcgggctgccccgctccggaaacattatgtgcgcgcatatttctggccccacgcccccccactatttggggggccccccgaatgtctccgggcgccccgagccaaaatatcccccccccccgtgggaggcctccctctttgttagcgccacgggtatactatctaccggcctctgtctcccccgtaattattcttgtcgccccgattcatttattccaatccccggcgtttccctcattaagaaaggcacttgggtggcaacttaagagaacacggttatgggtcccccccaaaaccgccccgtgtctgtgcgcggggtctgtcgccaccgtgagccgcagcgcgtgtaaaatttttggcgcaacgggagtgtcccccggttttaaaataaatttggaaagtgtctcccgaggttttaacaaccacatattgtcactccccctttaggatatttaaatcctactactcttcctgttctacacctgtatatactgggaaccacaatataatgtttataaaccctttccccctttttaatttttttttgggttttttggcgctccctgaattttatttctcttgtttgttccgataaaaaaagtaagagtgggatgtttataaatcctgccatttaattcctctgttatctcccaaaattaaaaaattaaaaaccggttgggttaaaaaaaa

SEQ ID NO: 688456 - DNA, 207 bp, Homo sapiens
ccgtaaccgtgcaatcggtcgcataatcacttgtcccttaattagggacctgtatgaatggctccatgagggtacagctgtctcttacttataaaccagatgaaattgacctgcccgatgaagaggcgggcatgacacagcaagacgagaagaccctatggagctttaatttattcaatgcaaacagtccggcgccggggatcctct

SEQ ID NO: 688457 - DNA, 230 bp, Homo sapiens
gctttggtccgccggactggcggtactcgagtgcgagagtcgcccttggagactcgatcttcccaactggacagtgggcccttcttcgcagccgcgcggcttccgtttcaacgggaaccttccgcgaagggaagggcggcccaagctttgagccgcggaaaccccgcttgcttttaaggggggacgcggggctgcgtctcacatgtgagagcagagagagcgctctcctc

SEQ ID NO: 688458 - DNA, 269 bp, Homo sapiens
  misc_feature (36)..(36): n is a, c, g, or t
aattgtgtggtgttatgcccactttgtttctcaacnatagctttaaaattcttaaaaatcgtaaacacttcagatttttgcttcatgaagtaaatccaagtcatacgagtatagtcatcaataaaaaaatgaaatacttattgttggcatgagttggattctccataacaccacacacatcggtatgaataagctccaatttatcctttgcacgtcaagctccactttttgaaaaaaattctcgatgatgctttcataacaccaccatt

SEQ ID NO: 688459 - DNA, 758 bp, Homo sapiens
taggcttgcctcactggccacctcccaacccaagagcccagccccatggtccccgccgccggcgcgctgctgtgtggtcctgctgctgaatctgggtccccgtggcggcgtgggtgcccaaggccatgacccagcactccgacctgaaatgcagctggtgtcatgtttactgctttgtggggccccatgaccctgcagctacctggagcacctgcccggactggtcttcccctgtgaatgacaaggataatcctagaggacgagaatgatgccatggcctgacgccgaccgcctggctggaccagctggctgcctgagctcttgtgccgccacgtgtgtccacactggctttagccgtgtcgtcctgccattaactgatggagtgatgggtcttcagaacgagggggttgttgattaatgccggaaaggatatgcaccagcagatgatgcttcccatgtgcgactcccaatacagcggggagttccagcacgaggtttatagccaatagtcaggagcctgaaatcagtgctagacttcaagcctgccgcgctcccccgggaggtctactgagtgaccttgccaggtctcgcagtgccacccttgatgccaggttggtccacacctgggtctaccccgagccggtggcgtcacctcaccacagcatgcatctctgaggatctgggctggtctgatcctgggccgtgactgccatgagtccggacatagcgaccggtggagtgaggtatcgggctcaatg

SEQ ID NO: 688460 - DNA, 278 bp, Homo sapiens
gataccttctgggcttctcttgctatggctcgtgggggtgctctcgatggtccccgtgttttggtgggctgggtgggagagggcgcttggacggtgtgcattgtcgggaggttgtgagtcacggggttgcctccagggttgatcccttccatggctgcaggaagtcttcttggagccacacccacgatgccggggggatatctgtatgtggcaccattgagctcaggatgaatggctggcgggtcaataactgaccaaggcgctgtaggtgggttacc

SEQ ID NO: 688461 - DNA, 165 bp, Homo sapiens
  misc_feature (117)..(117): n is a, c, g, or t
agcgaggctgttttgcaggcatcccggcaggcatggccaggtgtggtggggcagccttccgctcctcccaccgcagtttcttgtcagtgtcatccattcctcccatggtggctgcantggtcacgcagctcgcaattcggtcactccatggtccatcagctgttt

SEQ ID NO: 688462 - DNA, 207 bp, Homo sapiens
gtaccaggcatctcccagtgctcaagatactcaatccattgcctccgatggaaccccacaggaggagaaggaaaaggaacaaagaccacctgagttacccctgctcagcgagcagatgaatttgggcgagctgtgggacatgcttggggagtgtctacaggaactagaggaatcccatgaccagcatgcggtgctagtgctacagcc

SEQ ID NO: 688463 - DNA, 1203 bp, Homo sapiens
cctttacgattcagcaccatggctggaagacatggagaccaaaatcaatgaactacaatgacctgaccctttttgacatgccgcttccccaaacagaaccagactagaaactgctggcagaactacctggacttccaccgactgctcagaatggcaatgaccgctacagcgaggcgatatctctgtgtgcgaatggctaccagcgtgtgtaccagatccctactgaccccacatacctagggtacacagactggtgcatgcagccaactgcggcctgaagcgccacgctaaccctgtgtgcacagcatcctagacactaggctgccatctccacttatccatctagctacctccgatcacgtatcctcacccagcggactagcgttgcaagctgcgagcgcaccctgggctacccctaggtgattcacccaaacgccacatgggatcccctgaacatccactgcacttatacctaggcgtcaagtagagcaacacgttacaaatagggcacaacccacggcatgacaaacacacacacaaccaaccaccacaaccccaccaccgccgcgcacaccagcgcgcccgggaaggccgcccccacccacacacagccagcccaaacacgcaaccacacacggccacacacacacgcgcccacagatgagctccgtagtcggatctcataagtctagaaacaacccactgcgccaacgtctaacacccgacggaaacagaccggacacgactagctcctctactcacgcttcatgccccttctgcctaccctctcgccaagcaaacaatactgataagtatcgaacactgactgacttaatagacatatatctcggctactctccgttactagcaacgatgaccgaccaccgccccgattccatcaacctagtcgcacgctgcgatctgcgctcatcatctcccacagatacgcatccagtcgctatctaaatcacaactagatcgatgtcctagcgcaccagtagatccagcagcgctgcataccactgagcataccactacaccccgcgcgccacgctacgacgtgcgatcactcagtctggtactcagagtacgcgacaccaccagtatggccggagcccgaacatacggacgagcccccgccgaccactcaatatctcatttcagatcacacgacacacatgacatatcgtacgagacctcctt

SEQ ID NO: 688464 - DNA, 446 bp, Homo sapiens
cgttctgcaatagtcccctattattatctaaacagagcatggtcttatataccactgtctttcccaagactgttacttttttttatttgggaattgtgctctcggcttcggtccctggcaagtggcacgtgttctatttttctttcaaaaattgatggagaaacaacctctctgaaatctattcttctgattgctgccttgaaagcaaaagtaatcatcgccttgtctgaaatccgggagtcatcattcttgtattcatcactttgatcactgatttccacttggctttggtgcatttccatccacccagggagaggaacctcatttcataattttggtatcctgatacctaggggggagcttaaaagtggaaggggaacttattaaaccccttttgggaaggaggaaataacaccaatagattcctagggtgcatatagtaatga

SEQ ID NO: 688465 - DNA, 310 bp, Homo sapiens
taaatcgagctcggtaccatataactctcccccagtgggaaatgttacaggacaatgacctgtttttttggggtttttttgagatggagtctcactctgtcgcccaggctggatacagtagcgctgtagtgagctcactgcaaccttcacctcctgggtccgagtaattctcctgcctcagcctcccgagtagccaggactacaggcacatgccaccacacctggctaacctttgtatttctagcagagatgaggtttcaccacattgaccaggctggtcttaaactcctgacctcaagtgatcagcccg

SEQ ID NO: 688466 - DNA, 752 bp, Homo sapiens
cgtacgccctcaggggcccataccacgatcatgacctctcccccgatacctgggttcccttcttactgtccggccagttgtacactgtccccatatgggccttcagaaccttgccacaaggttttcgcccattcataaggggggggaacacctctgaacgttgttattctgccccgaaccacaccaggcggaccaacatttctcctcttccgagtttatcacgagccccgccctggtgtatgtgggggaaccgggctttaacacagggggtgccccacccacttggggaaaaaatgttgtacgcctcgccgccactcctgtggcgcgcccaccagctggcgcccctggcccacaaaggagcccccccccttggggagccctctctgcgacccccttacccggtgtagcactgttgcagcccgcccccaagaattgggggggccaaccgccccacactgcgcgcagcattgtgggccccccgcatacttggcttgcgcgggatattctttctttaacaacgccccacctcctcgggcagcccttgagttattgaatgtctatgcctcgggcttaatttccccctcaaaccctcgtggggtacattccctcggtgcgcaccaaggcaccgggcactcaaccatcgttggggggtttccgcctcaccccctctttctattaaagggccccaaaaacccccaaatttttggtttggccccccccctcaaaaaaaaaaattgggcaacccacaaaaa

SEQ ID NO: 688467 - DNA, 1565 bp, Homo sapiens
gctgtttattttttatgcggcggacatatatattcttgtgtgggggagaatatgacgccctcgctctgttttggtgtggtccccaccccctcggggggagcctccctccccatggggggtgtgtgccccccgtcaataattgtggtggccaacctgtgcgtggtagaatgaggggtttttctccccaccacagagggggtttttccgtgtcggtggggttgttttggtaggactagttggtaaaaggtgattgattggcgctcggcagtagttttgttcgctccaccagaggaatataggaaggttggagaaactatgtttcggccccaccatctgttttgagagagagacaacatatgttcccacaagagaaggcgtggtagattttaatatccgtcgaagaaaagaatgatggggggtgggttcccaccagggggggtgtataattataactatgtctttcggcggcccccggcgggtggaactttaataacaccggtgttgcccccccatcgggggccctactatcgtgggagatttcttcgtctagtaatccgcccctcgtgttgtacgccccacgacaaatattgggtgtggtgagtggttcctcccacaacgtggggggcgtcccactaccacaagcataatagtgggtgcgcgcactaggacggcgaccaacaagtggagtaaggtgttgatgaagaagcccgcgtccaccacccacgaagggtgaagagtgtgtgctcctacaacaagaagacttctacttctccacgagaggtgtggagtgaagcacgcttgtggggcggtgttctgctggtctactgtgttgttctctctggtgctgttgtgtggggtggtgttgtgttactgctggagataatattatacctcgcgctacgcacactattcactacaggagtactctccggagatagacgcgacgcttctgctatagaattgtcgtctctacacccactccacacacacagtggtctctcccgccccacaatattctccggcgagtatagagtatgaagattgtagtattgttgagatatagtcactagttggagactcccgcagcagagagaggatgctcacagacccacacatagtgagcactctgtgtgatattagagaatagagtgggggtcccacacatataaaattgtggagatgtttccacagcagcacacgcgcacattggtgagataatgcagcacacatatagagaaaaggggctttgctcgcacacatgtctatatttatattcctctctctccacatcgagagggtgtcgtgtcgctgtatagagaaaaggtatataaatagtgctgtaagaaagagccccagatttgtaattggggaagagctctcactggagactcttcactggtgtaagagccacctaggtttctggaaaagacccctcggggaacgcagaacaccgcggggctaaaattgtaaacggagactgtatggatatgtgaccccccggtcccagaaatctgttttaaggttccagacttccaatagatggcccaattaaaagtgctatttgg

SEQ ID NO: 688468 - DNA, 805 bp, Homo sapiens
  misc_feature (3)..(3): n is a, c, g, or t
  misc_feature (72)..(72): n is a, c, g, or t
  misc_feature (74)..(74): n is a, c, g, or t
  misc_feature (91)..(91): n is a, c, g, or t
  misc_feature (94)..(94): n is a, c, g, or t
  misc_feature (126)..(126): n is a, c, g, or t
  misc_feature (148)..(148): n is a, c, g, or t
  misc_feature (154)..(154): n is a, c, g, or t
  misc_feature (156)..(156): n is a, c, g, or t
  misc_feature (185)..(185): n is a, c, g, or t
  misc_feature (189)..(189): n is a, c, g, or t
  misc_feature (233)..(233): n is a, c, g, or t
  misc_feature (236)..(236): n is a, c, g, or t
  misc_feature (244)..(244): n is a, c, g, or t
  misc_feature (266)..(266): n is a, c, g, or t
  misc_feature (272)..(272): n is a, c, g, or t
  misc_feature (281)..(281): n is a, c, g, or t
  misc_feature (295)..(295): n is a, c, g, or t
  misc_feature (299)..(299): n is a, c, g, or t
  misc_feature (304)..(304): n is a, c, g, or t
  misc_feature (307)..(307): n is a, c, g, or t
  misc_feature (312)..(312): n is a, c, g, or t
  misc_feature (314)..(314): n is a, c, g, or t
  misc_feature (317)..(317): n is a, c, g, or t
  misc_feature (338)..(338): n is a, c, g, or t
  misc_feature (341)..(341): n is a, c, g, or t
  misc_feature (349)..(349): n is a, c, g, or t
  misc_feature (352)..(352): n is a, c, g, or t
  misc_feature (364)..(365): n is a, c, g, or t
  misc_feature (387)..(387): n is a, c, g, or t
  misc_feature (425)..(425): n is a, c, g, or t
  misc_feature (429)..(430): n is a, c, g, or t
  misc_feature (454)..(454): n is a, c, g, or t
  misc_feature (458)..(458): n is a, c, g, or t
  misc_feature (460)..(460): n is a, c, g, or t
  misc_feature (480)..(480): n is a, c, g, or t
  misc_feature (498)..(498): n is a, c, g, or t
  misc_feature (530)..(530): n is a, c, g, or t
  misc_feature (651)..(651): n is a, c, g, or t
  misc_feature (724)..(724): n is a, c, g, or t
  misc_feature (792)..(792): n is a, c, g, or t
gtnttattacagagaaagaaaaaacctatttcattggtatgaccatatttaatcaatgataatttactggtnanattcaaattattaaatnccngcatggcttctcatgcatggcttatataaatnaacaccttaaacagtataaacntttggnanactttactttccttggttttttataagtntagnggtctccaacccacaatgtcttagggaatagtttaacaataggnaancccttaanaccatctatctctatgtgaacncagacntatacatgngggtgggggttggngggngaatnganggggntngcnttcctaggggggaacatttcnggntttaatanatngattagcttttnnaatcagtcaagagagtgaagancttttaaataaatccccttattcattcattgtgctgcnatcnngcacaataaaatgggggtgatatntttnangtgttgttaatctgcgactntgtcttcttgggactaanatataatccaacttttaaatgcaaaatgagtnttatttgctagtcctttttattctcaaatatgttaaaagcacatgattatattgtcttatgttgtttcagttatgatcctcttctgaaatcaggaatacgaccccaagaaatgagtgagtnatatttgcttttatatcttatgcattgcaagaattcagtctcacaaacagttgaaccataaattaaaaatggnagactcacatttgaatagcagctagttatatataaaaaaatccaaattttttaaaaagtgacttgtantaataaaaactgg

SEQ ID NO: 688469 - DNA, 1412 bp, Homo sapiens
  misc_feature (558)..(558): n is a, c, g, or t
  misc_feature (1310)..(1310): n is a, c, g, or t
  misc_feature (1312)..(1312): n is a, c, g, or t
  misc_feature (1357)..(1357): n is a, c, g, or t
agcggacttccaagcatcgcgcgaccgcgaaggcagctgagcaggaggtcccgggacgctacttggaacccgaggctgtcaccagtgcccgcgccctgatcactcgctttccaccagggcgtcataggtctgagattcggtgagccctcctgccaaggcatgctgcaggccccaagcgtccctcgcttgaacgactctagaagagccgctcagcgtccgactgcatgggtcggacgctccactcctgaccctgaggtgcgcgagggtcccctcgcgtgagacagtggttcggtgcgtattcatgcctgtcgcatggcggacgacgtgccagccagaccgagagccgtggggagcgacataggagccagccgtcgtccactagcagtgtggaacgagcatcgtgtctgcaggcagtctatccctgtcatgaatcctgtccaaccattgcatctgagcatgagtagcctgtgtccgaaccttatgaaatagacccccgtttgattggcaatcgaacatccaatgcctacttcgcaacgcgactggcgtactggcatcccnttgggtaccgagccctccattgcatgaccccttcgcgggtcccttcccaccccacgttgtggcacttggacggaagaagctcaaactatgacaccgccccccattttgacttcgcccgaggcctatgccttctcttgctttgggactgggaattgggaaggactccctttgcgcccttcttatagaggcatttcggccgcccttggccccgcacgcttctacacacgcagaccccgtacggacgtgtcctacaacgctgctgggggcccgcagaccaacggctacgaggaacttcgacactaccccgctttctgggggcctccccccttttccctcgtcccacgaggacccttgcgggtcttttcgcacctatatacacccctgctccggttcccccatgccacaacaggcgccaagctcccgccggcgaacgtgacttaaagacgcggagaccccttatcggctccggtgtccccacggtacagttaatttccccttttacgccgtgtttgaaaccactttattacgccccttggagacgcattccgcgccttatggactcgccgcgcgcacactggatacggccgtccgccctggacaccgagccctagctctggcgtacgggctttcgcttacgtcccgctttctggcttggcaccccgtctccaaccttgtcgcctctacgtagagcgccgcattcgagcccctgctctggcgctgcgcttgagcttattctaggtttccgtcttganangacagtggcatcggttcgctttaacgctttatgtgccacccctcnaccactgttttacactatccgacaaatgcgcagtcgcgcgtataacttacgcgcg

SEQ ID NO: 688470 - DNA, 925 bp, Homo sapiens
  misc_feature (925)..(925): n is a, c, g, or t
cttcactatactactaacagaccgatacctcaatacctccttcttcgacccctccgtgaggaggaaaccccattctagtatccaatcatcctattactcgattatttacggtcaccctgtagtttctattcttatccgtacgcaggatttcggaaataatctcccatattgtaacttgactatcgtccggaaagaatggaaccatttggatacataggtatggtctgacgcttatgatatcaattggtttgcctagggtttatcgtgtgtagcgcaccatatgtttacacgtagtgatatatacgttgagacgatgagcatatttcacctcacgctaccatacctcatcagctatccccagcgctggtgtcaaaggtatttaagctgactcgtctgactccacgtgaggccaattcttgacaatgatctgggttgacattgcctctgatgccttaggattcatcctttacttgttcaccgtaggatgtcctgactggcattgtatcagtcaaacactctatcgctagtagatcgtgctatacgaagtgtactaggttgtagcctccacttgtgcgcactagttgttcctaatcatgacggagcttgtatttgccatcataggaggtcttcacttacatctgatttccccctattctcaggcttcgccctagaggaaatctttcgccactcatccatttcaggtatcgatattcatcggtgtcaaatctaagatttcttacccaccaaaatttctcggcttatccggaaattgccccgatcgtttactcgggaattacccgatgcatacccacatgaaaaatcctatcaatctgtaggctcatttcctttctctaacaagcagtattttcatagatttcctggattggagaagcttcgtttcgaccgaaaagtctaatatcgagan

SEQ ID NO: 688471 - DNA, 358 bp, Homo sapiens
  misc_feature (39)..(40): n is a, c, g, or t
  misc_feature (238)..(239): n is a, c, g, or t
ggcacgaggggaggacgatgagatcatgcagggattcanntcagctttcaggcccctgcccaggcactatggtacttgctggacttgaaacagatggaagagcgctgccgtttctagtgacctgtaaacccaacagctcacctccgcctccaggaagaccagactcccacccttccacacctccagagcagtgggacttcctcctgccctttcaaagaataaccacagctcagaatgnntaacgtggtcatctgtgtcgccatccccttgcctgctcacacctgcaccacggccatggggaggtcgctcctgggggcagagtctctggcagaggttattaataaacccttggagcatg

SEQ ID NO: 688472 - DNA, 271 bp, Homo sapiens
gcatttggggctgaccacaggcatctacttttggggaagcataatttaaaacaaatttattttcccaacacagaaaatctgtccacaaaagtagtagataaataaaagttttattattgaataaacattaaaccagaatacaatgcacatcacaggcagtccactaagacactgcaaagacggaaaacacatctcacccttttatatagccaagcaaatatcacccattgcatgcttgttttcaagataaacaataactagccaccactgc

SEQ ID NO: 688473 - DNA, 1070 bp, Homo sapiens
  misc_feature (1070)..(1070): n is a, c, g, or t
tctcctcctcctcttgctcctccagctcctgctccttcgccgggatgccgccgccgagtcctgcgccagtgccgaggaagcctcgctggccccatcccgtaacccgccgggcatcggagggcagcgcgccggaggccaaggttgccccgaacggtccggggcgaaaggacgtcgcgggctgccaagaaccacctggtcaggagatgggccgaccggccaaaactttgtgaaagccgagccagacggccccgtcatgtcggcggcagacaacacagagaagtgaccctgtggacaccgggcttcatcgatgccacttggggcagagttggcaccctggggactggggggcggccgatggcggtgccacaacttgcctgccccaggaccaacgcccaaagggagcccttcgtgaaaaccccacaactcgagactccgcgccagggtggctgggtgacacagaaccgcgtgtaaaaagcgatggtgttcccctatcggggtacgggcgtgggaccaacgcccattcaaggcaagatgacacgattgaaccggagggtaccacccaaagaaatgccccgattgctgcggtcacactcgcacgggcagctcccgaagagtcctctgatgggccttacggcctgggggtcacaggagctaccagtccctgctgacagggtcgcgtctatcgagggcccggatggtaccgcgtcggctggtccactttcgttgcacagtttgggaccagctcacctttccagggcaggggtgtgaaactatgcgtggtcacctggggtgaacttgacatcacatgccttgacaacctcgcttggatggggatcccaaaacgtgtgttatgaccgcgactgcctccattgggaccttggtccaacaacaacaaaccctggtcggaaaagcgatggattgaccagaggccccccggagagtgatatggcgaccagttcacgcgcccgcagtccctccggggctgcacataccacagagaatacgcgtttgtacagcacgaaagagggcttggtagagaaccccgcttgttatgacgcggctgcagcttn

SEQ ID NO: 688474 - DNA, 127 bp, Homo sapiens
  misc_feature (7)..(7): n is a, c, g, or t
accctgngtttatctcgggaacacctcgtgacgattctgtctgccgctggtctcacgccccttgacgacgacctgtggcatcagttcagccaccgcgtcgattcctcgatacaccgcgacctcatcg

SEQ ID NO: 688475 - DNA, 615 bp, Homo sapiens
ggtatctcactcccgccacagttgggatcggtctctgctgtttacgtcctccacctcgggagcccccggtgactgtcacagcctctttggcctgtgatctgcaggttctgggagacgcacagtaagatgccaggacatcctggaaggctgggaaaagatggagtttcactcttgttgcccaggcctggagtgcattatcccaatctcggttactacaactccgcctcccaggttcaagtgattcccctacctcagcctcctgagtagctgggattacaagcacctgccaacaacccggctaactttttgtacttctccagtacgagatggggtcccatcatgttggccaggctgtctcgaactcctgacctcaggcgatccacccagcttcccaaagtgccgggattacacggtgtgagccaccacgcccggctctcaactatcaactaatttttattctctagtagacacgttggtggtgaagccaaatcacgatggtcgtcctcgatcgagaaaaaggcagacacttgattttccgtggacttctcggcacactacacacttttttccccaacgcaaccaaccaccaccactatcaacccacaacaacaactc

SEQ ID NO: 688476 - DNA, 681 bp, Homo sapiens
gagcggctgggggatactggactaaacagcccctcccccccctttttttttctgaggcggagtctcagtctgtccaggctggagtgcattggcgcaatctcctctcactgcaacctctgccgcccaggttcaagcgattttcttgcctcagcctcccaagtagctggtattacaggcgcctgccactgtgcccggctaatttttgtatttttagtagagacggggtttcatcatcttggccaggctggtcttgaactcctgacgtggtgatccacctcggccgcctaaagtgctgggattacaggtgtgagccactgtgcctggcctctctctttattgggttttaaactaagttatattatgaatatacgaatggtttatcaaaatggttaccatgtgccaagccctggggatgtttggtatactagaaagggaaaagaataatgtgttactggcttccttgagatcctaatatttaaaagtactagccaaaatggtaaatgataattaaatgggttgattgggaccctcagtagtacatgagtatggtaataatatggggagttttttacaacctgcagtgagagtagcatgttggtctccaagagacagttctcattttgaagcacatgtggtaccagcctctggctgaaagcacgggttccccgtgttgaagcctgg

SEQ ID NO: 688477 - DNA, 281 bp, Homo sapiens
tttcatttcccttccctaaagcagggcggctgtgaaaagttgttaaaccaccatgctaatgtaaatgtccccccccccctttaaactttccctgttcagagcatcagatgaagacttcccttgggttttaaaggggctttctgatttttggtagccccttgaaaaagggagtttgaaagttgttgtatactgttaacgattgtctgcccctgtcccccccgaaaacccctgattgtttatggaaagtatctttaataaagctggaacccgtttggcttgga

SEQ ID NO: 688478 - DNA, 329 bp, Homo sapiens
ctgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaa

SEQ ID NO: 688479 - DNA, 345 bp, Homo sapiens
  misc_feature (1)..(1): n is a, c, g, or t
natattatctcatagaatatcacacttgctgatgtcagactgggaataagagctgaatagtgcttatctggcaagttgcaggggaaggtgcccaaaagcgtatgaatgctattctctaacccagaaatgttaatcttctcacaaccatgcattctcggccagtctaccggttccaattttatagctgaatatcgaatggaaagcacaaggatatctcctttactgctttgcctcttgcccaggtctttcagcaaatacatgtactgaaaggaagaagaggaggtctgggacacagcttccacagtgttatttatctcatccactctatttctgagtggcctttcc

SEQ ID NO: 688480 - DNA, 282 bp, Homo sapiens
aacaatgtcatttgatctggacatttaactggctattagtaacataatggtgttgaaacagaacgtgatgttaagtctcaactctcttcttagagtctcacccatcttatattttggtaagctaataatggcaacagttaacatttttttgcataaagcttctcatgtatgttccagaagcataatttcttacatttaaatgataatattgacgatctattatgctgttatttaaataaaatctttatgtaaatcatacatttgtgcataatgttagagata

SEQ ID NO: 688481 - DNA, 421 bp, Homo sapiens
acgtgttgatttgctgatgacactgactgtgaaatcaaacagaatgcctgaatgcatgacatacttcctattctacaccctagtatgctcccttcccctactcctcgaactaatttacactcacaacaccctaggatcactaaacatactaatacacactctcactgaccaagaactctctcactcctgagcccacaacttcatatgactagcttacacaatagctcagatagtaaagatcacctcttacacggactccacttctgcctccctacagcccctgtctcaacacccaattgatgggtcaatagtacttgccgcagtacacttgaaacacgtcggcaatggtctcatacgcctacccctcattctcaaccccctgctaaaacacctagactcacccttccttgtactatcccaa

SEQ ID NO: 688482 - DNA, 279 bp, Homo sapiens
tgtgagtgagtattagcagagtcgagagagaaatgatgggcagttcgcctacaccggggcctctgcggggtcagtggggagctgctgtatgtcttggctgcctgaacggtcaaggtgacataggcttcatagccgaagaggcacgtagcgattaggcccagtgcccccttgggacgatttgtagagtaggtttcctactctcaagacggacccacaattgtaggtgatccaggtacgagtcattgcctgctatacagggtactggaaagaaaaatcact

SEQ ID NO: 688483 - DNA, 609 bp, Homo sapiens
ggcgtcgccgatacaacagccgactcggtcattgcgcaggcttcccggcagctttatcggtttcttccttggcctatggccaacttcaccggcccaaccattgatggtcttgtccagatcgttgccattgcgctgcatcgcgtcggagaactgatcacggaacagcttgccgatgttgataccgttgatgatcacgttacgcagtttccactcaccgttgatcttcgtcagggtgtaggacacagggtacacggcgccattgctgccggagactttcattccgacttcggcacggtcgcccgactcgtccttgggcgcatcaacgataatgccctggttgttgtattccagcagagcgttaccgtagaactggaacagccccttcttgaagttttcctggaacgtctgcatttgcgcaggcgtcgctttgcgcgaatatttgaccgtcatgctgcttttggagatgccttcagcatcgaccacagggccaacgatcgtgttgagcgcgttatcgaacttggaaggtcttgcttgtactgtactttattagccttgaggtcagccagcattttgctggtggtgtcctgacaaatcgtgggcagaactgca

SEQ ID NO: 688484 - DNA, 1012 bp, Homo sapiens
cagcgcttttgggcaatggaagattcagctgtcgaggagcctgtccctgaagttgtaccagtacaattagaaaccgcaaaaagtccaattagccgattagagaagttatcagactgcctgtttgagcctgaagggaatgtctgctggttgacggacagtaccgtggaggaacacgtgctggcgctggtggtagactacgtcagctgactgaagctcggggacagagatcaacacggttccctccgcagggcaggcaaagatgggggccttgtcgtgacagaaggaaacgtgaggatcaggcgtaggccgtgcctcgtagcaggcgtggctcaatacgggcgacgccggacgctgatgaggaggatgacccatccggtggacttgagctcggtctccagtgcgctactcgcaggcttcactcatcgctggtcttcaagagacgagcagaagaaacaagatgtcacgctttctctccagtgccactaggtgcgcttctcaatgcagaataattcagtatttggcgacttgaagtcggacgagatggagctgtctctactcagcctacggaagatcaagactggcgctgcagtgtgcgctgagcctgcacgcgcagtttgtgaaggatgctgtgagctacagaagaaaagtggtggtacgagctcctggacccagatcgacaggcgggggacccctcttggaggctcttctcactggaaccgacagaaattggtcccaatgacggcgtcagatgaagcaatggttgggaaagcctagagaaggagcacccttggtctggagtcaagtggatgaagcctattcgaatttcgtggattgccggctcgtcccgggagggaaaagctcgccgcactggcatacctgtttggcggagctgggggcctccaacagggccggcgcactacatctccttccctagacccgtgcctttttggaagccccaatttctacgcgcacacactatttagggaaaccaccgttcgcatgcatgctgtcg

SEQ ID NO: 688485 - DNA, 252 bp, Homo sapiens
  misc_feature (33)..(33): n is a, c, g, or t
  misc_feature (52)..(52): n is a, c, g, or t
  misc_feature (125)..(125): n is a, c, g, or t
  misc_feature (205)..(205): n is a, c, g, or t
cttaggggataatttaggttttttgtgtttctnttttaaatttaaatttttntttttttgaggcagtatcactctgtctctcaggctggagtgcaatggcacaatcaactcactgcagccttganttcctgggcacaagtgatcctcccaattcagcttctcaagtagctaggactacaggtgtgcaccaccatgcctggctganttttttttttaagagatggactcttgctgtgctgtccaggctcgtgt

SEQ ID NO: 688486 - DNA, 233 bp, Homo sapiens
gccccttgagccctcgtcgagtcgtccctgcgcttctccgcacgcgcgcgcttcgaggcgtcacgagaagaggatcgtcgattcgctatcagaactccatctttcgacctttgtgatgcaagtaaggtgatgactgcttcctgctgcactgaggatatatccatataaaatcaacagagaaaggcaaggaccttactactggtccaaggatcgctgactaattacgataagaa

SEQ ID NO: 688487 - DNA, 340 bp, Homo sapiens
  misc_feature (159)..(159): n is a, c, g, or t
tttaaacttgaaagtgtacgagttgctttgttacgatgaactagatgtgtcgcggaggatttgatgcttttctctcagcataggtatgcttactatgaccttccaagtttgacttgtataacatcactgtcaaactttgtcaccctaacttcgtatttnttgatacgcactttgcaggatgacctcagggctatgtggattgagtaatgggattgaatcaatgtatcaatatcttcatagcttggtaacgtgggctcaatttccatgggtctctgaagtatcacacactggggataccagatagcacaatactctctgagcacattgcgcctctgatgtg

SEQ ID NO: 688488 - DNA, 1296 bp, Homo sapiens
tttggtgagtttttttttattttttatttgggaaagcaaggatccacacttacccctcccggtcccttaatcccttttctaaaaaggggggaaaactccggatggatttgagggatgggtctggtgtcagctgtgtttttatggcacacctaaatcctgattataggctttacatttctccgcaaagcctttatttgggcagttaagccaattgtgttttccagaaagttagttatttctcctctttcttccctttctttcctcccttttccccgtctgaccccaaacgttatggtccaaacatgactggacagcagctttggtttcttgaccctgtatttatgacagtctgctaatattgacagaaggtgcagtatggggtaatagtcgtgatttcgctaatcaatcatattaacgccggaaacaaaaatgactggtcctggtggtactggagtcttaagaaaaagtgcccatagtttagtgacaattcccaaaggctttagtaccaccggtatttcaaaaggggggacccaaattcccggaagaaccaagctctgaacagactacgtgctcagcttagaacgacaagagaatctctagctgaccaagtttggacttccaagagtgtaatatggccttggtatcccgggcgaagacagacacagtcccgcacttctggaagtgtcggaggtaatcccagtccatgacacaactattttgaagaaaatatcctgaacaggtgtgcgagattccagcttattccttggaaaaaggatccctcttagaagactttaaccaacacgggcgtcgtgtgtcacaggtcccagtgcacccccccgaaatattcaggccatattgacgaagggagtgtacactggcggttgtgaacccacgagaagacgggattcacacatcttgggggccgccggagacatgaattttggaacacatctgtcctgtgcccagtggtttacaaggggggcacagaaaacttcttgtagaaacccctataggggccgcgtgccagccccacactggtgaggttaaacagacggggggacgatcataaaacaaaacgcttcgggactgtcgatctgtggccgcgccgagcgcaacaaagggcggcgccgtggaacacacccaccaaccagacagggtgtctccactgtgcagaaaaagccatgcagccaaccccaacaagagaagccgcacaaccaaaagataccgaaagcgcgcaacacgaccaaacaagagcacccccaccgggtgtagaccaacaagaagaccgacgctgat

SEQ ID NO: 688489 - DNA, 404 bp, Homo sapiens
attcgcggccgcgtcgaccccagcacagtggcatgcacctgtagtgccagcttcttgggaggctgaggccagcctgcctgggcaacatagcaagacctcacctctaaaaaaaaaaaaatctggccaggcacggtggctcacgtctgtaatccaacactttgggaggctgatgggggtggatcacttgaggtcaggagttagagacctgcctggctaacgtggtaaaaacctgactctactaaaagaaaaaaaatagctgggtgtggtagtgcatccctgtaatcccagctacttaggaggctgaggcgggagaatcactggaacctgggaggtggaggttgcaatgagctgatatcctgccactgactacattctaggagaaagagcaaggctccattttaaaa

SEQ ID NO: 688490 - DNA, 290 bp, Homo sapiens
  misc_feature (100)..(101): n is a, c, g, or t
  misc_feature (107)..(107): n is a, c, g, or t
  misc_feature (115)..(115): n is a, c, g, or t
  misc_feature (119)..(119): n is a, c, g, or t
agcggatcggcagctccagttcagctcgctcggcgcacccacgcctcgctgccccgcttcctgccctcaacctgggcatgcgcccagaagctgcgtgtannaaaccntgtgggantccnctcgaggtcctactacgtgatcactggacagtacacggactggagcgccactcagagcccagcgcatgctgtccgcgcttacggctgacgactgcagtgctgactgctaattgctacggaactgggactgctgggcccaaggagggtgctggatccccagaagaggggccc

SEQ ID NO: 688491 - DNA, 498 bp, Homo sapiens
tagaggacctcgatggcgacatttcaagtcatttttctttactttgattttttgaagtttgaatatcacatgcctggtatagtttttgtttggtttgggtttggtacttatcctggtttgtgttctctgaatttcctgactctgtggtttaaaatctgacattaattttgggaaattctcagtcatttttgcttcaaatattgcttcttttcctttctctttttcttcttttactgctgatattctcgttacacatatgttacatcttttgtagttatcacacagttcttatttgtttctgtttgttttcattctcttccttttctctgttttttggttttgaaagtttgcattgtcatatcctcaagctcagagattcttttctcagccatgtccagtctactaatgagcccaccgaaggtagtcttcaatttgttataagcgttttcaatctctagcatttctttttaattcttagaatttccgttctctgcttac

SEQ ID NO: 688492 - DNA, 309 bp, Homo sapiens
aggtagataagatgagaagataatatgttatgaaggaaaataaagtctatgttcggcgagcaacctgacagagacaaatagaggtttgccacaagtgggtacaatggaagattcggtccctacttggaaatgaaaactcagaaattaggcagattgagtgtgcagtaaacataaataagtaacagtctggtgctggcaagatcaagagggagttcagcaacactgagaatctgattaatgcactgaataagttggattaagtgccctcagaaagttaataagcaatagcaaaagtagtttttttttttt

SEQ ID NO: 688493 - DNA, 160 bp, Homo sapiens
cgctgtggccggcttcttcaaattttccggttttttccttcggctaacctccggagggttttggttttctctcccatatagtgcttctctgcaattgatatctccgagctttcacgggccaccctgagagggaaaaaaatgggcacactctcccttacag

SEQ ID NO: 688494 - DNA, 156 bp, Homo sapiens
  misc_feature (77)..(77): n is a, c, g, or t
gagatttgaaattaaaggcatagtaaatattttttaacaggcattctaaacaatacaaaagtaatcaaatgtatttnctctaaaacttgtcttttaatggagttctcctcctagtaaatattgaacacagacttttgccgtatcacattttgcatc

SEQ ID NO: 688495 - DNA, 752 bp, Homo sapiens
atcccagcaccttgggaggcagaggcaggcagattgtttgaggtcaggagttcgagaccagcctgaccaacatggagaaaccccgtctctactaaaaatacaaattagctgggcaaggtggcacatgcctataatcccagccactcgggaggctgaggcaggagaatcgcttgaacccgggaggcagaggttgcagagagccaagatcgtgccattgtactccagtctgggcaacaagagcaaaactccgtctaaaacacaaacaaacaaacaaaaaacccaaaaaactgcaaggcagaaaaaacaagatggacgacggaatggcgagactaaaacaacattaaggggtgtacaatgacacatacattaaccaattacaatgtatggaccttactgaatcctgcatgaccaaactatcaaccactcccaggggaccacctaggaacattcacgtagtcacatgaattctctgatccagggactatcatcaatcacacaactgcactatcattattaatgtcgcccactacacaggaccccttaacctgactcctaacacttattgggcagttgtcggtggtacaatggcgcagtacaaaccaaacaactcacggcctacctactggcataacgcttccaacacactactccctcaataacagcgcgacctacataaccacacaacaccccattcacactttaatctcgagcacataccacgccgacacccgggaccacacaccacccacccc

SEQ ID NO: 688496 - DNA, 103 bp, Homo sapiens
gctctcacccctccctccatgatcttcgcatagagcacagtaccccttcacacggaggacgcgatggctcccaatatacgcccatatttccagaagagctccg

SEQ ID NO: 688497 - DNA, 865 bp, Homo sapiens
  misc_feature (447)..(447): n is a, c, g, or t
  misc_feature (784)..(784): n is a, c, g, or t
ttccacacgtggaagcttttttctttgccctactaatgactcttgcttctgctcactctttgggtccacatgccttaaagaactgtaacgctcaccgtgaaggtctgcagctacactcctgagctagcgacaccacgaactcagcaggaggaatgaacaactctggacgtggaggaacgaacaactccagacgatccgccttaagactgtaacaactcaccgcgaaagtctgcagcttcactccaaagccagtgagaccacgaacccaccagaaggacgaaactctgacacatcggaacatcagacagaacaaactccggacacacatctttaagaactgtaacactcaccgtgagggtctgcgcttcattcttgaagtcagcaagagcaagaacccaccattccggacacaatggggttgcatttgaggcaactttatagcccagntaaatgtaatgacagcattataggttaatcctagaggtctatcaataatatagatcttcagttctagaaaatccaaagctgggctcgagagtcataaagtcaacaaattgcttacagaaagaaacagagagcagacgagcgaatcaccaaacggaagaatgactgaggactcacctgggtatgacgtacagtagcaaggactcaggcagactgtcgaagtggcagtcgtggcgcaagcctcctggactgttgtctccagaggcttagtataacgacccgataagaccttgaggaatatgggccaccccacctgagaggaatgcacggcacgcaccanggtggagcagtatagggacacttcacaacaaataccgttggattggcgcttggtccactccatggagggcaaaggacacaa

SEQ ID NO: 688498 - DNA, 754 bp, Homo sapiens
  misc_feature (141)..(141): n is a, c, g, or t
  misc_feature (567)..(567): n is a, c, g, or t
gagtcctctgccactctcgctccgaggtccccgcgccagagacgcagccggctcccaccaccaacccaccgcgccctcgcttcgcctctctctccgcggagccacgtccgctgccacccgccgccgcccacggccatcgcncaccctcccgcagcctatgtccaccaacgtgtccgctgctcctcgctcctctctcaccgcaggtatggttcgcgcggcccggggccaccggcgagccgggccggaggctcccagcccggggagctacggtggactacgttcccaccccgcaaccctacaggctctggggcacggcgcgcttgccgcccccaagcacacaggccggaagccttcttaccgccttcgtcccctcggtggcgggcggttgtattggccacggcggccttcctctgtgccgtggcggccttgcgggaagacaagtggtgccccggggggttgccgggctccttgccgagggacctcgcggggggcacctttcttccggcgtgggcccgagacgccaatttcaacaacccgcggagttccaagaaaacaccccgggaccanacgagacaggtgtgcacgcttggcaggacgcttggaattggacccggttgcgccaagttactgtcgaccagaggttgcggcttcacgttggacgcagacaggaaataaagattccgtgtttgaccggaagtcggagcaagactcaagggcccagggcaagttccgcccttggggggaccctctaacg

SEQ ID NO: 688499 - DNA, 209 bp, Homo sapiens
tcacttcccaggctgctaaagcgctcttcaagaagtcaaccttataaccatatagggagtaaggaacagtgtttgcactaacgacttcacttggtgggttgactggtcgtctggtgtgtcttcttgtgtgagtatgaccacgtgtatgatctctcttaccatgaaaggtatatggtgccctaggatctcaaatgaaataaataaaaact

SEQ ID NO: 688500 - DNA, 107 bp, Homo sapiens
gatgatctggatactattgatgtaagcaacctcaacagacagttttgtttcacaagaaacatgtaggaagatcaaaggcacaggtagccacaggaacagtgtactgc

SEQ ID NO: 688501 - DNA, 843 bp, Homo sapiens
acctttctctctggtgtgtgtgtgagggggaggaggtaggcgcaggacggcacttttttggccgcctggcttccgggggttgcaaccgtgggaccctgaaggtgggcgcggtctccgcgggtggcggcgccgtggtgggcccccccggttcctggtccgagagctggtcgcgccgagttcccgggtgccggtgttgcccgcccgcccaggggtaggttgtgggccagcgcggggggacaattggggggacatgacgcccacagcgagggcctcacctcaagcagggttagcagaactggggtccctcgccggttttaaaaccgcgtcccccccattgggggaagccatttcacaccttgggcgtcaaagacaaacccgttttctccgagagggcacagccccatttgtggcagccgcccctcttaggaacatggccggagaacccttctagcaacgtctcctccactactcccccctaggttatgagcgatctctgcgggtctttgcttgtaccaacggaacaagttctgcccaacgacaacctcgccctggatactgtgacaatcataaaactgaatgcgtgtgtcacatcacatatttcctgaggaacactgggggagatatttctaaacgggaacaatagtttcttgctcgccaccctatggagtacttccaccactgtgattatggacctagaaattttgataggtagttaataaaggtctaaaagacccgtggatggataaaagccagcctctgccacagcgtccccttgcaggttttttcaatacagcctttttcttcacaaccaagatttttcaaaaacacccctcgcccaacaaa

SEQ ID NO: 688502 - DNA, 261 bp, Homo sapiens
atcctcgaccgccatgcaactgcatgatcgatttgaggattgccagccctaaactggtcccgccctccaaccgcgaacgccccgcgcccacccggtagaaccgttcgaacaagcgcgactggtgctctgcagcaataccaggccctcggttctccaccgctagccgtacttcgttgcccgcacgctcgatacgcagatcgacgggctcaccttccgggctgtgccgaatggcattgctcaacaggtttgacagtgctcgct

SEQ ID NO: 688503 - DNA, 244 bp, Homo sapiens
ggttgcaggactacaggatgtgtaccacaggctggttagtttttaaatttttggtaaaggacagggtctcacaaggtggcccaggctggtctcaaattccgggtcttaagtgatcctcccacctcagcctcccaaaacgggatcaaggttttaatttttttgggagacaggctctttctctggtggcccaggttgggagtgcagtgggttggatctcgggttcactaacaacgctcgtgtctcc

SEQ ID NO: 688504 - DNA, 108 bp, Homo sapiens
gttacgatcacatccactcactctacattgattcacctggaaccttttgtatgacaggcccattatgctagtgagtgccacattgcgagtccacgtcaaatattcatt

SEQ ID NO: 688505 - DNA, 389 bp, Homo sapiens
cggccatcgcacagcaggttcgctagcaggatcggcaaggctggagtttttcgcaccggaaatgcgaatctcgccatcaaaggcgggcacgccggtaataatccatttatccatgagaatctcgacgccttgggggctcaggtgcgctcggcccaggcagcgcggatgaaaaaatttcatagtgaccgcatggattgctgccctcggtgatccatgggttcacatgggcatagatcttgctgatgacgcttgaccgggctcaatgccgcccagtatcatcgcttaatcacgttcagcttggaaattgcagccttcgccttcgaatactacagtcgtatcaggcagcttcccttcaaggaagctcttaacttctagggacatgacatgag

SEQ ID NO: 688506 - DNA, 119 bp, Homo sapiens
ctatagccttccccttaggtcttcagaagcatcaagttttaacttgtggacattggatttggtggaacagcaatcatgactgttggcaagagtagcagatgctgcagcacattgactat

SEQ ID NO: 688507 - DNA, 1759 bp, Homo sapiens
  misc_feature (442)..(442): n is a, c, g, or t
  misc_feature (1488)..(1488): n is a, c, g, or t
gattagacgtctctactaaagctttggtccccaccgcaagcctatagtcgcttcgatgacaccattgttagaaactgtagatagagtctggcatctctaaacgcgcatatatggctctgtgattcggagctgccatgagttacacaccagaggcctgtcttttataaaccatcttaggttaagaggtggatatcatctgtagtcctattctaattggaccgctcgttcctattgaccttcaaagcttacaagtgggctttagagcactgtctcctataatattggataccatcgcacagtgtgcgaagagatatcgcattgtgtcgagctctgttcaaccggcatgacgtagacagaggaaagccctcagtcatgtcagagatgcgatagaatacgaaatctaaccacatctttgccctaggggaacgccgaagaatccccntcccagaagactccaagcttgtggtgctgactttctgggcgtcgtgacgcttcggtcgtttgtgatcttcgccacgtgttcctgtactttctaccctacccgatggggatgaaggcgcctttgggtgcctcgagtatctcgaccatggagcgagcgacgccccacatccttggagttctataccacttcgtccttgtcgccctctcttgcgttgtacttcgtactagtcccccctccgagtgttctcccaggtacacttgcgaactttgttcggaacacctcgagttgggaagttagaacgtatttcgcacaatactattgactcttcttacgtaattcactttctagcaaaattggtcactatctcatggttaatcccatccaacacttggacttaaattgcaggctcaccgcttagttgccacctttgagttttcacattcaccacttttaaccgaacgcgtttgtggggcgaatacgggtggaagacgggagcttctattggaaccaatctggtgattgcccaatggaccctatttgactttggcccaaccgcagttaaagaatttgcgtggtagttgtgggccccaccttcccctggggggctacacaacctttgtttgagctcgctcggatttggggcccggctgggaggggccttctccccgcaagaatcccacttttctagttaccccccctgtggccattacgtagtctttggaggcggtctttggcccacattgggcttttggtgagggagcccagacgggggtccaatcttcgctttgtatgccctggaccccggggggcacagcctttcacctttggggccaatttggccccgtcttccccggttggttccccccccaacttgggcccaaatcggtgttcccacgtcggggttggggcaacccttggaaacactgggcccggcgctacagaaaacaacgtccttttgcccaatctcatttgtcttggaaccggttccccgaccacgggtgactggtcaaaggcccatggctcgtttgctggaagtgtggcccccncctcttctctgtgggcattcccttgtgcggcgttcgcctttgtcgacccccgatgtgtggtctcccctctgtgacgtttccaagaggcgagaatcccccgtctcgttcccatccttttggaaccccggggcgtcgtgcttgtgccctcctgagcacgcgttgttgtcgagctgccttccggctggcgtgaccaccgaccttgtttgtgctcacccgcggtggtgtgtctcctgtcgcctgatgatcgctccgattgaagtcgtccaccacc

SEQ ID NO: 688508 - DNA, 1527 bp, Homo sapiens
aatttttttggtttttttgtttatttttctgtcttgtgattttttgtattttgttttttgttttacttatgatagctgtattttatttgtgtgtatattattatttgtttaattgatatttattatctttgtgatattatgagggtttttgttgtgtgttgttgtgtgttgttattttcttcttgttgttagtttttttgtgttgttgttttgatgtattcttttattttatttttattttatgttttttattgttttttgtttgtttttgttttcttatttttttgttttgattttcttatgtctttttttgttttttattttggatgtgtttgataatgttgtttaaattatggtatatttcatggtggttttttcatagttttttgatgttgtgataatttggttgtgttcaaggtgattgtggtatattggtgtttattttattgtggtttgaattttggaagctttctccttttggttgtttgtgtctgtaataatttttatgtatatggcatgacttttaattttgaattttatggtgattcagtgctccttatatgtcctggtgtggttgcttttgaattgttcctttcgtttgtgttggggttccctgttctggtggtcagtttctgttcactgcgtgctgtttttggtgtctttcccttgctttcccttctttgttgttctctgggatgcctttgtggtcgggttcttgtgtcatttttcgtggttctcttgttggtttttatgtttggtatgtcagtgtttgtgtcgatgtgttaaatgtgttcttctttctggtcgtcattcttgttcgtgcgtagtaattccgtgatgtgtatgattgttgatgaccctggtcaagtgtatttatggttctccatggttcaatcttctaaaggatgacttgtgctgctatgcctctatttgcatgtatatttgtgagatgtgaatgacctgttctctttttgtggtagtgatgtgtgttatgtgtcatcccatggctcttgtcattgtgatatttgcgaatctggtgtgatcattggtcatccgtctctgatctttgtctctcttataattttttctgattggggtccagtatccctattatggctatgagtcatatgatgggatttgtgtgtgtgatgatgtgatgatgattatgtgttaaatattgcaatggatggatgatgatgatgatattcatgaatgtatatcttatgtggatgctgcagtttgaggatattgtctgctgtatccttatggggggagctctctaatcaccatgaccatctatgatggatattgttggccttatggccgtgactcctgccatttatgcatgagattgaatgactggtgattgcccgctgttttctttttccttgcattttcctaataggccgtgtactgatccgtttgctgtgaaccctatgttatttccatgtgtcaagtgggtcttgtgttgccagcttctatttgaagatggccttgcactcagtgtaagttgctgtgcagcagtag

SEQ ID NO: 688509 - DNA, 174 bp, Homo sapiens
  misc_feature (83)..(83): n is a, c, g, or t
  misc_feature (120)..(120): n is a, c, g, or t
  misc_feature (149)..(149): n is a, c, g, or t
cgactggcactgcgcaccaagaggcaaaatggcggaatttaaccagtgtagtgacctaccttcctctgggaacgcacgactgngtaacgtggcaaaatgcctcaacgtgagcatgcgcgncaacttcagataatcaaacctgtgcatgngggacgggtcaccgagctcgcaatt

SEQ ID NO: 688510 - DNA, 256 bp, Homo sapiens
tcaactcagcggaacagctgtgtgttcctccagagcgacatcaccattgtcctgtatccctggaacgcatccccgtgctcctggaaaacctttgactacgccaccagcatcaccatggcccaggcctcggatggcctttattccatgcaggtgccatggcagctcaccagcctgccctggtccctgacctttcgccaggaggagaccatcatcatcatccggcttatcgaacaggctcggcatgccagctatggca

SEQ ID NO: 688511 - DNA, 896 bp, Homo sapiens
ggaaaattattaccaagagagtggacgtgcaggtcgagatgagatgaaagcagactgtatttgtactacgggttggagatatattcaggaatagggttcaatggtggtgatggaaaactgtgggacagcagaagctttgtgagatgggtatcatactggtcaaaacataagcaaatgtcgtcgtgtgttgatggctcagcatgtcgatgaagtatggaactcagaatgcactgtacacaagagatgtgcgataactgcgtgtaaagacaggtggcatttggaaagaaagaacataacagagtactggaggagatctaatcagagatcctgaagcaggccaggaggcaactgagatgaaaaactcactccattgcaaactgattgcattctctggatgggaacagggtgccagcacgaacctgagagtagcaggctgtcgctggctcccacactctcctcgtgaaggatctgggacgaagagtgattgcacactttcctaagtacagctacggatcttcacagaagacgtacacgttattaacagcttatgctaccatttcgtactgtgaaaatcaggacctaatagctaatcttctgaatcaaatgaggccccatgctatgtactatgccagtgacaaagtccacgcaggaattctttcaggggctgaaatcgtctcaacacttggtcagttctgatacaaggtgatacaccgatggcagcgacagcaactccaggcaaatctcccagaagcacggctgcaaacatggcttccacacaacctggtcttcgcactaccgggactcaacaagcagcacacacggctgatccctgatatgaccgtcaccagactcccaccaagcagcggacacccatgcctagccacacacgggccgca

SEQ ID NO: 688512 - DNA, 828 bp, Homo sapiens
cacctgaggtcgggagttcgagaccagcctgaccagcgtggagaaaccccgtctctactaaaagtgggaagttagctgggcgtggtggtgcatacctgtagtcccagctgctcaggaggctgaggcaggagaatcactagaacctgggaggcagaggttgcagtgagctgagatcgcaccactgcactccagcctaggcgacagagctagactcagtctcaaataaatagtaaatatattcttaatctttatggggataaagaaattaggacttgtgagacattttaaaggtaatatcctggtttttaaggaatggtagcattttgtaagatcttcataatcatttaagagatcagctacttaccctattccagagggtttaatacagaaaagtctctcatttcttagctcttctaagcagctagctgtcctttctctcattggagttggagctcctggctgttttggttcattctcaccatgctttgctctatcttctcccacccatcgaccctcatccactcctgctgccactcagctgtgaagtcgatccaagaagcagcacctggtggagggtgaggtccatgggcaaacctcctggtggtgtgaagacggggctggagtcaacaggctggggcgggggaaaagaacacagacgggaacaaatccgtccatcacctggcgggaaactttatcccaacatggtcaactcctgcgaggaatcagggagcatatggggacgctgagcttattgtccatcagttactttgaattggatcgggtccgctgcggccagtgatggtgaccccttattcggctgtggggccc

SEQ ID NO: 688513 - DNA, 3987 bp, Homo sapiens
  misc_feature (3451)..(3451): n is a, c, g, or t
  misc_feature (3459)..(3459): n is a, c, g, or t
  misc_feature (3463)..(3463): n is a, c, g, or t
  misc_feature (3550)..(3550): n is a, c, g, or t
  misc_feature (3553)..(3554): n is a, c, g, or t
  misc_feature (3557)..(3557): n is a, c, g, or t
  misc_feature (3559)..(3559): n is a, c, g, or t
  misc_feature (3561)..(3561): n is a, c, g, or t
  misc_feature (3566)..(3566): n is a, c, g, or t
  misc_feature (3579)..(3580): n is a, c, g, or t
  misc_feature (3582)..(3582): n is a, c, g, or t
  misc_feature (3585)..(3585): n is a, c, g, or t
  misc_feature (3590)..(3590): n is a, c, g, or t
  misc_feature (3594)..(3594): n is a, c, g, or t
  misc_feature (3597)..(3597): n is a, c, g, or t
  misc_feature (3602)..(3602): n is a, c, g, or t
  misc_feature (3612)..(3613): n is a, c, g, or t
  misc_feature (3616)..(3616): n is a, c, g, or t
  misc_feature (3639)..(3639): n is a, c, g, or t
  misc_feature (3644)..(3644): n is a, c, g, or t
  misc_feature (3648)..(3648): n is a, c, g, or t
  misc_feature (3652)..(3652): n is a, c, g, or t
  misc_feature (3655)..(3655): n is a, c, g, or t
  misc_feature (3659)..(3660): n is a, c, g, or t
  misc_feature (3664)..(3664): n is a, c, g, or t
  misc_feature (3670)..(3670): n is a, c, g, or t
  misc_feature (3672)..(3672): n is a, c, g, or t
cgaggctccgtgccccgccccccgggtgccccgcccctttgcgcggctggcgcggccagccggccaggctcccctcggcaaacctgtctaattggggcggggagcggagcttcctcctctgagggccgtgccgcgctgccagatttgttcttccgcccctgcctccgcggctcggaggcgagcggaaggtgccccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcataggaagaacagatgaggcagtggagtgcactgaagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaatttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgtatagaacaggctgaaatttcttgtcataagattatgaaaccacatgagaagtgatnaaatgttngttnaagctagatagaggttaagaatcaagatataatggataattttcatagctgccgtatcagaatttcccaaatatttagcatcttccntgnnaanangnatttncttcttgaatttnncnggnctaangganaanactcntatctttggnnctncctaaaattggttaaaaatgcanttggnttancaanganaaannctgnattagnanttttaaagagttcccaaaaaaatccccagccctcaaggcggcaattgttgaattttccaaaactttaaattggcccactttttttaccacggtgttaaaagtggaggagagaaaaaaacttccacattttcttagggaaattttccccggtgtcctaccgggcctttcaaaaaaacttttgcccctttttcctttttatcccaaccaaaaattttttcaaaaattttttccaagctatccccccccctataaaaggtttttttatctgcaccaaggggatttttcccagaattcaggggggttccactttaaaaa

SEQ ID NO: 688514 - DNA, 566 bp, Homo sapiens
ggtctgtctagtggagagatccttgctgccgatcccttcgccatccttcaccgcacgcagaccccattcaagttctagtcatgcgtgagatgcatctccatccacgttggccaggctggtgtccagaataaggcaatgcctgctgggagctctactgcctggaacacaggacatccagcccgatggccagattgccaatgtgacaagaccattgggggacggagatgattccttcaacaccttcttcagtgaaacagggtgctggcaagcatagtgccccggagcagtgtcatgtagacttggaacccacagatcattgatgaagtatcgcactggcacattaccgacagctctatccaccactgagcaactcatcaacaggcaaggacagatgctgccaataaactatgcccgaggagcacgtacacacagttggccaaggagatcactagacctcgatgtagagaccgaattcgcaagcctggctgaccagtgcaaccggatcttcaaggcattctagagaaaccacagctataggtggagggaactggtatcctgaggttcac

SEQ ID NO: 688515 - DNA, 245 bp, Homo sapiens
catctgcgctgtctgcctctgctgcttgtctgcctctgcctctctgcttgtctgcgctgcttgtctgcctctgcttgtactgcctctgcttgtactgcctctgctccttgagaggcccctgggcagcagggattacaggtgcacagcaccgcgcccagctaattttttcgtatttttagtacagacggggtttcaccatgatggccaagctggttttgaactcctgacctcaagtgatccacccg

SEQ ID NO: 688516 - DNA, 4716 bp, Homo sapiens
  misc_feature (683)..(683): n is a, c, g, or t
  misc_feature (691)..(691): n is a, c, g, or t
  misc_feature (693)..(693): n is a, c, g, or t
  misc_feature (4180)..(4180): n is a, c, g, or t
  misc_feature (4188)..(4188): n is a, c, g, or t
  misc_feature (4192)..(4192): n is a, c, g, or t
  misc_feature (4279)..(4279): n is a, c, g, or t
  misc_feature (4282)..(4283): n is a, c, g, or t
  misc_feature (4286)..(4286): n is a, c, g, or t
  misc_feature (4288)..(4288): n is a, c, g, or t
  misc_feature (4290)..(4290): n is a, c, g, or t
  misc_feature (4295)..(4295): n is a, c, g, or t
  misc_feature (4308)..(4309): n is a, c, g, or t
  misc_feature (4311)..(4311): n is a, c, g, or t
  misc_feature (4314)..(4314): n is a, c, g, or t
  misc_feature (4319)..(4319): n is a, c, g, or t
  misc_feature (4323)..(4323): n is a, c, g, or t
  misc_feature (4326)..(4326): n is a, c, g, or t
  misc_feature (4331)..(4331): n is a, c, g, or t
  misc_feature (4341)..(4342): n is a, c, g, or t
  misc_feature (4345)..(4345): n is a, c, g, or t
  misc_feature (4368)..(4368): n is a, c, g, or t
  misc_feature (4373)..(4373): n is a, c, g, or t
  misc_feature (4377)..(4377): n is a, c, g, or t
  misc_feature (4381)..(4381): n is a, c, g, or t
  misc_feature (4384)..(4384): n is a, c, g, or t
  misc_feature (4388)..(4389): n is a, c, g, or t
  misc_feature (4393)..(4393): n is a, c, g, or t
  misc_feature (4399)..(4399): n is a, c, g, or t
  misc_feature (4401)..(4401): n is a, c, g, or t
ttttttttttttccagtaaagactagaagattttatttccataattggcacatgcaggtaacagatcctcagaaaatatttgtacagtaattgaggacaaaacaggaaggcacctgaagcggttgggaaaggcttgccaagtcaaactgagtatgaaacggcacttgtatgtgtaagggtaatagcatttactgagtcatctacgatgtgccagttaccgagttaagtgcttcacatacatcaactcctttaattctggcaacaactctatataaactgtattgtcagtcctgtgttaatagatgaggcagagaaattaagaaacttattcaagctcctaacacttgaatcgagcagatctttcatgctcttagccatctcactgcagtctgaattcttaacttatgctagagtgaagtttaatgactgcttgtgctagaatgtggtggagactgtatggcgcacctacctcgccaacatgtataagaatataggtatccaaattactggtcagaaaatcctgcggccttgggtgatgaaaagctaatggcaacagaaattgggccaggaagcctcgtgtagggaactacctgactggtcacattttcgtaagttacttcctttttgtcccaaacgaagccatagttttcaaagggataatgggccctggatgttgctaagantggcagananagctcaggtgtcgtccactccggatcattccagggaaaggcatcctctacagggttgcctgctttgatgacggagattgcgggcggcagtctgacgcggtgtaaaccagatgattcctgctgtctaattggggcggggagcggagcttcctcctctgagggccgtgccgcgctgccagatttgttcttccgcccctgcctccgcggctcggaggcgagcggaaggtgccccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcataggaagaacagatgaggcagtggagtgcactgaagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaatttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgtatagaacaggctgaaatttcttgtcataagattatgaaaccacatgagaagtgatnaaatgttngttnaagctagatagaggttaagaatcaagatataatggataattttcatagctgccgtatcagaatttcccaaatatttagcatcttccntgnnaanangnatttncttcttgaatttnncnggnctaangganaanactcntatctttggnnctncctaaaattggttaaaaatgcanttggnttancaanganaaannctgnattagnanttttaaagagttcccaaaaaaatccccagccctcaaggcggcaattgttgaattttccaaaactttaaattggcccactttttttaccacggtgttaaaagtggaggagagaaaaaaacttccacattttcttagggaaattttccccggtgtcctaccgggcctttcaaaaaaacttttgcccctttttcctttttatcccaaccaaaaattttttcaaaaattttttccaagctatccccccccctataaaaggtttttttatctgcaccaaggggatttttcccagaattcaggggggttccactttaaaaa

SEQ ID NO: 688517 - DNA, 373 bp, Homo sapiens
tggccccttcctaggtctttgggggttcgacctttcctggggcttttacaaatttgccccggaattatttaaccaccggctcatttccttagggggcttgtttttggggatgaattgtttttttccccccaaattcctgttgtggaaggctcccccccccttttgttgtttttgggcgttgggcctttggggggttgttgggttttgggggttgggcccccggggacttttacgccctttcccccatttggggtttttgttgggaggttgtttttgggggagcttgccctttcccccccccaccttttcccgcccctttattttgggtgtttattgcctcccggactttggggaattaaccctttttttttta

SEQ ID NO: 688518 - DNA, 4683 bp, Homo sapiens
  misc_feature (683)..(683): n is a, c, g, or t
  misc_feature (691)..(691): n is a, c, g, or t
  misc_feature (693)..(693): n is a, c, g, or t
  misc_feature (4147)..(4147): n is a, c, g, or t
  misc_feature (4155)..(4155): n is a, c, g, or t
  misc_feature (4159)..(4159): n is a, c, g, or t
  misc_feature (4246)..(4246): n is a, c, g, or t
  misc_feature (4249)..(4250): n is a, c, g, or t
  misc_feature (4253)..(4253): n is a, c, g, or t
  misc_feature (4255)..(4255): n is a, c, g, or t
  misc_feature (4257)..(4257): n is a, c, g, or t
  misc_feature (4262)..(4262): n is a, c, g, or t
  misc_feature (4275)..(4276): n is a, c, g, or t
  misc_feature (4278)..(4278): n is a, c, g, or t
  misc_feature (4281)..(4281): n is a, c, g, or t
  misc_feature (4286)..(4286): n is a, c, g, or t
  misc_feature (4290)..(4290): n is a, c, g, or t
  misc_feature (4293)..(4293): n is a, c, g, or t
  misc_feature (4298)..(4298): n is a, c, g, or t
  misc_feature (4308)..(4309): n is a, c, g, or t
  misc_feature (4312)..(4312): n is a, c, g, or t
  misc_feature (4335)..(4335): n is a, c, g, or t
  misc_feature (4340)..(4340): n is a, c, g, or t
  misc_feature (4344)..(4344): n is a, c, g, or t
  misc_feature (4348)..(4348): n is a, c, g, or t
  misc_feature (4351)..(4351): n is a, c, g, or t
  misc_feature (4355)..(4356): n is a, c, g, or t
  misc_feature (4360)..(4360): n is a, c, g, or t
  misc_feature (4366)..(4366): n is a, c, g, or t
  misc_feature (4368)..(4368): n is a, c, g, or t
ttttttttttttccagtaaagactagaagattttatttccataattggcacatgcaggtaacagatcctcagaaaatatttgtacagtaattgaggacaaaacaggaaggcacctgaagcggttgggaaaggcttgccaagtcaaactgagtatgaaacggcacttgtatgtgtaagggtaatagcatttactgagtcatctacgatgtgccagttaccgagttaagtgcttcacatacatcaactcctttaattctggcaacaactctatataaactgtattgtcagtcctgtgttaatagatgaggcagagaaattaagaaacttattcaagctcctaacacttgaatcgagcagatctttcatgctcttagccatctcactgcagtctgaattcttaacttatgctagagtgaagtttaatgactgcttgtgctagaatgtggtggagactgtatggcgcacctacctcgccaacatgtataagaatataggtatccaaattactggtcagaaaatcctgcggccttgggtgatgaaaagctaatggcaacagaaattgggccaggaagcctcgtgtagggaactacctgactggtcacattttcgtaagttacttcctttttgtcccaaacgaagccatagttttcaaagggataatgggccctggatgttgctaagantggcagananagctcaggtgtcgtccactccggatcattccagggaaaggcatcctctacagggttgcctgctttgatgacggagattgcgggcggcagtctgacgcggtgtaaaccagatgattcctgctgtctaattggggcggggagcggagcttcctcctctgagggccgtgccgcgctgccagatttgttcttccgcccctgcctccgcggctcggaggcgagcggaaggtgccccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcatagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaatttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgtatagaacaggctgaaatttcttgtcataagattatgaaaccacatgagaagtgatnaaatgttngttnaagctagatagaggttaagaatcaagatataatggataattttcatagctgccgtatcagaatttcccaaatatttagcatcttccntgnnaanangnatttncttcttgaatttnncnggnctaangganaanactcntatctttggnnctncctaaaattggttaaaaatgcanttggnttancaanganaaannctgnattagnanttttaaagagttcccaaaaaaatccccagccctcaaggcggcaattgttgaattttccaaaactttaaattggcccactttttttaccacggtgttaaaagtggaggagagaaaaaaacttccacattttcttagggaaattttccccggtgtcctaccgggcctttcaaaaaaacttttgcccctttttcctttttatcccaaccaaaaattttttcaaaaattttttccaagctatccccccccctataaaaggtttttttatctgcaccaaggggatttttcccagaattcaggggggttccactttaaaaa

SEQ ID NO: 688519 - DNA, 3268 bp, Homo sapiens
  misc_feature (683)..(683): n is a, c, g, or t
  misc_feature (691)..(691): n is a, c, g, or t
  misc_feature (693)..(693): n is a, c, g, or t
  misc_feature (3171)..(3171): n is a, c, g, or t
ttttttttttttccagtaaagactagaagattttatttccataattggcacatgcaggtaacagatcctcagaaaatatttgtacagtaattgaggacaaaacaggaaggcacctgaagcggttgggaaaggcttgccaagtcaaactgagtatgaaacggcacttgtatgtgtaagggtaatagcatttactgagtcatctacgatgtgccagttaccgagttaagtgcttcacatacatcaactcctttaattctggcaacaactctatataaactgtattgtcagtcctgtgttaatagatgaggcagagaaattaagaaacttattcaagctcctaacacttgaatcgagcagatctttcatgctcttagccatctcactgcagtctgaattcttaacttatgctagagtgaagtttaatgactgcttgtgctagaatgtggtggagactgtatggcgcacctacctcgccaacatgtataagaatataggtatccaaattactggtcagaaaatcctgcggccttgggtgatgaaaagctaatggcaacagaaattgggccaggaagcctcgtgtagggaactacctgactggtcacattttcgtaagttacttcctttttgtcccaaacgaagccatagttttcaaagggataatgggccctggatgttgctaagantggcagananagctcaggtgtcgtccactccggatcattccagggaaaggcatcctctacagggttgcctgctttgatgacggagattgcgggcggcagtctgacgcggtgtaaaccagatgattcctgctgtctaattggggcggggagcggagcttcctcctctgagggccgtgccgcgctgccagatttgttcttccgcccctgcctccgcggctcggaggcgagcggaaggtgccccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcataggaagaacagatgaggcagtggagtgcactgaagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggttactaccttttctgtttatagctactaatggaaaactttatgaaactggaaacttattttggcatagaccatagatatgctgccttattattaaagtagagataaccagtctacagaaggtcctatcagtgaccctttttatatntctgtttccgatggtgaccagaggactttaattgtgtgcttaccctccagaatgctaaaaaattagtaccagagtatattcttttttctttttttag

SEQ ID NO: 688520 - DNA, 222 bp, Homo sapiens
ttgactgattgagcctctcgggattcccttctccgtgtcatctacgcctattgttttgagaagccactctgccgtccgagcgagctagccattctagccttgtatcaacgggttattatgtgacttgctcaagcccaatctgggactgcgaaaacggccacatttgccatatcgtattctgcggcataatcgaattacagtctaaaagcctaccctaggcct

SEQ ID NO: 688521 - DNA, 526 bp, Homo sapiens
  misc_feature (367)..(367): n is a, c, g, or t
tggaccccggggaaccttaatggggggacataaacaggggggggcccccaaggcccccccccttttaagggggtcaaattggaacgttggtgagggggggagaatccagtgggtgggggggagacgtgaggtggtggagagggaactcccccaggcagtgggagggttctctctcttcaccgtcgtgggtgcctctgggcgggggccaggtggggggccccgagggcgctctaacactccttttgggagcgccattgttggggccgagtgaaggttccaccacccttgtttcgttgttcgccaaaatcgctgtgtggtcaaaacccaggagaaaactgagagcgtcttagaacaaacgtgtggtgtnctgtagagagggcgacaaatgcgccacgcccccattggggggtaaaaaagtggttggcgacagagaatgtgggtgttgcacgcgctgtgatagagaaatcatacagagaggagagagaccccactctggggtggctaccaggtggttagccccaacgag

SEQ ID NO: 688522 - DNA, 2673 bp, Homo sapiens
  misc_feature (2137)..(2137): n is a, c, g, or t
  misc_feature (2145)..(2145): n is a, c, g, or t
  misc_feature (2149)..(2149): n is a, c, g, or t
  misc_feature (2236)..(2236): n is a, c, g, or t
  misc_feature (2239)..(2240): n is a, c, g, or t
  misc_feature (2243)..(2243): n is a, c, g, or t
  misc_feature (2245)..(2245): n is a, c, g, or t
  misc_feature (2247)..(2247): n is a, c, g, or t
  misc_feature (2252)..(2252): n is a, c, g, or t
  misc_feature (2265)..(2266): n is a, c, g, or t
  misc_feature (2268)..(2268): n is a, c, g, or t
  misc_feature (2271)..(2271): n is a, c, g, or t
  misc_feature (2276)..(2276): n is a, c, g, or t
  misc_feature (2280)..(2280): n is a, c, g, or t
  misc_feature (2283)..(2283): n is a, c, g, or t
  misc_feature (2288)..(2288): n is a, c, g, or t
  misc_feature (2298)..(2299): n is a, c, g, or t
  misc_feature (2302)..(2302): n is a, c, g, or t
  misc_feature (2325)..(2325): n is a, c, g, or t
  misc_feature (2330)..(2330): n is a, c, g, or t
  misc_feature (2334)..(2334): n is a, c, g, or t
  misc_feature (2338)..(2338): n is a, c, g, or t
  misc_feature (2341)..(2341): n is a, c, g, or t
  misc_feature (2345)..(2346): n is a, c, g, or t
  misc_feature (2350)..(2350): n is a, c, g, or t
  misc_feature (2356)..(2356): n is a, c, g, or t
  misc_feature (2358)..(2358): n is a, c, g, or t
gtcatgtgagaggcagaggagaaaatgaagcttattggtgtatacagaagtcccatgtggcaagtgtttgcttttctaacattttctttttaaaaaattatttttattggatattgacaagttataattgtatgtatttatgggatacaaagatatgctatgatgtacgtattcaatgtggaatgattgaatcaagataattccacatatcacctcaaatacttatcttttttcctaactgaaacattgtaccctgtgactaacagtccccacgctgtccccacccccccccagcctctggtaaccaccattctgctgggtgcttctctgagttcatttttattagcatccacatataagtgagaacatacagtatttgcctttctgtgcctggcttaacttctttttctatttttaaggtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaatttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgtatagaacaggctgaaatttcttgtcataagattatgaaaccacatgagaagtgatnaaatgttngttnaagctagatagaggttaagaatcaagatataatggataattttcatagctgccgtatcagaatttcccaaatatttagcatcttccntgnnaanangnatttncttcttgaatttnncnggnctaangganaanactcntatctttggnnctncctaaaattggttaaaaatgcanttggnttancaanganaaannctgnattagnanttttaaagagttcccaaaaaaatccccagccctcaaggcggcaattgttgaattttccaaaactttaaattggcccactttttttaccacggtgttaaaagtggaggagagaaaaaaacttccacattttcttagggaaattttccccggtgtcctaccgggcctttcaaaaaaacttttgcccctttttcctttttatcccaaccaaaaattttttcaaaaattttttccaagctatccccccccctataaaaggtttttttatctgcaccaaggggatttttcccagaattcaggggggttccactttaaaaa

SEQ ID NO: 688523 - DNA, 165 bp, Homo sapiens
gagaattgcttggacctgggaggcagacgttgcagtgagtcaagatcacgccattgcactccagcctgggtgacgagcgaaactctgtctcaaacaaacaaacaagctcctggacgtaggcctggggtttgatttctgactctgctactaattagctgtgtgact

SEQ ID NO: 688524 - DNA, 1287 bp, Homo sapiens
  misc_feature (258)..(258): n is a, c, g, or t
taaaatgggagatagggtcttaaactctggtccaggctgggaggagtgcagtcgtcacagtcagggctcactggaagtctggaccccgttgcctcagcctcccaaataactgggggccacgagggtgtgtgcaccacaacttcttcagcttaattttataaaatttttaatagagggtggggtttaactagtgcgtttccagaacgtggctcttaaacttcctgtgggcctcaagtgtgactcccccgtgcttggtgncctcccaaacagcggggtggagaattcacgaggcagtggagcgcaccaacaaaggtgggccgtgaaaaattctttaagaggcagtgggagaggtgctcgagtgacacgagccaccttggggccaactgcgtgggtgccttaaccgtgggaagacggggaagagaagcgcacgcgccattggggagaaccgtgtgctataccacctttgggggggcccacagtgtgcgcataagggtattattatggagagcgcccatatagggcccccttttgaggataaagatgggctacctttggcccttttctttcttgagaaactggttcttgtgcagaacatggtggggcactctggggcggctacagcgggttctgtgaacgcgaatatcaattataagtccaccccttcacaatttaacgaattttatacttccagtcctttactggggggcctgcaaccctccagagaattaccaaaggaaaaaacgccaatgtgtctggtggcccaaaagaagagtccccacaaccccaaggtcgtgttggcaccattggtacagtgggagcggccccattgtggcgtgcacgtgaacctgcatcgttggttcgtggtccccccaatgggccaaagggctcactcaaaggaacactccatcacattgggcaacaagagtacataacgccgacaacaagacacaagcgaaaggtctagcgaaaatgacgccatcctgtgcaggcggggtggaacatcccagaggtgtgagtggtacacgcacaatatcaccaggtgaaagttgtgcgcaatacaacaggacagggtggaggaaatgagacactcaaaacagcgaactacagagccagcccccgccccacgagtcaaactctggagtaggtgtcatcaaatactcaaagcaggcacaacagaggaagcgagttagagcaggtgcagaaaacacctggtgagaacaaaaaacggcaccatcagtagaaaaaaaggcgggcggctgaactaactaggagacgaccacacacgat

SEQ ID NO: 688525 - DNA, 2321 bp, Homo sapiens
  misc_feature (38)..(38): n is a, c, g, or t
  misc_feature (1785)..(1785): n is a, c, g, or t
  misc_feature (1793)..(1793): n is a, c, g, or t
  misc_feature (1797)..(1797): n is a, c, g, or t
  misc_feature (1884)..(1884): n is a, c, g, or t
  misc_feature (1887)..(1888): n is a, c, g, or t
  misc_feature (1891)..(1891): n is a, c, g, or t
  misc_feature (1893)..(1893): n is a, c, g, or t
  misc_feature (1895)..(1895): n is a, c, g, or t
  misc_feature (1900)..(1900): n is a, c, g, or t
  misc_feature (1913)..(1914): n is a, c, g, or t
  misc_feature (1916)..(1916): n is a, c, g, or t
  misc_feature (1919)..(1919): n is a, c, g, or t
  misc_feature (1924)..(1924): n is a, c, g, or t
  misc_feature (1928)..(1928): n is a, c, g, or t
  misc_feature (1931)..(1931): n is a, c, g, or t
  misc_feature (1936)..(1936): n is a, c, g, or t
  misc_feature (1946)..(1947): n is a, c, g, or t
  misc_feature (1950)..(1950): n is a, c, g, or t
  misc_feature (1973)..(1973): n is a, c, g, or t
  misc_feature (1978)..(1978): n is a, c, g, or t
  misc_feature (1982)..(1982): n is a, c, g, or t
  misc_feature (1986)..(1986): n is a, c, g, or t
  misc_feature (1989)..(1989): n is a, c, g, or t
  misc_feature (1993)..(1994): n is a, c, g, or t
  misc_feature (1998)..(1998): n is a, c, g, or t
  misc_feature (2004)..(2004): n is a, c, g, or t
  misc_feature (2006)..(2006): n is a, c, g, or t
atagctcactgctcctgggcatcaagcgatcctcctgnctcagccttctgagtcgctgggattacaggtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaatttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgtatagaacaggctgaaatttcttgtcataagattatgaaaccacatgagaagtgatnaaatgttngttnaagctagatagaggttaagaatcaagatataatggataattttcatagctgccgtatcagaatttcccaaatatttagcatcttccntgnnaanangnatttncttcttgaatttnncnggnctaangganaanactcntatctttggnnctncctaaaattggttaaaaatgcanttggnttancaanganaaannctgnattagnanttttaaagagttcccaaaaaaatccccagccctcaaggcggcaattgttgaattttccaaaactttaaattggcccactttttttaccacggtgttaaaagtggaggagagaaaaaaacttccacattttcttagggaaattttccccggtgtcctaccgggcctttcaaaaaaacttttgcccctttttcctttttatcccaaccaaaaattttttcaaaaattttttccaagctatccccccccctataaaaggtttttttatctgcaccaaggggatttttcccagaattcaggggggttccactttaaaaa

SEQ ID NO: 688526 - DNA, 867 bp, Homo sapiens
  misc_feature (38)..(38): n is a, c, g, or t
  misc_feature (717)..(717): n is a, c, g, or t
  misc_feature (746)..(746): n is a, c, g, or t
  misc_feature (749)..(749): n is a, c, g, or t
  misc_feature (764)..(764): n is a, c, g, or t
  misc_feature (770)..(770): n is a, c, g, or t
  misc_feature (773)..(773): n is a, c, g, or t
  misc_feature (776)..(776): n is a, c, g, or t
  misc_feature (787)..(788): n is a, c, g, or t
  misc_feature (812)..(812): n is a, c, g, or t
  misc_feature (817)..(817): n is a, c, g, or t
  misc_feature (823)..(823): n is a, c, g, or t
  misc_feature (832)..(832): n is a, c, g, or t
gggctccgcgcgcgccgggggtacgacctgtacagtgncctatgattacacaataccaccttatggagaaagctgttgtgaaaacggacattcagatagcgctcccttctgggtgttatggaagagtggctccaggtcaggctggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggtttggttccactggaaagaattaaaatttatgccaagaacagaaaacaagaagtcatacctttttcttaaaaaaaacaaaaaaagttttggcttcaagtgtttggggtgtttggcacttctgtaaacttactagctttaccttctaaaagtacggcatttttaacttttttttatgatcagaggaaaagatcattaaaaaaaaacaccaaagaagttttcctttggtggttgggatcaaaaagaaacttggttttcccgcaattgaagggttggtatgtaaatctggcttgggggtgacctgattgtaaacaggtgtcttcttaaaatcaaattgtctaattcaattacagatttaaaaaaaaaagncctggtattttaacctcatatgatctccnttnagcaacttatttggnttaatnggnttnaaatcttaagnnaatattttttatccagtaaacaanttctntcacanggtacaaantctgggcattaagtggacctaaatttaatgtcgag

SEQ ID NO: 688527 - DNA, 1320 bp, Homo sapiens
  misc_feature (38)..(38): n is a, c, g, or t
  misc_feature (717)..(717): n is a, c, g, or t
gggctccgcgcgcgccgggggtacgacctgtacagtgncctatgattacacaataccaccttatggagaaagctgttgtgaaaacggacattcagatagcgctcccttctgggtgttatggaagagtggctccaggtcaggctggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggtttggttccactggaaagaattaaaatttatgccaagaacagaaaacaagaagtcatacctttttcttaaaaaaaacaaaaaaagttttggcttcaagtgtttggggtgtttggcacttctgtaaacttactagctttaccttctaaaagtacggcatttttaacttttttttatgatcagaggaaaagatcattaaaaaaaaacaccaaagaagttttcctttggtggttgggatcaaaaagaaacttggttttcccgcaattgaagggttggtatgtaaatctggcttgggggtgacctgattgtaaacaggtgtcttcttaaaatcaaattgtctaattcaattacagatttaaaaaaaaaagncctggtattttaacctcaaaaaaaaaaaacaaaaaaaaaaaaaaaaaaaaaaaaaaaaaaaaaaaaaaaaaaaacaaaaaaaaagccaaaagagggggacaagaagaataaagacgaagagaagaaaggaagagagagagagaacagaaagagagaggcagaagcggtccaaagacacgtgccaacaaaagtgagacagagagtggaaaggggagaaaaagaaaagaggaagacataagtccgggtgagagtaaggaaccaatgaagctagaagaaagacgggaggacgaggaacatgaacaccacggagaacaaggaaaacacgagaaactatagagagagaaaaaagaccggagacagggagcaccatcaggaccacgttagatcgagaaagcatgaaaggagaagagagacaaaacaacaacaaggcagaaacgaaggaaggaggaatggtgggtgaggagaaagggaaggagggcggctgaggggaaaagagcgcaaggggagcgcgaggcgagggagaagccgccgcgatgcggacgaaggagaccaagagaggggagtggataggtaagaagagaacagagagacgaagtaggaaat

SEQ ID NO: 688528 - DNA, 125 bp, Homo sapiens
tactgaacatagagctgtctattatttggaactgacttacttacttaccttattgattgagacaggctctcactctgtagcttaggctagagtgcagtggcacgatcatggctctctggagcctc

SEQ ID NO: 688529 - DNA, 1201 bp, Homo sapiens
agcgggcgtggtccccggcactctcaccccgtcgtgcgctcgtagagttctgggaagatggcagaaggtctcaccagtctttacgtactgatcacattgaggcgaagttgcccaatgaattcgacggccatgcgctagcgatatgcgcgattatacggtaacatcattacgtatagaggctgcattgacatgaacataccagattattttagctactcacatgaacgtatagactagtgttatgctgcgaatacattgaaggtgatatgtctccaaggtctatacacattatatcttgccgttcatatgacaggaacattgatgatgactaatagatgaggaaaagtggatgagtaagagaatagttcaaggaaactagatatatgcatagaggttgtgagaagtttggaggaaggatatttaattcaatagcaataatgcattcctaatgcatggcgatgatcgcatatttggtatgcatatattgaatcgatgtgtgaatgattctgcacgtgcgtacgactagtgggtcgagcgaattgacattgagctagttgattattgatcttctcagagaagcctgatggaatagactaggcttcccttaggcgatgatcaacagaggtcaagaccgagttaatcatagcgccatgacgactcttgaagaccgagttgtgtacacagactacttgatttgagtagcctagtgagccatggcttatgagttgcattacgggattgcgtatccatacgaaagcgaatcgcaaacgtaaatctactttgcatggcctaagaaaaagccgtaaaaagaattagcccattttcgagacaaatggcgccgacggggggaacagacatggttgggaagggcccccattccgggaacgcggtgaatgtacgtatctccttgggaaatcgaacattttgtattgtcgaagaacgcatagggaaatgcccttggggggatttgacactgttggcgaaggaaaaccgtttttatcaatccaaaggttggaaaccagttgaacgttatttgcaaagagaagtgtaatggcccttatattggtttatatagaaccgggaaaccctaaaggtgaatcggagggttaaatttcggagaaaagaagacatacttttattacttggggtcagagcaagagagatgcgttggaaaaaggtttaaaaggtatattgccccgag

SEQ ID NO: 688530 - DNA, 687 bp, Homo sapiens
  misc_feature (565)..(565): n is a, c, g, or t
agcggactcgcgcccttgccgtgccaaccgagcccgtcatggagcggccgtcgctgcgcgccctgctcctcggcgccggtgggctgctgttcctgctcgtgcccctctcctcttcctcctcttcggacaccgtgcggccctgcgagctgggctccgtgcccggctgtgcctcgccggctgggactggctgcctgggcgagagccgcgacgcgtgcggggtgctgcgcctatgtgcgcccgcggccgagggcgagccgtgggggggtggcggcggccgagtgggggggatacatgcgacgccgggcatggagtgcgtgacagacgccgcgaaggaaggcggacggggtaagacgccgggggcaggccagccgtggggtcacgcggtagtaaaagccaggcgtgtcgccgtgtcgccactgaggccggatactcaggggtgcaggctgaagaccaggaaacaagactaagccggagcgggttgccaagactgccgcccgatccgccctaggctccacgaggggccctgacggaagactcggctgtggcgagcacaaggtcaatcaancccaagtgttacacggcaaaatgggggcaccctgcgaaaaccagggggttacgccttccgaattatgtagaacagccttccccccaaagggtagcactcttgggaaattgttcacttgggtc

SEQ ID NO: 688531 - DNA, 384 bp, Homo sapiens
tctctgcaggatcccctcttctccgaaaggcacatggccgccctcaagaccccttgtgaggcccgtgatcgttcaacagagaacccagaatgcttcatccggcaccagtcagaccgatctgtcagacattaaggcgtaactggcggaaacccagaggcattgaccactgggttcgtataagattcaagggccagatcttgatgccccacattggttatggaatgcaatcgcatcataacgtagcacatgctgccccgtggcttccggatgttcctggtccacaacgtcgaggagcctggaagtgctgctgatgtgcaacatatcttactgtgccgagatcgctcacgatgtcgccttgcggagaagagggtaccgagcccgaat

SEQ ID NO: 688532 - DNA, 974 bp, Homo sapiens
  misc_feature (751)..(751): n is a, c, g, or t
tccaggaggtggccaggtgcccgacgtcgtcagcgggggcgtttgatgcgacgcctggtatcgcctggtctccgccgctggggcttgcatccctcgaaccaacaccccggttcgggcctctgaggcagatcccaggtcacaccttctgctgctcccacttgaggaccgtagatggtgggacaggtccgaggtccctgtgagggcggggctcgttgtgtgtgtggcacagactggggatgcatggcacaccccactgtgcatcaaggctcccctcccatctgttagcacgtctccagcccccactatgtccctgacgccccaggggccactgccctccatgcccctagagccagtcactattgtctggagtggtgcaggctccatggaggccggtgtagccgagctgtggctccatggaccataccggagacccccctggagctcacacagcagtcctggtcctggaagatgacggacgatgtgctaatgttgcgctgattgagccggtgggtgttgggtacgctgaggcatatgatgagccactgttacctgaggggactgggggatctagtgaaggctctctctggggggtctactcatagtgggaaactttagaggtggggtaggttccgcttgaattcttcctgtcctggattaggattggtggcctccgtgggacctatgtagctgtaaaaggtaggccctaggcgggaggggggcaccagattccgctgggcgtgcaatgggggcncccaattcctaccaacgactgggcccagagccccattgggtgggtgtcaaacgaaacgctaacggggaggggggcccccccttggacttacaaaagggaaacgagggaaaatacaccccccggagtggaagaggggctgagaccacaggggcaagaagcgtacccaggcgaggaagagcaaaaagagggcagcgcgatagaagagagtcgagaaatatatgga

SEQ ID NO: 688533 - DNA, 235 bp, Homo sapiens
acgcctagcccgcccgccccaccatgtgccacagttcagcagctggaaagaagatggcgcctggtggacagcataggctttgatgactacattaaggagctaggattgggaatagctttgcgaaaaatgggcgctatggcccagccagattgtatcatcacctgtgatggtcaaaacctcaccataataactgagagcactttgaaaacgacacagttttcttgtaccctgggag

SEQ ID NO: 688534 - DNA, 700 bp, Homo sapiens
  misc_feature (155)..(155): n is a, c, g, or t
ctaagttgggagctccccgtaagcccatcaggtaaggcccccattgggcatttaattgcataacgaatttttacggggagggccaagagggagcccctgtctaaaatatggtctcaaaataaaaaccaaatgggccacaccatgtgaaggaaatncactttcgtcatctctcatgaaacacagtaaccggaccttgttacaaggttccataaatagaaagcccctgttattgattatgtcacagcttttgtaggtcacgacctttcagactcataagatatgtgtcttctgtgataccagaatgggtggattggataaggccataacaactcgtcttataattttcttcagtgtaatagtcatacttccagatgtcgaaagtcacaggtgtcttttatatgcatagtcgctatgtcccattctttcagcaggtccgggtgtgctgcctcaagcttgtaatcccagcagttcaggagtctcaggcaggtggatcttttcaggtcggaagtttacatcccttgtggcccacagggtaaatccccgtctataattaacagctgataatctgcccagtgtggtgccggctccctgtaatcacagctattcagttggctgaggcgctagaatcctttcatcctcggaggtggaggttatagttagtctggatcgtgttactgcacccagcctaggtgacatagca

SEQ ID NO: 688535 - DNA, 1255 bp, Homo sapiens
  misc_feature (1155)..(1155): n is a, c, g, or t
gcggccgtccggacgcgcgggaacacccgggcgtgatggagtctgcagtcgggtccgggaagccgcgcggtgatgggggaggccttcacttgagggggattaggtacagcagggggtcgtgccaagtattcccctgagacgatgggctcagcgtgtgcatagaacgaccggtgcattgagctcctcggacgcatggaagaagcccgctcaaggctagctccctaagggacgacttgtgacccgggcctgtcttagggtccactgcgccaggtcgcatatgatggtgctctgacagtagcatgacgagtggcgtgggccctgcgggaggccgtggggtcgcggccgaatgcaaggcggatgcgcgcagagggggagatgcggatcgaatttggctgccctctagctggggccctggggtaggtcgttaactgagccccctttggggtggcgccttgtggggcttgtccgggctcccatggacttcgcggttcagactttgcttggagagtcggtgggaagaataagggcgggtacgtagagaccggccagtatcgctctggaaggaattaattgccaaaaccgctaaaaagtggttccccaatggggagacgctctgggttgtcaaagaaacaatttttagcttcaagacagtagtggtttaggggcacctttctgtcgacgttcgggatagacgacaagcgaggaagcgacggaaagcaaggcgttatgagttaagtcgtggccaattggtctccccagatttggtccattggccccttggggaagcatgccacggcacaaggggtgactgaacccccaaggtgccatgtgtggggaggagagcttggggaatttccttccgccaaagtaaaagcgctgggttttctctttcccctttggtgggaagcggtgggaacccctccagtttggggggtttcccccgagaaagaatacgctttttttccccaattcgacacagggcgaatacaaaattgtaacctcacagaggcttttgggtttccccaacgttcccaagagttaagagaaagcccctttgggccaaaaaaggggcataaaagagagcgcctccccctctctttcaagaagaagggggttggacatccttctgtgggggaccgcagataagcttacgtnacattttttgcccggggttggtgggcctttttttaaaccgtttccaaatgtgtcttttcgccacaaggggaaagcttttcctttggaaatttcacccttg

SEQ ID NO: 688536 - DNA, 245 bp, Homo sapiens
gttttgggggggaattttgttccgtttggatttatttttttgaaaaggaaattccctgtttcgtgggttggcaataattttttgtttttttttcgggggaaaacggcaagctggttaggaggttttggggatttgcccttcctaaaaatttttttaacccttgattttttttcttggaaaggggggggccccataaacatattttggggaaagggatccccaaaaaaggggtttccttcctgcca

SEQ ID NO: 688537 - DNA, 1040 bp, Homo sapiens
  misc_feature (424)..(424): n is a, c, g, or t
caggagaggctgggtgttactcggacgaggtgttgatcttgaagaaactgggcgtgtttaagtattggtgatggtattgccgcgtacatgggctgaggaatgtcaaggagaagaaatggtagagttttcttcaggcttaaagggtatgtccttgaacttggaacctgacaatgttggtgtagtcgtgttggaaatgataaataattaaggaaggagatagtgaagaggacaggagccatcgtgggcgttccagttgggtgaggagctgtttgggtcgtgtagttgatggcccttgggtaaatgctattgattggaaagggtcccaatttggttccaaagacgcgtaaggcgaggttggtcctggaaagccccggctatccattcctccgaatttccagtgcggtgaaccacatgcaggactggncattacaggctggtggataggcttcgggtgcccaatatggtccgtggctcagccgtgacactgatttatttggtgaaccacagacctggtgaaaacgctcaaatttggtatttgacaccaatcattaaaccacgaaactgtttccaatgcatggactctgcatgcaccacgaagaaagctgtacctgtcatttactgtctgcctatttgggtcaacagaagattccactgtttgccccagattggttgaaggagaacttacagaatgccgatgccatgaagtacaccattgtggtgtcggctacggctccggatgctggcccacttcagtacctggtccttactctggtgtcccatggggagcgtattttcgagacatggcaacatgcttgtcatctattagggttttcccacggctgtgctacggcaggtgctctgtgtcgcgaccctggtcgtgggcttctgggagtgtctactcccccggtggggggggccatgacgtgttggggggccttacggtgcgctaaccgtcgcgtctggcccccctgtccctgcggggcttgcgatttcgtcccccgtcttccgcgcccgcgcgccctcttgggtcccccacttgc

SEQ ID NO: 688538 - DNA, 294 bp, Homo sapiens
ctccattgggaagaggaaacgaggcttagagcagatacttggtaaactaatgtggctaataaatggcatgtggcggggcaaactcatgtgtgcctgactccaaagtctttcccacgatgctggaaccttccacattttttccttagagcccttcccaacctgccatagctctgatggtatgtcagagctgagcctgacataccagggccagctgagccttctcgctccctctcgcctgacacggcactgctgctgtgtgctgtgccaagctggatcaccattccgtccggggta

SEQ ID NO: 688539 - DNA, 382 bp, Homo sapiens
cggcacgagggatatccaaacgcgcattcttcaccaagacctgaggcacagacacctggtgagtgaggcttcaagggagatgctctttgtcctgggagagagccctctcccctctcttccaccatctcctgctcggacagaaaccgtacctgcagcaaggcatacctcctgccaactcctggtgaaaagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgcaaaaaaaaa

SEQ ID NO: 688540 - DNA, 595 bp, Homo sapiens
gggtgggaaggacgtccacccaaccgaattaagttgtttgaggtgacccgggctgtaggtagccgtgagtcagaggtaatctaagttggggctcgcgtaaggtgagggcagcttaggttggggtgggagggttgtgagagctaagagagtgaggtagcaaaggcgctttgtaagttcattggatggtgccggcaggcagacatcaagctggtggggctggtaggttatttgtgggtgcgtgcgccccccgtgtagcgttcctccgagcgcaagcaatagtagcgctgccccacaacactggtcgtggtattatatagaaaagtatcatcatcactagcacgtcacagtgtcgccgccgtttcattctacagcagcagcatcgtggtggtagagaagagaatatatgtcatgttggtgtggtgtggtaatatcatggtctcgtgagatcatttgatgcacgtattctcgcgcgtgtgtgtaggtacaccgccgcgcgtggggatatatatgtgtgtatgtgtgtgtatctcttaagaatataccgtgtgttcgcgcccgtgtgtatacaatagatacaaaaaatactacaacagaa

SEQ ID NO: 688541 - DNA, 395 bp, Homo sapiens
  misc_feature (315)..(315): n is a, c, g, or t
  misc_feature (347)..(347): n is a, c, g, or t
  misc_feature (366)..(366): n is a, c, g, or t
  misc_feature (372)..(372): n is a, c, g, or t
gtgaccaaaaaaatggatcttagtgtcagagtaaacttcagtttgctagttaggaattgttaatatctgtcatgtttatatatttttttcaatattcccaataagaataggactctcatgtttatatagaacagaatcaattttatgaaatacatgaaaattctatgaaatatgtagaaaaatctcttaggaaaaaaatcagttttattattgaaatctcaaggccaatacttcagtgtaaactctgacgctacagttttctttggggtttctttcccaggaataagccctcaacatgtgttggctgcatgagtngggagagtgaggggccgggtccaacatctganggggagggtgctgctgggncccctnggctggccagcacaggtcccttt

SEQ ID NO: 688542 - DNA, 84 bp, Homo sapiens
ctagaagattcagcaaagtacttttgtgctcttggggaaccgacgtactgggggataggctcctgggacacccgacagatgttt

SEQ ID NO: 688543 - DNA, 262 bp, Homo sapiens
ccccaaaacctttgggtttttttttccccaaaaaaaaaccccccaagggggggcccccccgggccccgtttttttaaaccccgccggggcccggggcccaaaaattaaaggtttccccccctttgggaaaaatttcccccgttctggggttaagggcccagggccccccccccccggcttttttaaaaaataaattagggggttcccccctttttttttttttacggggggggttttaaacccggcccccccccccatttta

SEQ ID NO: 688544 - DNA, 416 bp, Homo sapiens
  misc_feature (416)..(416): n is a, c, g, or t
tggatgtagagaggctgtaactgtccaagctatacttatggcgtgatcgccctgctgactgtcggcaccgccctactgctgacagagacgaggcatgcacagctgccacagaccatccatgacgtggagagatagagtgcccctaccagtcttcatgagggagagatagcccatgaagcatgttcagaactaagtgggagtggaggctggccctccacagaagctctgcagcatatgctgggagagcagaatggcacgccctgcaactcaagctgggagtatcgaaccctctggctagggacggagtagctgtcacaacccgctctctctgctcatacatccttgagtattaggcttataggaacacgtgacgttccagtgcggactgctgggcacccctctcacggacggagggn

SEQ ID NO: 688545 - DNA, 275 bp, Homo sapiens
  misc_feature (4)..(4): n is a, c, g, or t
  misc_feature (10)..(10): n is a, c, g, or t
  misc_feature (55)..(55): n is a, c, g, or t
  misc_feature (57)..(57): n is a, c, g, or t
  misc_feature (72)..(72): n is a, c, g, or t
  misc_feature (82)..(82): n is a, c, g, or t
  misc_feature (86)..(86): n is a, c, g, or t
  misc_feature (101)..(101): n is a, c, g, or t
  misc_feature (105)..(105): n is a, c, g, or t
  misc_feature (136)..(136): n is a, c, g, or t
  misc_feature (148)..(148): n is a, c, g, or t
  misc_feature (164)..(164): n is a, c, g, or t
  misc_feature (234)..(234): n is a, c, g, or t
  misc_feature (242)..(242): n is a, c, g, or t
  misc_feature (271)..(271): n is a, c, g, or t
gggnccaggncgtctcccccgcagctcggctcccgcgcgctcagcaccgccagcngnactcagatgcaggcngacgagcganctcngggaggccgtgggcngccnccacggccgcggccggcctggcgcgagatcnccacaccgaccngcccggagccgcaccngccggctaaccagcaccgcgcgccgcgcgcgagagcgcgccgcgccgcggcgcacgcgcaggccgcgcancgccgccngcgcccgctcgcgcccgctgcggccgcgngcgc

SEQ ID NO: 688546 - DNA, 126 bp, Homo sapiens
agcaatttaatcaagtaatcattaattagttcccccctatatataaatatatgtaatcaatttcttcaaaaagcttgcttacatgataatcaattagccaaccccatggcctccatgactttttca

SEQ ID NO: 688547 - DNA, 267 bp, Homo sapiens
taatcccttttaagcagagatacacattcacagagagagaatgttttaaaaagacccacaaggggaagggaccaagtaagcacttttaattcattttgattacacaaaaataaggcaaactaaatgattcagaacaattcaatttaactgaagccttctagaaaaatactcaacaggcttcaacaaaaagacttagcgcacataaaacaatcacgaagatcacaatttcagcacaaatatctgaaggaatacacgcaaaacatcata

SEQ ID NO: 688548 - DNA, 207 bp, Homo sapiens
  misc_feature (48)..(48): n is a, c, g, or t
  misc_feature (117)..(117): n is a, c, g, or t
  misc_feature (119)..(119): n is a, c, g, or t
  misc_feature (125)..(125): n is a, c, g, or t
  misc_feature (159)..(159): n is a, c, g, or t
  misc_feature (171)..(171): n is a, c, g, or t
  misc_feature (187)..(187): n is a, c, g, or t
  misc_feature (203)..(203): n is a, c, g, or t
ggaaaaagaagaagaggaaataagagccagcgttagagacaagagccnggtgaaaaaggccaaagccacagccagagccaagaagccaggattcaagcacatgaggagccacgcctntngggggncacggtgcaaagatgggccttccctgggctgtgnctgcaggacagncgtgcccctgtccagncccctccacctgtgtnctga

SEQ ID NO: 688549 - DNA, 413 bp, Homo sapiens
tctagaggatctgctgatacaccaccaagaaagttagattctccaaggtcggaagtgaagacagcctgaccaagatggagaaaccccatctgtagtaaaaatagaaaaattagccgggcacgatggctcatctctgtcattccagctactcgggaaggctgaggcaggagaatcacttgaacctgggaggcggagggtgcggtgggccgagagccgccatcgtactccaccctgggcgacaagagcgaaactccgtcgtgcccacgcgtgtcatcacagcactccgggagggcgatacgggaggatctctgcgagcctaaaagttcgagatcacctcgacacgtgcagatgacgcctacacctctctgcggcttctatagcgataagatgttatggccagaccgcggaagctc

SEQ ID NO: 688550 - DNA, 219 bp, Homo sapiens
agaggattcaggagatgtcacggaggaccaggttggctatgagcagtatcttctgtgccctttgtctcaccagacccaggtccagaccaataagaaagaagggacaagggacattaaaatgaagccagagatatggacagaaacaagaggaaggagggactggaaaagacgttgagagggaacagaaaagaagtacgacaggtacgtgaaccatctccg

SEQ ID NO: 688551 - DNA, 106 bp, Homo sapiens
aatgcaggagtaagccctgagttctcctgactcagcaggaagccaagcccccctcaagtaggatatgggaaacttgtgtgctaccccatccatatacaggacatgt

SEQ ID NO: 688552 - DNA, 812 bp, Homo sapiens
  misc_feature (68)..(68): n is a, c, g, or t
  misc_feature (146)..(146): n is a, c, g, or t
  misc_feature (149)..(149): n is a, c, g, or t
  misc_feature (154)..(154): n is a, c, g, or t
  misc_feature (162)..(162): n is a, c, g, or t
  misc_feature (170)..(170): n is a, c, g, or t
  misc_feature (180)..(180): n is a, c, g, or t
  misc_feature (193)..(193): n is a, c, g, or t
  misc_feature (199)..(199): n is a, c, g, or t
  misc_feature (214)..(214): n is a, c, g, or t
  misc_feature (217)..(217): n is a, c, g, or t
  misc_feature (247)..(247): n is a, c, g, or t
  misc_feature (294)..(294): n is a, c, g, or t
  misc_feature (299)..(299): n is a, c, g, or t
  misc_feature (344)..(344): n is a, c, g, or t
  misc_feature (353)..(353): n is a, c, g, or t
  misc_feature (359)..(359): n is a, c, g, or t
  misc_feature (681)..(681): n is a, c, g, or t
gagaaactgggagagggaggaagggagaaagtgagaagggaaatcggaaagagaaaagggaggaaacnggcagagccagagagaaagaggaagagactgagtgtgaaggagagaggacacaggggatgactgagagacagagagangangagangagagaantgagacangagacttaanggaaagagacccntgtgangtctgacaataaaangantttggacagaacacagacaacgacttggangacgagagagagagggagagaagtgagtgagagacgagactggacangagancagagactcagacgggagaccacagaagacgtgacgatcgtgggngacgacgangggtanggtgtaaacaagggacacgacgacgacgacgacgacgacgaccgcgtaagacgacagggagacgcaaagacgaccaaaagatgtgtgatgtgacgcaggtgagcgacgacgacgagttgagacatctagtgacgacgaccacgcacgtctaacgacggaccaaagggagggcgggacgacctgcctagtgtgccgcagcacccacagcgtcctcttgcccccccgtcactgggaccccagagctggcccttgatggaggggagccgatctcgcaggagctctgagcctggacagcagcgcctccatcatctcctcgctcagnagctgagcccaagaagccacccggggcagtaaacaagatccacgccttgggagagaggcatggctcaggagggatcccacttccggcaatcgaggtggtcatagcggaagtgggcccttctggaccgggtc

SEQ ID NO: 688553 - DNA, 754 bp, Homo sapiens
atcccagcacttgggaggccgaggtgggtggatcacgaggtcaggagatcgagaccaccctggctaacacagtgaaaccccgcctctactaaaaattaccaaaaatttagccaggcgtgctggcgggcgcctgtagtcccagctactcaggaggttgaggcaggaggatggcgtgaacccaggaggcggagcttgcagtgagccgagaatgcgccactgtactccagcctgggcgacagagtgagactccaatcaaaaaaaaacataaaataaaataattagaattaagatttagataaggttccataacaggtcattacggcacagttaccagatattggattacatataaggtctttagttgtactaatgaaacctcaatattccattcacaaataaattcaacctcaatattccagtgcacaattaaaactttatggaaaatatgttcgatcaggtatacctattagaaattagtccattctctaacgggcattgtacgacagttattaaaatttgaagatttacatatattggacccaagaaatgccattctaggaatttattccctctgataaaatgtacacagaaagtattttgttgagatgatattttactcgtcaagactgaaacaacgaatgtccaaaaaggagtgattaattctggagctataaacggggaggcgcgtttatgtcgttggactacagaagtcccccgtgagtagggtctatcgggagggcagaacaaagtggag

SEQ ID NO: 688554 - DNA, 304 bp, Homo sapiens
  misc_feature (2)..(2): n is a, c, g, or t
ancggggattggatcagagttaaatatttatatagtaacttgcataccgaaggttaaaattcaaaacagaaatctcactatagaatatctagtactcccagacaggaaggagacaggtgtataagggtgggggatggaattgtatagggagcgtcaagagtgagggtatgtgggggctggttaggaagaggggcaatgctcattacgaaaactttccttctctgcaggaattgtaaccgtgtaacaagctgatggtcagtgatagcattcatccaaaatggaacaacagtacaaaaagacacct

SEQ ID NO: 688555 - DNA, 303 bp, Homo sapiens
aggaattctagacattgcgtttctgtgttgcaaaatccttcggacattctcagacatctccaagttccatcacgtcagatttggagctggtagcgcttacgatgccccacgtgtgacatctgtcttggtcacagagctgggtgctgccggtcacctgagctgtggtggctccggcacagagtttccggggttcggccatgtctcagccggcagggtggagcctcacaggcaaggggctttggattcattcagtggtttcagtctctatgtaattaacagatgaatatccatgacttggataag

SEQ ID NO: 688556 - DNA, 143 bp, Homo sapiens
ggtccggctccgccctgcgtcggctgacagcttgtcgcatcactgtgccctgcgctgggtcggtggctggcgcaccctggtcggcaagctggcacaccctacagtaccccctaccctagttctcctagtgacaatccctgtct

SEQ ID NO: 688557 - DNA, 362 bp, Homo sapiens
gttgcccgcacttacttgcagactgtaatggccgatgcttacccgcatctccacgtgactgccgaaaaattgttcgtttcagggctatgtgttaaactcgccgcccctgatttgcctgactactgtatgttactttatcctgaactacgcaccattgaaggtgtcttaaaaagtaagatgagtgggttaggcatgccagtacagcagccggcaggttttggaacttactttgataaacctgctgctcattacattctgaaaccgcaatttgcagctactcttagaccggaacagattaacatcatcagcacagcctatactttttttaatgtggaacgtcattctctgttccacatggaaac

SEQ ID NO: 688558 - DNA, 291 bp, Homo sapiens
agtcatattccaatcttacaatgtagtagaaaatcaattttctttccttttaaaaatggtgttctaggctgggtgcagtgggtcacacctattatcctagcacttgaggaggccaagggaggtggatcacttgaggtgaggagtttgagaccagccctggtcaacatggtgaaatcccatctccagtaatacaaaaactaagccaggcatggtggcgcacagctgtagtcccagctactcgggagcctgaggcaggagcactgcttgaacctgggaggcacagattgcagt

SEQ ID NO: 688559 - DNA, 134 bp, Homo sapiens
catcttactacgcggctcgatctgactacgcggctgaagcacccctatgttttctccattaatttctgctcgttttggaatgggaagcatgcccaatctgtccattcctcagccattgcctccagccgcgtagt

SEQ ID NO: 688560 - DNA, 121 bp, Homo sapiens
  misc_feature (114)..(114): n is a, c, g, or t
actttattgctactccacaaacaggcgaaaggttactcggagcgtagaattatggggtactcaatgcaggagatgcatgaggtggtgtccaacgtccaggagtatcgtgagttngtggagg

SEQ ID NO: 688561 - DNA, 322 bp, Homo sapiens
  misc_feature (217)..(217): n is a, c, g, or t
  misc_feature (279)..(279): n is a, c, g, or t
tggaaaaggggtttcaccacgttggtcaggctggtctcgaactcccgacctcatgatgcgatccacccacacctcggccttccaaagtgatgcaatttacaggcatgagccactgcacccggctgatacttggggcaagtttgtggccattcagaggcatcataagcagtgtggcaaaaaaatctgagttgcctgatgtggacgttctcagctacgngaagtaagcggggttctgcctttttgtgacagtgcctacaatacacaatggtcttctttttngcagtccgtttagctccacgttgctcgcattttaagattttcg

SEQ ID NO: 688562 - DNA, 869 bp, Homo sapiens
ggttgcaagacgaccaaatggttcaccccgccagttgcctagcagatggtttgataaaaagccgccgagaaacttgcgggccccacacaggtggtgggggattatccgccctcccccgagccccggggggcagcaatgcttgcaaacaagcgccccccgctcttgtggagtgacaagattgagaaccccgccgctccgcccgcctggccccgtgatggttcacaacacgcctgtggtcacgcggggcgcccctgacctcttccagctcgcaccccagacggatacccggtgggcacgtggcggacagccacccgcgcgagattaccccgccccccatttggcggatgcgcaacccgggaccttctttgcgtgacaaccacacgagctgttctagaggccccactctgcggcgacaacaccaccagcagagaactcctcgggcttgctcccacgaaaaactacgcactaacatcatcatcagcgcaccacagcggcaagatgatgttgcatgaacacacaccccactgttgcgtgagaggacacggggaccacacggggacaactaccgtctaggtaagaaagagagggctaatgtcccctcactcgtgacaacactggcgagtattacttcttgttccgactagatagctcgagcatttccagtcggggcttgttgtatgatgctcccacttcatgaagtgtgtgctactgtactcgattgataacgcagcagagtgggaggggtgggatcctccacgtgatgctcccaggagggcaccatcgtgtcgcctcacgtgcagggcattactgtccaccccccccctcccctcccggcggccccgcccaacccttccgccccacaaagacaa

SEQ ID NO: 688563 - DNA, 222 bp, Homo sapiens
gttgcggagctgaggagcataatcccccaggcgtaagaacatatacactctgtccttcccatggccatgtaactgggagcgacccacagaaggtagaggaggctcaaactgccgccagtgcccaggcttctcaggtcagggagttagggaggcacatgacagtgacatgcttcttagatacatcagcggctgtaaccacagggctgagggtgcctccttgat

SEQ ID NO: 688564 - DNA, 264 bp, Homo sapiens
  misc_feature (229)..(229): n is a, c, g, or t
ggcgcgtcgtcctcctcgccctccaggccgcccgcgccgcgccggagtccgctgtccgccagtctacccgacttttcctgccgccccgccgctgccatgctgcccgcgcgctgctccgccgacaccccggtgacacttggccgcctcgtccgcctacagcccgtgcctatgccagagcgtcctgccgccgccccgtgcttgccccaggcctctggccccaaccagatgntcctttcaaacccccttttttcgcctctcaccaaa

SEQ ID NO: 688565 - DNA, 290 bp, Homo sapiens
  misc_feature (101)..(101): n is a, c, g, or t
  misc_feature (103)..(103): n is a, c, g, or t
  misc_feature (177)..(177): n is a, c, g, or t
  misc_feature (191)..(191): n is a, c, g, or t
  misc_feature (197)..(197): n is a, c, g, or t
  misc_feature (216)..(216): n is a, c, g, or t
  misc_feature (248)..(248): n is a, c, g, or t
  misc_feature (275)..(275): n is a, c, g, or t
tactgccactgcttcctccgctgtgatgtaaggcccgtccttcaggtagttgtgctgccgctcctgttctgccttcagatagagccgggtgaggcggtttntnttttttttacaaacaggcttgtccacaggggcccctcggcggatccgctctcggttgtagcgggcagtgttggnccaccagtcagccntggccntcacgtatcgaaggatcanattctctatgggcgtcgggagcccagggaccncccagggaatgtaggcttcccagcagngccaggccacactga

SEQ ID NO: 688566 - DNA, 190 bp, Homo sapiens
gtagttttctgctagttgactcctagaggatccctttaggatggtgctgtgcgctgaagagggctttgtgcagtacagataacaataaggttgcatatgagctaacttgcatttttctatcagctgaggcaggagaatcacttgcaacccacgagggctggagggtgcagtgagccatgattgctgccac

SEQ ID NO: 688567 - DNA, 295 bp, Homo sapiens
  misc_feature (22)..(22): n is a, c, g, or t
  misc_feature (184)..(184): n is a, c, g, or t
  misc_feature (278)..(278): n is a, c, g, or t
ctcaaactcctgacctcaaatnatctgcccgccttagcctcccaaagtgctgtgattacaggcgtgtgccaccgtgcccggccatagtgtaaaatctttattcttcagtgtggtttatcccaattccaattatacattaggtctaaaacaaaactcaggccttgggaattccaagctttgcccnagagtgaagcccattcccttgctgggattgttctggggacagaagctgcatagctcactgtcctgtggagttgagggaagctatctttccacantggtcccagcaaggggt

SEQ ID NO: 688568 - DNA, 129 bp, Homo sapiens
gacctggctctgtccagttagctaagttgtgatgcaaaggaaaagtcctagaaagaaattaaaatgctattccagtaaacacatgaatgataaagcaaacgcaaaacaaccttattgcttagtttctca

SEQ ID NO: 688569 - DNA, 289 bp, Homo sapiens
ggtcgactttttttttttcccccaagacagagtcttgctctgttatcccacagcctcaacctccaaggctcaagtgatcctcttgtctcagcctcctgagtagctgggactacaggcagctgccaccactcccagctagtttttaaatatttttttgtagagaaagggtctcaccatattgcccaggctggtctccaactcctggggctcaagcaatactcccacctggacttcccaaagtgctgagatcacagatgtgccactgtaccctgcctggttccttttatta

SEQ ID NO: 688570 - DNA, 256 bp, Homo sapiens
  misc_feature (201)..(201): n is a, c, g, or t
actctctttccactccctcaactcccaccccagtgtgtgttccacctctatcacttccctccctctttccaataagctcatacagcaataaacggaaaaatcctaccagaatattcgacaatctggtgatgactcgtctggtcctcttaccctctgccctcagagcagcgaatagcaaagcgcccacacaggcaccctttngtagaattctcattgtcgccacgctagcaatgatgtgatagaggccctggattac

SEQ ID NO: 688571 - DNA, 320 bp, Homo sapiens
  misc_feature (36)..(36): n is a, c, g, or t
  misc_feature (41)..(41): n is a, c, g, or t
  misc_feature (45)..(45): n is a, c, g, or t
tagaggagctgtagaaaatagcgacgcgtgttgtcnttcgnaggngaaggctgatttggcatgaagaagccctgtttgcactggccttagcagccctcccatatccagctagggagctacgtatatagggcctatctccgacacggctcaaaacacgcatctaggagctgcattctgcaaacggaaactgtgcacggggaacacacctctgccccaatgcggcttgggtcaaggattgcggcgccggcctagttctcccgtagccctatgccccccatagggccaaggaggggctggactgccgtcgcaaaattttccgg

SEQ ID NO: 688572 - DNA, 468 bp, Homo sapiens
tacttttccacaaggttaaagctatgtgttttaccataaaggaaacatgtcagagtgcataaaacaaagcgagtcagaaagacactggcatagtacagaacatactaaagatgaagaaatacaggtatcacttacgtagacgtgaatacttcatttctactatcctactgtcagtggcctcttaattttcctctagaaattttctgtgcataggcaagcatgcatagcctacacatacacatgcaaagacagacctttaggaaacctgtaagtggggtcatgctggacatgtgttccctgcaccttccttttttctgttaatagtatgtctcagacttttttttgtaacagctcacatagagagctgcctctcgtttggtggctgcatgatgtgtcatcgaatgggtatgctttggcttatctgcccagtctcctgttggtgagcattcagagtctttccatttcgga

SEQ ID NO: 688573 - DNA, 452 bp, Homo sapiens
cagtcctatgttgtccatcaataggctgaaatacagtgttgcatacacatgtaactactgtgtggagcttgtgtggcagcagcatttgattcttgcttttaagtatttgaacaactttaaaatggtatgagtttttttcctacaaagttttgtagatttgggcagcattattcgggattctttgatgccctctagtataagttcatagtagcactgaactttttataagaaattaaatgtacttttaaaaaattacattgaaatagctttttaaaagcatttaccattagactcagcagttttccttctaataatttatattaagaaaaattgctcaagtattcaaaacactgttcaggggatctttgttcattgcaacatcattggtaacagcaaaaaaatcaaaattacttaaatatccatcagtaaaaaaatgattaaataaactgtcc

SEQ ID NO: 688574 - DNA, 174 bp, Homo sapiens
ggggggggggggttttttaccccccaaaacccctttggggggccccccccccccgggggcgcgggggtggtttgtttttttaaagccggtttttttttttaaaaaaaggggggggccccttggggcccccttttccccgtttttaaaaaaaggggttttttttgggggtcccca

SEQ ID NO: 688575 - DNA, 1211 bp, Homo sapiens
  misc_feature (403)..(403): n is a, c, g, or t
cgaaggagacccggtctccgacggctcatggcgatgctggtcctagtacccggacgagttatgcggaactctgggtggccaactttggcgcttcttgcctcggcggactcgagattctggggcccacgccgaggggactgcgaggagtcttgctgaaggcagttctgcgctgcggcaatgcggatcgacgtggcgtgcctcggaggcgccctgtggcgtattgccatgggaacccgtggccctcaggcacctgcgaggccgctcacccgcccgatgttacgcacgaagggggccccggaagagctgcggcacgacggccacctcgaaggccctcgggggcctgttgtcctgtgaatgcatctattatgacaactacagcagtttggctagttggatgagacgnctatatatctggtctggacactgacactgcagcgttcagattgcaatacgacaaatggcaacgagaaggattcatgagaaagggaactggagcgagcctggacaagcagtcgggcacagtccattttaagcatttggcggtgaaccgtagtaagtccgcttccacgagaggtcattacgtggtgcgacgctcgttgagactgagcaagggtacgtacctatgggggttcaggagcggtataccttgacgttgtactttatatggccttcaggcttctatttgtgctcgctttggagtaggttcatggatctcgatgagacgaaacgtacgaacagcgactgacttgagctttccaacgtgatctccgatcgggacttagacccacattagggaattaccggccattttacacgaaatgctatcatggcgccacgaagttccctaataaccttccacaacccgtattaaacaagtctccaacggcatagatcttgcagctcgccaaggaaagaaaagagggggaactcgcggaataaagtggaaagaggtcccaattccggacctacagaactgtcacgtgggtttgcacacatagggacacagttgtttggcgttcccgctcaagaaaagacttggtggttaggagcgttgtgaacccatgggggctgaggccgaacgtaaggaatacgtaagggggttccaggaagattcaaaaaggttggcgtgtcgcaccacgggaggtgccattttaatcaacggcaaggcgtggtataactttcatcgaaggaccccctggggctcccccaag

SEQ ID NO: 688576 - DNA, 223 bp, Homo sapiens
ttgcggtcacataacggaattaaatctgtcgaaatgcaccatgaagcttggagtgaagctcttccttggggacaatgtgggcttcaatgtcaagaatgtgtctgtcagggatgtacgtcgtgacagggaagatagtgacagcaaagatgacccaccaatggacgcagctggctacacagctcaggtgattatcctgaaccatccaggccaaataagcgccggc

SEQ ID NO: 688577 - DNA, 723 bp, Homo sapiens
gcgccggtccatgaccgcgcaccgttcctgagggtgccagcgccacccgtctcctgcagctcggcaccatgcgcgagatctgtgtcatatccaggtgggccagttgcgggcgaaccatgtatcgggcgcctacaggtttctgcgtgagtgtcatcaagctgatgaagcagttgggactcgaaccccacaggcagattaccatggagtaccgtgacttgtcgagctggagagaatcatgcgtgtatcgtacacagtgatggctgctggtaatcaaagtatgtagcctcggagaccactcctggatgtgtatctgtgcagtgcctggtgcaccatggaacctgctgttgcaggatgctggatccctgtcggccacaggatgcttgcagtacccagaacagacgtatgcgatgtttcgtgagcgcagaagctgggagaccgggggaactagagctggggccgaagggaccacatagctccacgtagtggatgcccgcaagccttgtggtctgacctcgggatcccttggcacttgttgtgtgatgggcaccacgtgcggctccaggaggatggcgttgctgaacttgctcccttctgaggaggccttgtccccaggcgttgcaacccacgacttgcatactttgtgcggcgtgggccggggcacgcggggcgattcgccgcgcgaatgggcctaagcgcaccgttggcgtttgccaagtcgaatgt

SEQ ID NO: 688578 - DNA, 126 bp, Homo sapiens
gcaacctccatctcccggggccaaggcaggaggattgcttgagcccaggagttcgagaccagcctgggcaacatagtgagtctctactatttattaaaaaataaaataaaataacacctacaaagt

SEQ ID NO: 688579 - DNA, 540 bp, Homo sapiens
  misc_feature (109)..(109): n is a, c, g, or t
ggtgtgtcgaaggtcacggcgcgctcacaatggagctctcggagtctgtgcagaaaggcttccagatgctggcggatccccgctccttcgactccaagcgccttcacgncttctccatcgcggggcggcattccagagtctgctggacgcccaggcggacgaggccgtgtagatcatccagattgaaacatatcgacccagtgcttttaaaacattgtcatgcagcagttgaatttacatactagaggcaggaaagcacggagttgacaagtcaattctaagcacttatctagaagatgtaatttgtgacagagagggaatagaactgtttcggcaggaatatcagaataataagaattccctagaaatcctactggaagatataggcagatctctccctcatataaggatgtttctgggcgcttgaatatcagaataagaccaatcaactccataggatgtacagacctgcatatttgggaccttaaggtccagaacagtgatccccatctatccagagatagttcagttgcgcatgca

SEQ ID NO: 688580 - DNA, 179 bp, Homo sapiens
atctagagttcccattccaaacagccccgacagcagaggctcatctttgcaggcagcagctggaaatggccgcacatctttctgactacacacatccatgaaaggagtctgaccctgcacctgtcctgcgcctcatgggtggctgttaattcttcagtcatggcattcgcagtgcccag

SEQ ID NO: 688581 - DNA, 185 bp, Homo sapiens
  misc_feature (67)..(67): n is a, c, g, or t
  misc_feature (82)..(82): n is a, c, g, or t
  misc_feature (163)..(163): n is a, c, g, or t
ggaagaccttgttgcagatcgcctgcgtcgcctagagagtcggcaggcgcgatcacgcgctgcgcgnagatcttgttgaccngatcgatgcacgcctggacgttgtccgaggagtacttgcgggacgtgccggtgacgccgcagagatccgtctccgtcgacncgcccgcgacttccgcgtcgac

SEQ ID NO: 688582 - DNA, 349 bp, Homo sapiens
tatactcacacacaggcatggatgcatgtgtgtgtaacaaacactttgaccctgggaactgggtatacctctctccatgcgagccagaggctcaggcatacgtgttcacgctcttccgttcttggggcctgaatcagcggattgccatagttgagtatgcgcgacagtcgcccagacattagacggtgacgttcacgttccggcctttgacttcctgcaagggtcatcagatcacgaggaattcagaaggctagtctgttgtccagagttggtgggatcaatctgtatgtatgatcatccacatgatattgaacatgaaggagccggtgtataagttagggcggccgct

SEQ ID NO: 688583 - DNA, 220 bp, Homo sapiens
ggtggaccataatacactccaaacaggtatggccatggtactctccttatcccagctatgctcgggcaggccaagaatgctgcccagtgaacacgccaatgcagatcaagatggcagtcacctgccccaagagagccaccggatctccttgggtgagatctcactgaggtacatggggagcacactgagggcgacgcctccatctatgcccagccgcggc

SEQ ID NO: 688584 - DNA, 121 bp, Homo sapiens
tgggggggggatttttttcccttttttttttgggggggggggtccccccccccctgggcccctgtgttttttaaggggttccaaaaaaaagggcccccccttcattaaagaattgggcgga

SEQ ID NO: 688585 - DNA, 369 bp, Homo sapiens
gaggatccccgacgagttgttcgagttacttgtgaggctgaggggggaggatggctggagctggggaggcagacgtccccttgaaccaagatcatgccagtgtactccagcctgggccacacagtgagaccctgtctcaaaaagaaaaaaaaacacatcttggtcataaaaataactcaataaaaatactgaaagaacatgatggacaatattttcataatctaggaatgggaagatcttaggaagacaggaaactcaaaaaccataaaggaagactgacatttatctacagataacaaaaaaatagatcagaactaaaatatggaccatactataaacaatggcaaatgattaactcggacaagtcgt

SEQ ID NO: 688586 - DNA, 623 bp, Homo sapiens
cacttccgtgactaggactacagttgtagtctctcgtcagggagagagacgtacaaactggagtgtaaaaaaatcagaggtggaggtcaggaggttaggtccagaagaaaacctcgtctggagcccagcctgcatcatctacgtcatggaagagtctggagtccagggcacccgtacagcacccgcccaggagcaagtcatccgtggccatcccagcccgagccccggccgtctgggaggctcatgaggcagacagtgggggcctgtgaggtggggatgggacttgagagaccaaggctgcagagaccatctatgtgacccaggagcacgcgactggatcccgtcatcgtgcgcacgagggccaaggaacgaccgcagagcactgcgctcagcaagtgctgtcgttgtgctgaaagacaaccaatgaatgctgattgacggctgccggatttatacgggtccagagtggcttccagcgatgagctagtgtcaaggaacagacattggggaatacgtgcgagccgagcaacttgtatcgcaggtgggaagtaacgagtatattcaacgtgtgcacccgattattttgagagcgagatttatcggagattcagcaggaaggggag

SEQ ID NO: 688587 - DNA, 740 bp, Homo sapiens
  misc_feature (18)..(18): n is a, c, g, or t
  misc_feature (20)..(20): n is a, c, g, or t
  misc_feature (22)..(22): n is a, c, g, or t
  misc_feature (713)..(713): n is a, c, g, or t
  misc_feature (726)..(726): n is a, c, g, or t
  misc_feature (734)..(734): n is a, c, g, or t
cccactctcctcttctcncnangcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccanagaaaaaaaaaanaaaacaancaaaaa

SEQ ID NO: 688588 - DNA, 1019 bp, Homo sapiens
accaaggtccttctgtgatgctgtccactgaggcttttctgtatgtgggcaccatgctggatgggggtgacttgtcccggtttgtactgctaatgaccaactgctatgccacacccagtagcaactccacagaccctgtgaaatacttcattatccaggacagttgtccacgtacagaagatacaaccattcaggtgacagagaatggcgagtcatctcaggcccgattttctgttcagatgttccggtttgcaggaaactacgaccttgtctaccttcactgcgaggtgtacctatgtgactctacgagtgaacagtgtaaacctacctgctctggtactagatttcgaagtgggaacttcatagatcagacccgtgtcctgaacttgggtcccataacacgacaaggtgtccaggcctcagtgtccaaggctgcttccagcaacttgaggctcctgagcatctggctgctgttgtttccctcagccactttgatcttcatggttcaatgatggaaagcagaaaacctggtgtggctcccagctcacttcctgctggccaggagtggggatgcaggctggttatcagccaggagagagggagctcacactgcctccagcttgcacgtactctttctttaatcctcaccatcaaaaacaagttggcatctttcagtgctgttcttccttcaaatgtgatatgtatgaagcccctgtctcctgaaggaatgtggcaaaataataagtttaaagtatcagcttttggactcattaattcaagtcgttacagaacacacagttgctgtgagcactgtctgttgtgctgggcattacatggtgggaataaaacagatcctttctctatctttatggacttcatagatgctctaagaaactaggctcaatgcatgttctgctatgtgatctaagatgagacacacaatgtatatgaacttcacctgtctatccattcatgtatacatccatcctttcactcaataaacatttgccaagtcaaaa

SEQ ID NO: 688589 - DNA, 714 bp, Homo sapiens
  misc_feature (18)..(18): n is a, c, g, or t
  misc_feature (20)..(20): n is a, c, g, or t
  misc_feature (22)..(22): n is a, c, g, or t
cccactctcctcttctcncnangcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtcaattgtcctcgttcccgatgaaatatacctgagaaggggaaccaaaaggaaggg

SEQ ID NO: 688590 - DNA, 406 bp, Homo sapiens
ttattcccccggttaggtaactctggcaaattgattactttttacaacaaggtgttatcttagctaaatttgatgggtattattttgcatatatagatagttgaatgctatggcaggacgcagtggctcatgtctgtaatcccggcactttgggaggccaaggtgggtggatcacttgagaccaatagttccagaccagcctggacaacatggtgaaaccccatctctactaaaaaaaatacaaaaagtagccgagcgtggtggcacacacctgtaatcccagctactcgggaggctgaggcacgagaatctcttgaacccaggaggtggaggttgcagtgagcagagatcatgtcactgcgctccagcctgggtgacagagtgagactctgcctcaaaaaaagga

SEQ ID NO: 688591 - DNA, 462 bp, Homo sapiens
  misc_feature (435)..(435): n is a, c, g, or t
  misc_feature (448)..(448): n is a, c, g, or t
  misc_feature (456)..(456): n is a, c, g, or t
gggtccaccgccgccaccatgcctcgtgggaagccgcatgcgcgtacttcccgtgccagtcagccgccccgaacgggacgcctctgttgagctcgcactatgcgctgccgcctgtgcgccggacagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccanagaaaaaaaaaanaaaacaancaaaaa

SEQ ID NO: 688592 - DNA, 946 bp, Homo sapiens
  misc_feature (18)..(18): n is a, c, g, or t
  misc_feature (20)..(20): n is a, c, g, or t
  misc_feature (22)..(22): n is a, c, g, or t
cccactctcctcttctcncnangcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctgtgggactcagagtgtgagtgagtgcccatttgggagatggcgtgggaaaacgcatcctaaatcggtcttaagattcatccaatgtggggcctggctcggtggctcacgcctataagcccagcacgttgggaggccgaggcgggcggatcacctgagtgtcaggagttcgaggtcctagcctgggctaaccagagtgagactctcatggttagaacaagaagattcaacgtgcgtattcaggcaagtaactcgtgtgggctttatgacccaaggcattttgaagctttctccgttgccatgacacgtatctcaaggtacctggggagttcattctccaggccaggcctgtcctgcttccaatcgtcgtcttgcttgacgattggtgtctctggttcgctcatgtgctggcatgtgccagtggggtgactctcggggttcccttgccagccatcctggctcctggggtcgaaggtgattctccgtggcctcggtcgctcgccatgaagtcgtgggattaacaggccgtgtgcctatctggcccggtctgcttcgtgctatagtcaggtagatgacggtggttcacacgcatggttgggccagggctggtctctcccattcttggggcttttagctgattccaccggctttgacctgcccatgttgctggggtaccggtgcgttagttccgtgtgtcggactgctcgcgtttccgga

SEQ ID NO: 688593 - DNA, 637 bp, Homo sapiens
  misc_feature (18)..(18): n is a, c, g, or t
  misc_feature (20)..(20): n is a, c, g, or t
  misc_feature (22)..(22): n is a, c, g, or t
cccactctcctcttctcncnangcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctgcgtgcgctcaggagctgttgtactcgctatacatagcatagggcatccatcgagtgatatgtgctacacattgcgatctaacttatagcgtaggctgtgcttctgtacctaatgcactccctgggtagataagcaagttcgcatacggtgctgcatctgacagtctacgaccgttagcccgactaggtggctacgacgctcccagctagtgccgcatgccccctgcggtgccgcacatgaagcgtgaagccaagctctgacgtccgtgcaggcacagacagagcatcttcgtactacatatgaataactgtatcttaacacacacaattccatgaagcaaacactatgcatgacacagggaacagacagatcattgcctgatacatcacgtccacgctctccctt

SEQ ID NO: 688594 - DNA, 1520 bp, Homo sapiens
  misc_feature (1119)..(1119): n is a, c, g, or t
  misc_feature (1305)..(1305): n is a, c, g, or t
gataagattcacagcggttttgccagcttggaagatatgtggcagctcaaacatccatcctgaacgcactgaatgacttcagtctgtgcagtctgcttactcaattgggcagacggaggagctatatgagtcggcaggtctactggcgtgcctggaagggctgacacagagcaatgatgtaccgccatgaaagtgcctggatccacagagcagcatcaatgactggaagcaagggggagaccgcatggacctcatggaatcagtacgactgcaatcatgccctgcttcgacctcgctcgaagcacgtggcgagtagcatggcaacaattacgaatatgatcatggcaatgatcaactatcgtcgttatccctatcgatcggcacttagtatcaaaaggctccagccatatcaatccatgagtacactccattgtacatcgtgtagaggagaaccttgtcatcgttacctacgcatcgtcgcgcagacaacggtggggactcatctcctcgaagtacggcgtgacgatgcggcgtatcataatagacgggcctgtagaatcatccttgggtgtcctggaagcacacgattgcactaagcgcgcgttcggctagaggtctacctgtggacctctagacatgcacagctcgaagctactaccgttcgctcggaactaacgctaataggactactggttagctagtgaatactctgcggaccttggggcactagagaactaggtgaaactatcgtaccaaaggagaagaaagccccccatatgccaagcagttgaggcacacacacagggataccattgtgcatccaggaagagtatcctgtcagaatggggggcgttgggccttaacggaacaagccaggttggccagaacatgagttacttcatactggggagtggccaatgctactattcaagggtatagctatgcaggggggacaacaaggagccccctatcccggtagcaagacaacacaagaaacccaaagaacagaggcatgtaagaatcgagagcggcgaatgacaggctgaaagatagtgcccgaggggaagcgtgccggaaatcctatcatacgcgaggaagatagggccccctgcggagcanagggtttgacgcagaaaggggaggtttaaccgggaaaatgggctagccggagccaaggggccaagggaggaaaagaagaccgctatataacacacccagaacagggaaaacgggttcatgtgcacagaaaaacaccatcgccgcgagaatccaccaaagaagaggtaggagatgagcgaacaaccnaacaagaatggacgcagtaagaggagaaacaaacagaacaaaagagacgatgccacaaaggacacacaacaaaaaggaagaaaagagaacgagaatcacccaaagccagagaggcgaacaacaaaagaaacgacaacagtaggagaaccacgaacgactgaccaactgagccagcagcatcatcaacaaaaaaagcacaacgagaggaggggggc

SEQ ID NO: 688595 - DNA, 304 bp, Homo sapiens
  misc_feature (18)..(18): n is a, c, g, or t
  misc_feature (20)..(20): n is a, c, g, or t
  misc_feature (22)..(22): n is a, c, g, or t
cccactctcctcttctcncnangcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttttcgtcgcgggtcgcacagtgtggtgatcgctgaaaacaaggtagctaggctgttgtgtcgacatggtcagtcgtaga

SEQ ID NO: 688596 - DNA, 286 bp, Homo sapiens
catagtcaaacagtgccttttagttgagttttgagatagggtcttgctcctgtcacccaggctggagtgcagtggcagatctcagctgactgcagccgcctcccgtgtacaagcgattcttgtgcctcagtctcccgagtagctgggattacaggcgcgatctagcatgcctggctaatcttttttttttttttttacctttggcacttgtttgtggcctctgggggacccctctagagtctccctgtgcaggcttttcaagctttggcacttggcccgtccgttt

SEQ ID NO: 688597 - DNA, 376 bp, Homo sapiens
gctccctacgcctctatcgatgctcatgagaaatactccacggcctgcttcaccacttccgcgaggcagtccacctcgtccggcaggttgtaaaagtagaagctcgcccggctcgtggcgatcgcgcccagcttacgcatcagcggctgcgcgcagtggtgaccggcgcgcacggcgattccctcggcgtcgaggaaagtggcgaggtcatgcgggtgcaccttgtcggcggtgaagctcagcacgccgccgtgaagctcggatttcgcgggagcgaacactttgatcgtgggcacggcgaggagcttttccttcgcgtacttcacgagcgcgctttcgtaggcgtggattttgtccatgccgatctcggcgaggt

SEQ ID NO: 688598 - DNA, 405 bp, Homo sapiens
agccttgaatattgcaggacccaagaatctgccagtatgtatagccaggtgcacttggggtattgagtgtctcagacagccgcgcttgaagttggtctgccctcagggtccaattcccagactctcagagaccttgtccttagcggtgctccagtagtctttcagggacctgaagccttcgttcacccagcccgtggcttgttggcccacttggatctcgtgcacgttgctcagtgcatccttgccgtgtcttggtggcgtgcttcatgtagccgtgcatgaagttgagaagggaggctatcctcggcttctaagtctcggacagagcccaggagcgacaggagggccaccacaaggagtacccgggtgtgcatggcacctctgttcctagaacatctgtctcta

SEQ ID NO: 688599 - DNA, 966 bp, Homo sapiens
  misc_feature (18)..(18): n is a, c, g, or t
  misc_feature (20)..(20): n is a, c, g, or t
  misc_feature (22)..(22): n is a, c, g, or t
  misc_feature (928)..(929): n is a, c, g, or t
cccactctcctcttctcncnangcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatctccgaaaatcagccgcagcaataatctgttgtctcaccatgtataaggtgttatgtctgttccaaaaaaaaaaaaaaaaaaaaaattgttggggctggcctggaaagtttaaaccaccgttggggcgcggcccgtgttaggtgactggccatgtgtccctagagaccccgggcctggactgggtgggttccacaataaaaaaaggcccgggggaccgaggtctggacaattccagtggggttcggggctttggttctacacgggggtccggggctcattttcaatacgcccgccctgtagnnagaaacacacaaacaacacagaaaacaacacaaaaac

SEQ ID NO: 688600 - DNA, 582 bp, Homo sapiens
  misc_feature (12)..(12): n is a, c, g, or t
  misc_feature (74)..(74): n is a, c, g, or t
  misc_feature (212)..(212): n is a, c, g, or t
  misc_feature (262)..(262): n is a, c, g, or t
  misc_feature (432)..(432): n is a, c, g, or t
  misc_feature (437)..(437): n is a, c, g, or t
  misc_feature (462)..(462): n is a, c, g, or t
acgatggttggnagctcccatgttggttaccatcttcttggctcactatctcctagttcccgcggccggacaancttccgtcaaagtattcgacgttgcttttcagctacgagataacccccgtgacatatctggccttgtcttggtcgaaactatccttgggctcaacgacaactcatgcatgcccgagtgcctacaacgaggatcctccntcgtcctctacctatagctcatggacaaggtcaagtgcgttcctaccgtncaatggggttatgaaatatgctacgacattcaaaaggcgcgtctaaatcaagcgaagccaagagcacttttgaatgatgacgatccaatcaacgaggagacactatggcacgactccaaggagatgatctactcaatgcatggcatgcctcgagttttcctatatggttnggtanagatgacgtgctactacatcaaaanccttacaaagcaattcggacgagataagatgccactgatggacgtagccacgacaccttatgatgtgcccatcacattaaagatgttcaacgggtatccctccttgtggaataatgccct

SEQ ID NO: 688601 - DNA, 787 bp, Homo sapiens
  misc_feature (18)..(18): n is a, c, g, or t
  misc_feature (20)..(20): n is a, c, g, or t
  misc_feature (22)..(22): n is a, c, g, or t
  misc_feature (760)..(760): n is a, c, g, or t
  misc_feature (773)..(773): n is a, c, g, or t
  misc_feature (781)..(781): n is a, c, g, or t
cccactctcctcttctcncnangcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcccactatgcgctgcccctgggccgccagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccanagaaaaaaaaaanaaaacaancaaaaa

SEQ ID NO: 688602 - DNA, 105 bp, Homo sapiens
tatccctgaaaaatttatttcaaaatcttccaggtacattgtctaactctctttcacttctcaggcagttcccccaccctcatagaacctgttgcatgcaactta

SEQ ID NO: 688603 - DNA, 189 bp, Homo sapiens
  misc_feature (40)..(40): n is a, c, g, or t
  misc_feature (162)..(162): n is a, c, g, or t
  misc_feature (175)..(175): n is a, c, g, or t
  misc_feature (183)..(183): n is a, c, g, or t
tcacctgccgtggccacgcaccgtacagtgtggcgagcangatgctattgctagagggcaagagttggagtctatcttaggaaaatcaaggcccgcaaaggcaaataaatccttgttttgtcttcacccatgtaataaaggtgtttattgttttgttcccanagaaaaaaaaaanaaaacaancaaaaa

SEQ ID NO: 688604 - DNA, 1351 bp, Homo sapiens
  misc_feature (91)..(91): n is a, c, g, or t
  misc_feature (120)..(120): n is a, c, g, or t
  misc_feature (139)..(139): n is a, c, g, or t
ggcacgagagacgttcgtggtggagtgagaggttcccaggggaggaatgtgcaaagtcccagctttggcttctactccctcttctacttancaggacagtgggggtctcctccgtcctgngcgtagttctgggagccgngccctcgctcctccctgggatggggctgccgcttctccgccggacttaagtcgggccctgttgcctcagtactggagtgcagagctgaattcgggccactttgtcttttccacagcctgtgctcactgccaaggggacaatgacggcctccagtgtcctcctgcacactggacagaagatgcctctgattggtctggggacatggaagagtgagcctggtcaggtgaaagcagccattaaacatgcccttagcgcaggctaccgccacattgattgtgcttctgtatatggcaatgaaactgagattggggaggccctgaaggagagtgtggggtcaggcaaggcagtccctcgagaggagctgtttgtgacatccaagctgtggaatactaagcaccaccctgaggatgtagaacctgccctccggaagacactggctgatctgcaactggagtatttggacctctatttgatgcactggccttatgcctttgagcggggagacaatccctttcccaagaatgccgatggaactgtcagatatgactcaactcactataaagagacctggaaggctctggaggtactggtggcaaaggggctggtgaaagccctgggcttgtccaacttcaacagtcggcagattgatgatgtcctcagtgtggcctctgtgcgcccagctgtcttgcaggtggaatgccatccatacctggctcagaatgagctcattgcccactgtcacgcacggggcttggaggtgactgcttatagccccttgggttcctctgaccgtgcttggcgccatcctgatgagccagtcctgcttgaagaaccagtagtcttggcactagctgaaaaacatggccgatctccagctcagatcttgcttagatggcaggttcagcggaaagtgatctgcatccccaaaagcatcaatccttcccgcatccttcagaacattcaggtatttgatttcacctttagcccagaggagatgaaacaattagatgctctgaacaaaaattggcggtatattgtgcccatgattacggtggatgggaagagggttcccagagatgctggacaccctctgtatccctttaatgacccatactgagacctatagtttctcagcttccctttcagttctcctgctaagcattgcctgctactccccagaaagaaggaatcaataaagccattgaagtgtaa

SEQ ID NO: 688605 - DNA, 177 bp, Homo sapiens
agacaggctcccacgatgaatctcaggacacgtgggctgcctggttgttagtctcactgcctagtctctagtcgtgtccctagagatgaattcccttccccacatccattggctggagtgggagactagacactggtggatagctgcagaataaaaaagaaagaacgaaggcggccg

SEQ ID NO: 688606 - DNA, 944 bp, Homo sapiens
gacaggcgtccgggagaagatggctgtcccagcattgtccgggctctcccggcccgcgtgcgatgctgcagtgacctctgaggtcagaccatgtgccaagcttgtgaggcctcctgtcaggtatgcggtcattggaaggtcagtcgaatgccatagcatcttatatatcgtgcgtgcagtcaatagactatgaatattgagagcctggcagcgagaagtagataaatggagtatgtgtagatgatgtagcactagaaatcctgaaggatgcccactagtgtgactggattacatgtcctgacgtccctattgtgaagcgttccattataagtgtgaaggctaatatgacatcacagcgaaagagaggttcgtctcccccgtcatctaacgaagtctgatcaattgtgcttgcttgatatatggtcgattagtgctatacccaagggagtcgaactgctggcctgatcttaccatgatgatgttggtccatctgccggagagatacctatgccgaccagtgactctctgaatctcctttagaaggatgtcacactcgcttgaatttccaaacttgttctcacggagcggtcctaggtcaagggtcaactgtttctgaattgcggaggccacagtactggtccgtgcaatctcggggtgggaatgatggagcgcattgggagaaattgtttgtcactgtctgttaagcccttgattcatgaaggtggaagggatgggggagatgtctaaagtgttggtagtggcgtcagtgaaatttaactgggggccggaataaaagctgctgaaagatgaaaggtgtggagaagcaaagaaggtggggggggcaaaaaatattacaaagggggggcgcccgattagtgaaggcaagagagaagggggtcaaaaaaccgggaggggtgaacaagaaggtgggtaaagaaaaaacg

SEQ ID NO: 688607 - DNA, 206 bp, Homo sapiens
aaaaaaaaaaaaaaaaaaaaaaaaaaaaaaaaaaaaaaaaaaaaaaaaaaaaaaacggcacgagccagagatgctggacaccctctgtatccctttaatgacccatactgagacctatagtttctcagcttccctttcagttctcctgctaagcattgcctgctactccccagaaagaaggaatcaataaagccattgaagtgtaa

SEQ ID NO: 688608 - DNA, 296 bp, Homo sapiens
ccagggaaggttgggcccatgccaacccccaaccagggggtttttttggtggtatgggcaaaaccagggcctgggccatccaccaaaggcttttgggcaggtttttccaccaaccaatttttccggttaatagggttccaaaattcaggtagggttttaaccttgctgaaggtaaagattgacccccaggccccgggggctttggtaatggcttttggttttggtttaaaggcaaccccggcttgggcggggcattttttgttttttttaaaataaaaggttgaccggcccggcca

SEQ ID NO: 688609 - DNA, 522 bp, Homo sapiens
ggacggagctccccttggtagccctacattatgactccgcgcaagagtaccagtgtctgcctcacttatgatatgggaccacggcggggtgaagagtgaaagacttagctgtttcgtcacctcaccgaccacttctgtttgtgacggcgccggatcgctgcgagagtgactccacgcacgcttgatgttcaggcggcggatcccccgctgcagggtcacaaccccaccgcgtggagaacactcctctcgattcgcaccctcgtgaggggccttcaacgatgctgtctttgtctatagcaagacgccgagtagtcaattagattagatttttcttcgggaggttgttggcagaacatcatgtcttttataacatacggacgaaactgcttcgtgtgtatatggcagaaagacccctcgccacgcaacacccgggggagtaccaaattcatgtggaggtcccacccccctacctccctccccgctcttattagtagtagcccctgataatcacccaacatgaca

SEQ ID NO: 688610 - DNA, 296 bp, Homo sapiens
  misc_feature (270)..(270): n is a, c, g, or t
  misc_feature (273)..(273): n is a, c, g, or t
aacacggtgcctgagacttgacatgcttgaactcagaatagtcccctgtacactgtcacatgcgtagtaacaggtgacccgctgtaattctcgagcgagggagacatagtaccgttgcagatagtgggtttccgtgaaactgctggcaatgagaccttcatttctttccagatttatgatcagttctttgctttcccgttgtagtcgaatattcagcacttctggatgattcttggagtcgaagctcttcactgggatccagaggtcccnacnccgaacagaggcacagatgcagt

SEQ ID NO: 688611 - DNA, 468 bp, Homo sapiens
  misc_feature (13)..(13): n is a, c, g, or t
  misc_feature (65)..(65): n is a, c, g, or t
  misc_feature (76)..(76): n is a, c, g, or t
  misc_feature (86)..(86): n is a, c, g, or t
  misc_feature (96)..(96): n is a, c, g, or t
  misc_feature (100)..(101): n is a, c, g, or t
  misc_feature (105)..(105): n is a, c, g, or t
  misc_feature (115)..(115): n is a, c, g, or t
  misc_feature (121)..(121): n is a, c, g, or t
  misc_feature (123)..(124): n is a, c, g, or t
  misc_feature (127)..(127): n is a, c, g, or t
  misc_feature (130)..(130): n is a, c, g, or t
  misc_feature (133)..(133): n is a, c, g, or t
  misc_feature (170)..(170): n is a, c, g, or t
  misc_feature (173)..(173): n is a, c, g, or t
  misc_feature (195)..(195): n is a, c, g, or t
  misc_feature (198)..(198): n is a, c, g, or t
  misc_feature (220)..(220): n is a, c, g, or t
  misc_feature (230)..(230): n is a, c, g, or t
  misc_feature (265)..(265): n is a, c, g, or t
  misc_feature (278)..(278): n is a, c, g, or t
  misc_feature (414)..(414): n is a, c, g, or t
atagcagcttagntatgtacaaaagcagttataaaccatttatattacacagaattattcaggtnttcattttatnttattttttnaaatttttantttnntttncagttatttntttatntnnttnttnatnataaggaatggtaaatccatagcaccatttcaaaganttnttgttacttatttctcatttanatnttttatgaatatacttcacctnttagggcaantttgcaaattccacaagccgtgttttttcaaggtntccattttgggcnttttttccgttttctcgttaagcttcatacagaggttcgtggcagcggctgtttcttttggatgcactgggtcatccacctagaaaagggcttttggacatttggggtttctacccacactttggttttctaaatnaggtggactgggagggaggtatcttctttcagatgaaagggaaggggcgagaag

SEQ ID NO: 688612 - DNA, 675 bp, Homo sapiens
  misc_feature (39)..(39): n is a, c, g, or t
  misc_feature (98)..(98): n is a, c, g, or t
  misc_feature (185)..(185): n is a, c, g, or t
  misc_feature (231)..(231): n is a, c, g, or t
  misc_feature (244)..(244): n is a, c, g, or t
  misc_feature (248)..(248): n is a, c, g, or t
  misc_feature (258)..(258): n is a, c, g, or t
  misc_feature (283)..(283): n is a, c, g, or t
  misc_feature (297)..(297): n is a, c, g, or t
  misc_feature (327)..(327): n is a, c, g, or t
  misc_feature (329)..(329): n is a, c, g, or t
  misc_feature (336)..(336): n is a, c, g, or t
  misc_feature (355)..(355): n is a, c, g, or t
  misc_feature (397)..(397): n is a, c, g, or t
  misc_feature (403)..(403): n is a, c, g, or t
  misc_feature (569)..(569): n is a, c, g, or t
  misc_feature (579)..(579): n is a, c, g, or t
  misc_feature (600)..(600): n is a, c, g, or t
taaaaaggtctatattttaatatgggggggagggagtanaaaagcaagcccctatacggggccctattcaggggcagcttctggtcccataggattanggaagactctgaggaaataaaagtggttgggaaaaatccaggtgtagtggcttggtatgtggtgaggggtagaagggatgaagtgangtgtgaaggcccctcataccctccatctggcctcagactatgtccnggaaccctggggngganaaagcgccantttcatccggcttctggggatggtngacggccacgtagngatagagaacgacaagcaaagaagagcganangcccagnatgtgggcagaaaatggcngagctgcacgtccgggatcatccggaccagtccgggctcggntccgangccaccagggaaccggggaacagagcccttggcgtcctccctcagaatgaacgggagaccagaatctcagagttgtttaggcccaagaaaagcggggattccggtcagcacttctcccagaatcgtaagggggctgacggaggatgagagggggcacccagagatnggagagtgcnatggccgcggctcaaggaggnccgggagtacaaggccactgggacggcacagtataaccggggttagacggcggcagtagcatccgcgacctggtg

SEQ ID NO: 688613 - DNA, 839 bp, Homo sapiens
aatgtagagctcgggctgtggcttcagagggtggaagccccaagctgtggcagcttccatgtggtgttcagcctgcaggtgcacagaagtcaagaattgaggttgggaacctccacctagatttcagaggagtatggaaatgcttggatgcccaggcagaagtttgctgcagggcagaggccctcaaggataacctctgctagggcagtgcagaagggaaatgtgggattagagccctgacacagatcccccactggggctctgcctagtggagctctgagaagacggcaccattctccagatcccaggatggtagatccaccggcagcttgcatcatgcacctggaaaagccacagacactcaatgccagcccgtgaaagcagccaggagggaggcttactctgcaaagccacgggggtggagctacccaagaccatgggaacccacctttgtgtcagcatgacctgaactgtgagagctggagtcacacaagagatcattctgacgctttaaacatttgactgtcctgctgggtctcagacttgcatgggccttgtaaccgcttcgtctggtcaatttctcccattcggcacagattcacccaatactgtacccatgtatctaggaagtaatagcttgttttgattttaacggtcatagggggaaggatgccttgcttagatggacttggagtgaggctttgagtttatgtgaaatgatagatttggggacgtgggagagatggtagaagtgcgctgaaatggggcggggacagaagtgtgcttgcaccaatcatatggtccaatcagtgggaacggggaaataggggccagtggtc

SEQ ID NO: 688614 - DNA, 141 bp, Homo sapiens
cgctatcatcggcaccagctgggggccagccagtctttagggaaggtggccttagtctgtgcggtacaggcccgggccaggagggtcttccccgctccctgggggccctatacactcagcacccacttttggagcgttgga

SEQ ID NO: 688615 - DNA, 845 bp, Homo sapiens
ggaggcaggtagccagccagctacacctgggaatggggtcccgggccggtaggcttggcctcttgggccgacctcgtctgtgtttttctattctgttgttctgtttgtttatttttaaaaggtaaacctctgtggtgccgcagatggcaaagggagtgtcgctgggcctggtgatcccagggctggatctcagccccatgcaggagacactgtggccacgtcaggtgttgactgctcacctggctctggagggctgccctgcagcgggcctggggacaggtcggcctgtggggcagcctcagtacccgtccctagaggcatcacggtggcatccgagcatgagcttcctgcctccttgggcgagacccagcagtggacagcacaggtcctcacacccagctccgctgcacacccacggccagccaccccctcccgctcggcacaggcacgcagatgcgctcacacgtacacacacacaaatgcacgcccacttgcacatgctccacgcacaccgtttcacacactgcacagctcacgctcacacaggctcgtgcaccgcatacacacacgcacagactccctgcacactgttccacatgcatagtgtgaagcactcggacgcgagcatctcccacgcacctctaccccaccccaagcacgctctgtccccccatgcacctctccccaacaacacacacagccgcctgcaccgcccgccccccgcccccaccaaggccccagcctctggccatgcagtcctggtgccagagcctttgcgtgaagttcgggccgcagagtggcccgctggactcccatggcgccgttaaggctgagatggctatcgt

SEQ ID NO: 688616 - DNA, 169 bp, Homo sapiens
gaggacggagatgtcgggcatggacaatcgatgcagtgcagaaagaatctggtgggagataggtccagcacatcatgcgtgagagtggacggggaagctgtgggaaatgacacgtgcgaggagaaggctgaggtgggacgtgcgagcaggggaaggctacggggaggtg

SEQ ID NO: 688617 - DNA, 371 bp, Homo sapiens
aggtcctttagcaagctccgttctcaaaaggctgtgggtatttatgtaagaacttattccaaagtgactctaagatccatgttcccaagatctagtacgggctattcatggttctgaggcatgtccagcatgcaggcaaacttatctgttcaaattgaggtaaaccagacaaagccgccttaatattatcagaagctatggaattagaccgagccctttactgcgtatttaagataatgatgaattctatgcatacagagacccgcgtagtcgatcatgtcagttgaagttagttccccaaatgaagagctatcgtttgttcagaccctgtcgtttgtagttaatatgatgcgatttcgaatatacgagtc

SEQ ID NO: 688618 - DNA, 689 bp, Homo sapiens
ggagagacagccagctcacgagcagatgtggggtgacagcctgctcacatgtgccgatgtggagtgcccgcctgctcacacgtgcccatgtggagtgcccgcctgctcacacgtgccgacgtggagtgcccgcctgctcacgtgcccatatggagtgcccgcctgctcacacgtgccattgtggagtgcccgcctgctcacacacatgccgatgtggagtgcccgcctgctcacacgtgcccatgtggagtgcccgcctgctcacacgtgcccatgtggagtgcccgcctgctcacacacgtgcccatgtggagtgcccgcctgctcacacgtgcccatgtggagtgcctgcctgctcacacacgtgcccatgtggagtgcccgcctgctcacacaaagccctggcatggtggttctgtaggtttcctgtcctgccggccgagtcagacgctgttaccgtacattctactcatggtggctttttaatacgtttttatgtcaaggatcccttttatatttctctgcacctcgagataacgtaggaatattagggatgagatggaagaggagagggtgtttttgtaaaattgaattcaggactgatttgttagcctggtgcttttcgtatcagaccttttaatgaattttcatggatgctgattaaaagacaaacctgtgaaaaaaaaaaa

SEQ ID NO: 688619 - DNA, 312 bp, Homo sapiens
attaatgctaaacagtgccgtaacgaaacccacaggtcctaaactaccaaacctgtgttagaaatttcgcttggagagaccgcggagcataatccaacctcagagcagtacatgctaagacttcaccagtcaaagcgaactactatactcaattgatccaataacttgacccacggaacaagttaccctagggataacagcgcaatcctattctagagtccatatcaacaatagggtttacgacctcgatgttggatcaggacatcccgatggtgcagccgctattaaaggttcgtttgttcaacgattaaa

SEQ ID NO: 688620 - DNA, 453 bp, Homo sapiens
attctagaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaaaggaaagggaaaaaaaattagctttatacctcttcctggtctcaaccgccatggaaaatttctgaacactccaaatttcagtggaattaattccaaaacaaaattttataaggtttaaaattaattttaaccttctatatagataatagtattaccttttaaaaagggcctcagggggtatattaatctttctaac

SEQ ID NO: 688621 - DNA, 1089 bp, Homo sapiens
  misc_feature (25)..(25): n is a, c, g, or t
  misc_feature (35)..(35): n is a, c, g, or t
  misc_feature (45)..(45): n is a, c, g, or t
  misc_feature (59)..(60): n is a, c, g, or t
  misc_feature (63)..(63): n is a, c, g, or t
  misc_feature (65)..(65): n is a, c, g, or t
  misc_feature (124)..(124): n is a, c, g, or t
  misc_feature (1043)..(1043): n is a, c, g, or t
  misc_feature (1058)..(1058): n is a, c, g, or t
  misc_feature (1064)..(1064): n is a, c, g, or t
  misc_feature (1073)..(1073): n is a, c, g, or t
  misc_feature (1085)..(1085): n is a, c, g, or t
attttttaaagactgacactttaanaatgtgctgngcaactctgnaaatcaataccctnnccncnagtttattgttgttctgttgctgttaccttttgtttagtgtgtgttctggactaatttnaagtgtccacctcatcagcttcatgttcagccagtgactggacagaggacccctttaagtgctttgcaccagtaactctcacggttctgccgacacgcagttgatgcgtggtgagtgtgccttcagcgctccatcgcggttctgctgacacgcagttgatatgtggtcagtgctccagcaggcagctgccaactgtgcctttgccttcacttcttacttgcacacagccacaaagccagccagaggtgagggccagggcagctcaggttcctctcgggcacacacacagctctgtgcctgtgtgggcacagccttccatgcctccaggagtgtggcagagcttctcagcggccactgtgggcatctcgttcctcagatcttcctttcatgagttatgtagttgaattatcaatctttcttggcttctaagttttgtgttctacttagaatgctcttcccccttaaagattatatttgaaatgttttccatgttttcttctagtacttttatgggtttcattttcatattgaaatcattgatctacttctagtttttgatacaaaatgtgagccaggaaacccagtttttaaatttcaaatagctgtccaggtgtccctgcacctcttatgcatgagccctcgctttgtgccaatgtggagtgcccgcctgctcacacgtgcccatgtggagtgcccgcctgctcacacgtgcccatgtggagtgcccgcctgctcacacatgtcgatgcggagtgcccgcctgctcacacatgtccatgtggagtgcccacctgctcatgtgcccatgtggagtgcccacctgctcacatgtgccgatgtggagtgccgcctgcttcacacacgtgcccatgtgggagttgcccgcctgcttcacgttgcccatgtgggagtgctcggnctggttcaaaagtgnccgatnttggagttntccggtttgttnaaaa

SEQ ID NO: 688622 - DNA, 1447 bp, Homo sapiens
actaccccctccccctcgcggcggcgtggaacaactaaaaagcagcgccttctgttatagcagccgccctcgtactatcgctcctcacgtgaggtagccgccaacacgaccacgcacagtcgggtttgttgttaggcttcactcctacgttaagtatataaactcaccgggcgggggtctgaatgattatcacacccactcctgccaggagctattcattataatcaatacgaccggcgcctcgcgggcgtagttaatacaatacatattatatcctatccatcacgaggagcgagcacgcagtttatatagtagcatcctagtttcgcgcgccgctctgattgtgtgggtgcgccaccacttagtagaacacaaacagagttgtatcctccacacaataaaaagaagcaaggggtggtgtcaatgccgcttgccgcagatatataattctcgccgatggtgtataatggacgcagcggaagagatagcgatgcacaccaaatgcagtactgatttttgatctctgctgagaacaaataagagggagggaggagagtttatttttctctccagctagaagcggacatactctactctggttgggatagatgatagactacactaccccgcctggtgcttgcctgtcatgtagctgttggtgtagtcatatacacaacacacagcggagggcgtcattgttaagttaggtgcactcaccctcacactcgcactgatgcacctcacgctggcggtggattctaaataaagagagtagagaatataatggcgcgcccgccggagcagcacaccaacctaatttttttagtccgccgccagttagaagaaagaaagatacacacaccatagagaatcgccccctagagcgacggcgaaatattacttaccatcgctccccgcgggcgggaaaaaaacacatacttctctctcagcggggcagtgaacatacacaccacagcagggggcgcctcactccacaactctggtgtcggccacacccaccgcgtgatatgaagacgacactatgatcacacgccgccgtcggcgggtggaggaacacaaaagagggggtcgcccccacaccacaacacacgcactgctacccagcggggagccaccccccggcaacatactgtgtggagaacacccacacaatagatattgatggagccgcacttttctctagaagagaggacccccgcgcccaccagtggcagacgatgtaggtggtgcatcatctcccctcctccggagagagaagaaatacccatcacgacgagcgtctcttagtacgtttttcatcgtgtgggggtcctccccccactcttcttgtttccgcagccacacaaaaaatagcgcgtgggccccccccccccccggcgaaaaaaggggggggggttttttaaaaaattttttttggggcccccca

SEQ ID NO: 688623 - DNA, 1160 bp, Homo sapiens
  misc_feature (25)..(25): n is a, c, g, or t
  misc_feature (35)..(35): n is a, c, g, or t
  misc_feature (45)..(45): n is a, c, g, or t
  misc_feature (59)..(60): n is a, c, g, or t
  misc_feature (63)..(63): n is a, c, g, or t
  misc_feature (65)..(65): n is a, c, g, or t
  misc_feature (124)..(124): n is a, c, g, or t
  misc_feature (1114)..(1114): n is a, c, g, or t
  misc_feature (1129)..(1129): n is a, c, g, or t
  misc_feature (1135)..(1135): n is a, c, g, or t
  misc_feature (1144)..(1144): n is a, c, g, or t
  misc_feature (1156)..(1156): n is a, c, g, or t
attttttaaagactgacactttaanaatgtgctgngcaactctgnaaatcaataccctnnccncnagtttattgttgttctgttgctgttaccttttgtttagtgtgtgttctggactaatttnaagtgtccacctcatcagcttcatgttcagccagtgactggacagaggacccctttaagtgctttgcaccagtaactctcacggttctgccgacacgcagttgatgcgtggtgagtgtgccttcagcgctccatcgcggttctgctgacacgcagttgatatgtggtcagtgctccagcaggcagctgccaactgtgcctttgccttcacttcttacttgcacacagccacaaagccagccagaggtgagggccagggcagctcaggttcctctcgggcacacacacagctctgtgcctgtgtgggcacagccttccatgcctccaggagtgtggcagagcttctcagcggccactgtgggcatctcgttcctcagatcttcctttcatgagttatgtagttgaattatcaatctttcttggcttctaagttttgtgttctacttagaatgctcttcccccttaaagattatatttgaaatgttttccatgttttcttctagtacttttatgggtttcattttcatattgaaatcattgatctacttctagtttttgatacaaaatgtgagccaggaaacccagtttttaaatttcaaatagctgtccaggtgtccctgcacctcttatgcatgagccctcgctttgtgccaatgtggagtgcccgcctgctcacacgtgccgacgtggagtgcccgcctgctcacgtgcccatatggagtgcccgcctgctcacacgtgccattgtggagtgcccgcctgctcacacacatgccgcgtgcccatgtggagtgcccgcctgctcacacgtgcccatgtggagtgcctgcctgctcacacacgtgcccatgtggagtgcccacctgctcatgtgcccatgtggagtgcccacctgctcacatgtgccgatgtggagtgccgcctgcttcacacacgtgcccatgtgggagttgcccgcctgcttcacgttgcccatgtgggagtgctcggnctggttcaaaagtgnccgatnttggagttntccggtttgttnaaaa

SEQ ID NO: 688624 - DNA, 1378 bp, Homo sapiens
  misc_feature (25)..(25): n is a, c, g, or t
  misc_feature (35)..(35): n is a, c, g, or t
  misc_feature (45)..(45): n is a, c, g, or t
  misc_feature (59)..(60): n is a, c, g, or t
  misc_feature (63)..(63): n is a, c, g, or t
  misc_feature (65)..(65): n is a, c, g, or t
  misc_feature (124)..(124): n is a, c, g, or t
attttttaaagactgacactttaanaatgtgctgngcaactctgnaaatcaataccctnnccncnagtttattgttgttctgttgctgttaccttttgtttagtgtgtgttctggactaatttnaagtgtccacctcatcagcttcatgttcagccagtgactggacagaggacccctttaagtgctttgcaccagtaactctcacggttctgccgacacgcagttgatgcgtggtgagtgtgccttcagcgctccatcgcggttctgctgacacgcagttgatatgtggtcagtgctccagcaggcagctgccaactgtgcctttgccttcacttcttacttgcacacagccacaaagccagccagaggtgagggccagggcagctcaggttcctctcgggcacacacacagctctgtgcctgtgtgggcacagccttccatgcctccaggagtgtggcagagcttctcagcggccactgtgggcatctcgttcctcagatcttcctttcatgagttatgtagttgaattatcaatctttcttggcttctaagttttgtgttctacttagaatgctcttcccccttaaagattatatttgaaatgttttccatgttttcttctagtacttttatgggtttcattttcatattgaaatcattgatctacttctagtttttgatacaaaatgtgagccaggaaacccagtttttaaatttcaaatagctgtccaggtgtccctgcacctcttatgcatgagccctcgctttgtgccaatgtggagtgcccgcctgctcacacgtgccgacgtggagtgcccgcctgctcacgtgcccatatggagtgcccgcctgctcacacgtgccattgtggagtgcccgcctgctcacacacatgccgatgtggagtgcccgcctgctcacacgtgcccatgtggagtgcccgcctgctcacacgtgcccatgtggagtgcccgcctgctcacacacgtgcccatgtggagtgcccgcctgctcacacgtgcccatgtggagtgcctgcctgctcacacacgtgcccatgtggagtgcccgcctgctcacacaaagccctggcatggtggttctgtaggtttcctgtcctgccggccgagtcagacgctgttaccgtacattctactcatggtggctttttaatacgtttttatgtcaaggatcccttttatatttctctgcacctcgagataacgtaggaatattagggatgagatggaagaggagagggtgtttttgtaaaattgaattcaggactgatttgttagcctggtgcttttcgtatcagaccttttaatgaattttcatggatgctgattaaaagacaaacctgtgaaaaaaaaaaa

SEQ ID NO: 688625 - DNA, 224 bp, Homo sapiens
cttcgagctcggacacccccgcccgggtataccctttttggaccttttttttaaaagtttttttaaattttccttaacggacctggtggataatcggcttgggcccggatttaacccttaaagggatttaaccacccgttttgggttgatttcccaaccaacccaactccggaaaaacccggccccgggcccccgggggccgttaccggcctaaaaccgtccac

SEQ ID NO: 688626 - DNA, 1059 bp, Homo sapiens
  misc_feature (999)..(999): n is a, c, g, or t
gcattcaccatctcacttctaggaatactagttatatcggtcacacctcatatcctccgctactatgcctagaaggaatcatactatcgctgttcattatagctagtctcataacgcctcagatcaggcagctccctcttagccaatattggtggctattgctcatactgagtctttgccgcctgtgtaggccgcgggtggggctagcccgtactagtctcattgctccaagcatatagtggcctagagcgtacgctacataaacctatggcctaggtctcaactgctaagttacataagtcgtcaccagacggattatattcaggtaccgactgactatgaaattttccaaaaagaaagacatagtttgcaggtcaacactagtcgggccacacagtccgtattttagttagcatcatcccttctactattctctttgtcgcaacatcaacataaaaatttctatttcagcgtgttcacgcagtcctttgaggtctggtgtccatctcaggcgcccgcgtcctagtactggattacctggatgttccctagtcgctcacaaatcatggcgccgtccagatgccacattgatccagtgaaccactagtgacggagcaaaaatgcgtaacctctctatagggaatctccctaaaatctccttgtttttcgattcacaggcgcccgaagtaaggcactattttatatcgccttggagagcacacgttattcccaactttggttttctgtgcccgatgaggcagcgagcctaagcgtgaacgcaggagatttagtgcctattctaaaccggaggaggccctccgtatttatacgcgctaggtaaatttcaaagcccaggtttagggtatactaacctatttgcgggaagataaggcctgcgaaacaaatggatgtcagggtgtaataaaaacctcttggccactttattctatccagggtcccccgggttatagtggctgcaagaggggtactcactctgcngccctctgtctctgatataatctgccacccaattacgtgggcactggccgggatgcaact

SEQ ID NO: 688627 - DNA, 165 bp, Homo sapiens
ttcatccaaccccctcgttcaatatgagtgttgctgagaactgcggaagttggaactcacagccaggcctcccggcctccccggctaagctttcttccttccaatccagaaggtgtttccaagcctgtctggagtcccctggggaaggatgagcccaggactctg

SEQ ID NO: 688628 - DNA, 493 bp, Homo sapiens
ttgattagacctgatctctggtgctcatttccagagtgtgcgattcgtgaagctgggggaggaagccggccatcctgaagtatccagcaagcccccaagcaatgacagggttgctggtatggaaaacatatgttgagaacaagttgtactagtccatactgctgccttgtgaagacctcatcctctatcctgatttccccaatcattctgaaaaaattccactgtgttactattgggcttcacacagatcacttacagtaactacatgatatgacgcatgttctaaaaggaatctatagtctgttctatgccttgagctctgaacacagggtctcacatttagattaaggagccatctgccaattctggacatctgttaaatcagttccagcctcgggagagtaggaagacctgttagatgccatggaactccacatacacctctgaaatgtctggaatgggacagagaatagaggcagcttctccctgattc

SEQ ID NO: 688629 - DNA, 1254 bp, Homo sapiens
  misc_feature (25)..(25): n is a, c, g, or t
  misc_feature (35)..(35): n is a, c, g, or t
  misc_feature (45)..(45): n is a, c, g, or t
  misc_feature (59)..(60): n is a, c, g, or t
  misc_feature (63)..(63): n is a, c, g, or t
  misc_feature (65)..(65): n is a, c, g, or t
  misc_feature (124)..(124): n is a, c, g, or t
attttttaaagactgacactttaanaatgtgctgngcaactctgnaaatcaataccctnnccncnagtttattgttgttctgttgctgttaccttttgtttagtgtgtgttctggactaatttnaagtgtccacctcatcagcttcatgttcagccagtgactggacagaggacccctttaagtgctttgcaccagtaactctcacggttctgccgacacgcagttgatgcgtggtgagtgtgccttcagcgctccatcgcggttctgctgacacgcagttgatatgtggtcagtgctccagcaggcagctgccaactgtgcctttgccttcacttcttacttgcacacagccacaaagccagccagaggtgagggccagggcagctcaggttcctctcgggcacacacacagctctgtgcctgtgtgggcacagccttccatgcctccaggagtgtggcagagcttctcagcggccactgtgggcatctcgttcctcagatcttcctttcatgagttatgtagttgaattatcaatctttcttggcttctaagttttgtgttctacttagaatgctcttcccccttaaagattatatttgaaatgttttccatgttttcttctagtacttttatgggtttcattttcatattgaaatcattgatctacttctagtttttgatacaaaatgtgagccaggaaacccagtttttaaatttcaaatagctgtccaggtgtccctgcacctcttatgcatgagccctcgctttgtgccaatgtggagtgcccgcctgctcacacgtgcccatgtggagtgcccgcctgctcacacgtgcccatgtggagtgcccgcctgctcacacacgtgcccatgtggagtgcccgcctgctcacacgtgcccatgtggagtgcctgcctgctcacacacgtgcccatgtggagtgcccgcctgctcacacaaagccctggcatggtggttctgtaggtttcctgtcctgccggccgagtcagacgctgttaccgtacattctactcatggtggctttttaatacgtttttatgtcaaggatcccttttatatttctctgcacctcgagataacgtaggaatattagggatgagatggaagaggagagggtgtttttgtaaaattgaattcaggactgatttgttagcctggtgcttttcgtatcagaccttttaatgaattttcatggatgctgattaaaagacaaacctgtgaaaaaaaaaaa

SEQ ID NO: 688630 - DNA, 227 bp, Homo sapiens
tgcgcaaactcgtggcagcgggagctacggcgctttgagttgccatttgactggccccggtgtccagtggtgtcccctggggggaacccagggcccaatgaggcagcactgcccagtgaggacttatcacagattggtttccctgagggcctgacacctgcccacctaggagaacctggaggtaagagaagggaagcgcgtttgcgcaacggcgcgtttgcgcgctg

SEQ ID NO: 688631 - DNA, 1290 bp, Homo sapiens
  misc_feature (25)..(25): n is a, c, g, or t
  misc_feature (35)..(35): n is a, c, g, or t
  misc_feature (45)..(45): n is a, c, g, or t
  misc_feature (59)..(60): n is a, c, g, or t
  misc_feature (63)..(63): n is a, c, g, or t
  misc_feature (65)..(65): n is a, c, g, or t
  misc_feature (124)..(124): n is a, c, g, or t
attttttaaagactgacactttaanaatgtgctgngcaactctgnaaatcaataccctnnccncnagtttattgttgttctgttgctgttaccttttgtttagtgtgtgttctggactaatttnaagtgtccacctcatcagcttcatgttcagccagtgactggacagaggacccctttaagtgctttgcaccagtaactctcacggttctgccgacacgcagttgatgcgtggtgagtgtgccttcagcgctccatcgcggttctgctgacacgcagttgatatgtggtcagtgctccagcaggcagctgccaactgtgcctttgccttcacttcttacttgcacacagccacaaagccagccagaggtgagggccagggcagctcaggttcctctcgggcacacacacagctctgtgcctgtgtgggcacagccttccatgcctccaggagtgtggcagagcttctcagcggccactgtgggcatctcgttcctcagatcttcctttcatgagttatgtagttgaattatcaatctttcttggcttctaagttttgtgttctacttagaatgctcttcccccttaaagattatatttgaaatgttttccatgttttcttctagtacttttatgggtttcattttcatattgaaatcattgatctacttctagtttttgatacaaaatgtgagccaggaaacccagtttttaaatttcaaatagctgtccaggtgtccctgcacctcttatgcatgagccctcgctttgtgccaatgtggagtgcccgcctgctcacacgtgccgacgtggagtgcccgcctgctcacgtgcccatatggagtgcccgcctgctcacacgtgccattgtggagtgcccgcctgctcacacacatgccgcgtgcccatgtggagtgcccgcctgctcacacgtgcccatgtggagtgcctgcctgctcacacacgtgcccatgtggagtgcccgcctgctcacacaaagccctggcatggtggttctgtaggtttcctgtcctgccggccgagtcagacgctgttaccgtacattctactcatggtggctttttaatacgtttttatgtcaaggatcccttttatatttctctgcacctcgagataacgtaggaatattagggatgagatggaagaggagagggtgtttttgtaaaattgaattcaggactgatttgttagcctggtgcttttcgtatcagaccttttaatgaattttcatggatgctgattaaaagacaaacctgtgaaaaaaaaaaa

SEQ ID NO: 688632 - DNA, 140 bp, Homo sapiens
ggatacagagagcaggagacgaggccagagtctccagctaggggtaggacgtagcccaccagctagccgaaaggccaaagacgccaggtccggtaggacagtagacaagcaggacatagacataggtccaggtagtgacg

SEQ ID NO: 688633 - DNA, 353 bp, Homo sapiens
aaatgacccttggctcttattgttcttgctggtgtggtatgttcccggctgaaaaaatggtcagaaggggaaaggaggaagtgagaaaaaaaaaacagggaaatgaccctgcatgtgatggatcagctgaccccatccagatcagtaaactggttcatttgattttgtgccccccccccaggaactgactcagcgcaaaaagacagcttcgactccttgtgttttcatccctaaccaatcagcactcctggctccctggcttccccccaccccccaaattgtccttaaaaactttgctctccaaacgctgggggagactgatttgagtaataataaaaccctggtttcctgca

SEQ ID NO: 688634 - DNA, 1060 bp, Homo sapiens
cgatccacgtaggctccgtgttgcatagtgtaacagcccatgacgactctatgtacgcctcacttactcttgagcgagcctcatgtgcttggctctactcgtgcccgtgccttgtgctgaacctcacatgcctcgaggggtgtcaaagggtgtgttggcaccacatgtgggagacggccgctccgactgcgggccctgctagaacgcagtgtgctgcagattgcgtctatgagacacaattgcaaagcagctcgacaagtcccttctgctgcaggacgatatgtgacgagatctcccacgacatgtagagactatggtgtacaagagaccaagttttcccactgacagtagggagcactccttgtgatactatgggacgaccagaccgtggcgaacgtgcgctccctggaatagacgcaagcatgctctgctttcactgcgactgcagattagtgtagttcgtcataagctcccccttgcttcaatcctggtatccctcatgactggtcaggaacaatgacagcagttgcttgcggagaggtagatgctcatgttgcaatcaacaactctgtccaatgttctacctccatgtaaggtgcatcgtacgttagcccgccttgtatgatctactctaaagataccgtaggtattggaagattgcatattacatagaatccccagggacgtcaagggaacacaatagaaccttgaagaagtggggtgtgccccgcacttttcagagatgggcactcaccatttccgccgttcgtcccctcccatctatatcacacatcgatatgacagcaggagccctacgtcaaagttaaagcccgtcccgaggtccacaaagttgaagtagatggggcggaaacgtctattgcgcacatgtgagctagtcgctagttccaggacttgcgttaaccatgaacgatcccaggaacgttgggtaggaaccgtggccaagcttccagccctttggtttcgagaggcccatcgcatagaaaacattgttgacatgtacgcccacttgttaggccgcccatatgtccctttcgaattg

SEQ ID NO: 688635 - DNA, 184 bp, Homo sapiens
tagcttatgtccactcagtttttccattctttttttctctttctgagttcaagaccaagaaacagaaacacaaataagttataagaacagttagtgcctaaactagaaatgctgggtgtctttcagccccaaatgaagggaggacaggcctggctgtgtctgtggcactgagacatgacgctgg

SEQ ID NO: 688636 - DNA, 250 bp, Homo sapiens
aataaacccaggttaaaatttctgagccaaccccccccttccatttaccaaccaggaataatttcaaaggttaattccagtttgaaatttccccagggaattttgaaagtaaggccaaggcagtttcccaaactgttcaactatagcccccagcttagtgaaaacagaacgtagcgcattgagcaactagagcactctcttctcccgagtcggggcagcatggctgggacagaagccttctagtcgacgc

SEQ ID NO: 688637 - DNA, 200 bp, Homo sapiens
gaccacttaacagtttctttgagacattgactttttgtaaggattgtgactatctatcatcccttatgacatgcacattggtctgccactaaccctgggatttcgctgtatggccacctaaatgggcacagccactgatgaaaacctctaggggataatcacacactttggaccacagatcccccacggctgaaggcttt

SEQ ID NO: 688638 - DNA, 643 bp, Homo sapiens
tatttgcatgttttgtgtgtgggtgtggggtgaaataatattcttacaaagtatttttttacctgtgtatgccctgtttgcaaaaacatatttatgaaaaaaacaacacagcaaaacctatcttggcaaaaaaaggaagtgagtcagagcccattttcaggaggcattggtaatgttagtgtagggggttgcttgcagacacacaagaaatttgtattgcccaggattggcactagctatgaagggcttggcgagccacattaaggagacctcacggaactggagagcactccccccattttcttagtaagaggaagccaaatgttattaaacacctaaatcctttttgtcgtccacttgtattatataaaattaaccctaaccatagccaaaatctcccaggactaaaactttttttatttcgcacatcttgagccttttacggagatttgaccaaactccctttcgttctctttattcacaacctcatggagttttcccacacacacgggtatcctgcccactgtctgtttctacacattactccaaccttcgtctcaacgcctcctttttcttttctctcctttttatcattttaatttctttacggccagcgagattccgccttatatattgcgtaatt

SEQ ID NO: 688639 - DNA, 273 bp, Homo sapiens
cagcgggattactctggttatcttcatcatcatcatcatcgtgtgggttgtctcttcatgaagaaccagcggaactcaaaactgctgttcaagaaacctcttcaatgacttttgacttagaacctgctatacttatcaatgcttaccttactgttatctctaacaatttttttttgtgttaattgtaaatgttgaactttctatggaaactgtgccttttgttttctatatatgcactccacaattagaaggccggccccgtccacatttttg

SEQ ID NO: 688640 - DNA, 318 bp, Homo sapiens
cctcacctcatgggtacgcaacgccacttatcagtgaaccaatatcacgaaaaaaactctacctctctatactacatctccctacaaaagctcctgagtccataacattcacagacacagaactaatcatattttatatcttcttcgaaaacacacttatccccaccttgggtatcatcacccgatgagggacacaggcagaacgcctgaaagcaaggacataattcctattctacaacctatataggtcccttcccctgcgcatctgcactgatttacaatcaccaaaaacctaagggtcactaaaacttctaataa

SEQ ID NO: 688641 - DNA, 231 bp, Homo sapiens
caacagaaacaatcatcataaaaatatactagtatatcaaaacgaacatatagtataaatcaatcactgattctcagtgactcaccaaaagatatcttcaatatatggctagcttaactacataagactacatacaagcaaaataagtatttcttgaaagactattatacttatctgggcaatctatgtatttggacagaaatcaaagacttgacaccagcccaagattga

SEQ ID NO: 688642 - DNA, 146 bp, Homo sapiens
accgggcgtaagatatgctcaaagtaccgatagcactccccggaaggctcggggataggtgaatccccggatactatcttacacaaccacctgtactatagtagtaactatatggcaacacggttgcaagtacagacccggggtga

SEQ ID NO: 688643 - DNA, 860 bp, Homo sapiens
  misc_feature (37)..(37): n is a, c, g, or t
  misc_feature (243)..(243): n is a, c, g, or t
  misc_feature (278)..(278): n is a, c, g, or t
  misc_feature (280)..(280): n is a, c, g, or t
  misc_feature (288)..(289): n is a, c, g, or t
  misc_feature (311)..(311): n is a, c, g, or t
  misc_feature (313)..(313): n is a, c, g, or t
  misc_feature (322)..(323): n is a, c, g, or t
  misc_feature (372)..(372): n is a, c, g, or t
  misc_feature (376)..(376): n is a, c, g, or t
  misc_feature (383)..(383): n is a, c, g, or t
  misc_feature (385)..(385): n is a, c, g, or t
  misc_feature (412)..(412): n is a, c, g, or t
  misc_feature (426)..(426): n is a, c, g, or t
  misc_feature (431)..(432): n is a, c, g, or t
  misc_feature (471)..(472): n is a, c, g, or t
  misc_feature (474)..(477): n is a, c, g, or t
  misc_feature (494)..(494): n is a, c, g, or t
  misc_feature (496)..(496): n is a, c, g, or t
  misc_feature (501)..(501): n is a, c, g, or t
  misc_feature (509)..(509): n is a, c, g, or t
  misc_feature (512)..(512): n is a, c, g, or t
  misc_feature (514)..(515): n is a, c, g, or t
  misc_feature (517)..(517): n is a, c, g, or t
  misc_feature (519)..(522): n is a, c, g, or t
  misc_feature (528)..(528): n is a, c, g, or t
  misc_feature (532)..(532): n is a, c, g, or t
  misc_feature (535)..(535): n is a, c, g, or t
agcggaacggagagaacaggaaagcgcgaggagccgncgccagccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgnaagtggcatccagataaaaatcctgagaataaagnangaagcagnngagaaaattcaagcaagtagcngnaggcatatnnaagtgctgtcggatgctaagaaacgggacatctatgacaaatatggcanaganggattanantggtggaggacggaggtggaagtcatnttgacagtccattngaatnnggcttcacattccgtaacccagatgatgtcttcaggganntnnnnggtggaagggacccatntncattngacttctntgncnngncnnnnagaggncatnctntagggactcgaaggggtccccgaggcaagcagaagccgagggacggggtcgttacacatctgacgttcagtggatttccgtctttcggaagctggatccactactaaagcatacagcgaaaacaacatccaacgggctcaaccacgcggccacaggcgggcacctcacgtaccaccactcaacccaacgaccactatggatgggcccctgcgccctgggcacacactacaaactcgaacacccacacccgcacaccacccaaaacggcacaggacagcacaagaacactagacaagcggaaccgacgcagcacacgaccccgaca

SEQ ID NO: 688644 - DNA, 899 bp, Homo sapiens
  misc_feature (37)..(37): n is a, c, g, or t
  misc_feature (282)..(282): n is a, c, g, or t
  misc_feature (317)..(317): n is a, c, g, or t
  misc_feature (319)..(319): n is a, c, g, or t
  misc_feature (327)..(328): n is a, c, g, or t
  misc_feature (350)..(350): n is a, c, g, or t
  misc_feature (352)..(352): n is a, c, g, or t
  misc_feature (361)..(362): n is a, c, g, or t
  misc_feature (411)..(411): n is a, c, g, or t
  misc_feature (415)..(415): n is a, c, g, or t
  misc_feature (422)..(422): n is a, c, g, or t
  misc_feature (424)..(424): n is a, c, g, or t
  misc_feature (451)..(451): n is a, c, g, or t
  misc_feature (465)..(465): n is a, c, g, or t
  misc_feature (470)..(471): n is a, c, g, or t
  misc_feature (510)..(511): n is a, c, g, or t
  misc_feature (513)..(516): n is a, c, g, or t
  misc_feature (533)..(533): n is a, c, g, or t
  misc_feature (535)..(535): n is a, c, g, or t
  misc_feature (540)..(540): n is a, c, g, or t
  misc_feature (548)..(548): n is a, c, g, or t
  misc_feature (551)..(551): n is a, c, g, or t
  misc_feature (553)..(554): n is a, c, g, or t
  misc_feature (556)..(556): n is a, c, g, or t
  misc_feature (558)..(561): n is a, c, g, or t
  misc_feature (567)..(567): n is a, c, g, or t
  misc_feature (571)..(571): n is a, c, g, or t
  misc_feature (574)..(574): n is a, c, g, or t
agcggaacggagagaacaggaaagcgcgaggagccgncgccagccaccagcgcagcagtcctggagctgtgaggagattcgggccgtcaccctgcctcccctgcgtcccgccaccggccgcttctgtcctcggacccattccaatcaactcttctgtaacaagcactcgtgtggtattcactattcgaatgtatcttatgggccgtgctatgacgtacactgcctctctaccacgtaggggattattcacaaaaggcgaatagtcggtaagcctggcactgnaagtggcatccagataaaaatcctgagaataaagnangaagcagnngagaaaattcaagcaagtagcngnaggcatatnnaagtgctgtcggatgctaagaaacgggacatctatgacaaatatggcanaganggattanantggtggaggacggaggtggaagtcatnttgacagtccattngaatnnggcttcacattccgtaacccagatgatgtcttcaggganntnnnnggtggaagggacccatntncattngacttctntgncnngncnnnnagaggncatnctntagggactcgaaggggtccccgaggcaagcagaagccgagggacggggtcgttacacatctgacgttcagtggatttccgtctttcggaagctggatccactactaaagcatacagcgaaaacaacatccaacgggctcaaccacgcggccacaggcgggcacctcacgtaccaccactcaacccaacgaccactatggatgggcccctgcgccctgggcacacactacaaactcgaacacccacacccgcacaccacccaaaacggcacaggacagcacaagaacactagacaagcggaaccgacgcagcacacgaccccgaca

SEQ ID NO: 688645 - DNA, 260 bp, Homo sapiens
cagtcctctttcaatccatgggtagtctttcaattaacttgggcttaaatttctgtcatcaatcttttataattttgtcgtgtctaagtcttacacttgtcgggttcagttagttccaaagtagttaatttgctactgtattttaaatttccctttcagacaattcatcgttagtgtcaagacatagcaatgatttaggtatgtcgatggtgtatcctacaactttagtaaatttattatatagtcagtccttcatatcc

SEQ ID NO: 688646 - DNA, 197 bp, Homo sapiens
tcacctcggttaaatcatagaggccacggacatgaggttagactttcgcaaagccgctgcctgtcagaacacgcccagctcccggcgccagagcgccacagcgagttcgtcaccagcgtgcagggcacaggtagaggagagcgggctgccacgctgcatcagggccagtgccacgatatgtcacaatggagggcaag

SEQ ID NO: 688647 - DNA, 661 bp, Homo sapiens
acacctacaaatccaatccaaggttcccaaatcggcccgcacatcctgagcggatgcttaatcgcggttgactcggggaggtccccgtttcttggaatactcgatcggtcgcctttgttttaggagtaatgatttttcggattgatgttgcttgctgactttcttagtaggtgtgggggtattatctccgtcgtgcgagactagacctcttataatgtgttggagtggatcccgttcttggtcgcgaggaggcgtaagtgttttgatttttaagatgcccgaggttatgggagttttatttcgttttattttgaagtgacttctctacctggtgctgtgaagtgtatcgtattcattgttatgaccgcctccctcgagtatttttcgctgtttttgggttgtgtggtagccgatgagttcgcgatgacgtatgcttagcggataccgtaagtgtttggaggaggaatgggtggttttggtgttttttactatggttttgtgaagacgataagctatggagagggtgtctgtgggtcgagagatgtttgaagggctttatgttttgtgaataatcgttggggatagtcttcgaagtgtggagtgatttgcgcgggctttgttctcctagtgaagggtttttgttcgttttcctgccgctcga

SEQ ID NO: 688648 - DNA, 710 bp, Homo sapiens
gcgggggcctgtgcccgaggcgccggcggggggtcctgtgcacgcctgtgacggtggtgacgcctgctggagaagctggcctccatgctggagactctgcgtggagctggcatgggaggcctggctcgaaggcagggatggcctggcatgtggtcctgtgctgcctgcatccatgatgctggcctggtgctgctcttgatgtctgcatgccactgacacgcaccatgcaaacacctttgtgctgcatgcttgcgtggccaatggctgggatggctgctgtgtagctctgcactgccaagcgccggcccaaggatgctgctgctgtgttgctgcctgaggcaggcccatggtggttgcatgcgtgcttggatgtgccagaccactgtgtgctgcttggttggctggctgctggtgaatgctcgcacggtatcttgcgtcttacaacggacgggacgtgggtgaaggttccctagcccatgctgctttccacggaaggtgcatcatgatgccgcttggggccctggcgggaccaagtcctggatgcttgtgggccgcgagaagccagcgttgggaggtgcctgaacgtctgcgcaggaggagctcggggaactgagcggacgcctggtggaagtccaatggtggccccatgacgggcttgctgtggtgcaaccggggatttgccagaatgggtacaagcagccctccggaag

SEQ ID NO: 688649 - DNA, 1593 bp, Homo sapiens
  misc_feature (1113)..(1113): n is a, c, g, or t
ctccctgtccctctctctccccttggggggaattatcttctcttcgtcaggctctcgtccttctatgttgttatttctctccctctcccgtcttgctgcttcttacatatggggggcgcccacctctttgttagggagtgtgctcgtggggccccccctgatctgcccctcgtgagaagtggttcttcctcccttgtaatggccccccttttttgtcgatagttgttgttgtatagaaaaaaacacagggaaaaaacgagggggttgttggtcccctctttttgcgggagaaaaattaccacacgatcctctgtgtggctttgtgtaagggaaacagtctgcgggcccacaacttcttttggggcctggggcccaacccggtggtgttaaagaaaaaaagggctgtgatattagttgtggccccccccggccgaatgtttttctagaacaaccccgtgtaagaaagaggggtcttttcccccataagaatggttgatgtttttaaaacggccgccaatgagtgtcttcccccgaccgcgttgttactctttaaaaaagggggggtacaaaaaaaagatacatcctcgcggagcacggtgctcagtaagaacaacccctgggggtaggagagatggtgtttatataatgggggagaaacaccacccgggggttcattagagggcgcccccccctttgtcgcgacgagagttgtgctgtacttctctccagggggccacccctggtgtgtcgcgacaatatttctctcgtgcgctctcgcgccgctatattattatcctctcgtctctgttgtgtccccccctgtccgagagatatatttttgtgggccctctttgaatatacagcagaaattatatgccgtatatcctgatatagagacacatattcccacacactccctcatatatagagacactcttatacacaccgcacacatttgtagaacacctcgcacaaatatctctttcttgtagagaaaaagggcggggggtcctttcttataaaaaagttataaggtgtgtgagatatcttttgtgggagaaaataaaagcgacacacactaaggtgttttcacacacaagtgagatttatacncacacagagattactacatgagcgtctctctttacacacatgggagagagactctgtgagagatatatgtgtgtgtgtgtttgatgagagagacacacacctgtgtgtgtctctctctgtgtgtgtctctctctccacacaagtggtgtgagagtgacacacacaaaatagtgagtgtacaccctctcataagtgtgtggggtcacacacattctaatgtctcatttctctgtgcacataaaattatgaggagattataaaggtttgagaaggtgggaaataacacatcttgagacttttaacacggcacttcttacggggggagactttttatatgaaataacacctgagaacctaataccacaagtgagttttatgagaaaacgtttaaaaatacacagagattttttttattttttcccaccaccaacgtgaaacaagatttttttaaataaaagagtttatgtgtttacctggtta

SEQ ID NO: 688650 - DNA, 145 bp, Homo sapiens
aaaaaatttttttttgggggggggggacaaaagggggccctttcccttttttccccccaaatttttggggcccccggggggtttcccccccccccttttttcccttttgggggggggggggataaaagggggcccccccggccca

SEQ ID NO: 688651 - DNA, 413 bp, Homo sapiens
gcaaaccccgttccgtagttacagacgaagagccagtagtatccttaatcttagctcagtgcatacatcagtgatactttccaaaccgatatctctgataacagagtgttacttcatcagctataagacactctggtacctctgtttcccatttccagattaccggatttctgggatacttcgtaaaaacactcaggcagagacagggcacgaaacaccggtgctcacagagtccagagtcataatccctgcaggtctcttgatcccctgggtactggtctctctatcactgactttttcttctgaatagcccacattattattttattttgtctggtgttcttctgagatggagtctcgctctgtctacccagactgaagtgtagtgcccgtatcatccacattagtaccga

SEQ ID NO: 688652 - DNA, 277 bp, Homo sapiens
  misc_feature (43)..(43): n is a, c, g, or t
gggggcaagcccgggcccttttgggtttttaaacaaagctccnttcccccccccccccgtgaaggttttttcctttttttattgtggcccgggcccccccctccccccttcccaattgggtgggtgggttggggcccccctttttggggttttttaaaaaaaggggggtttttttttttccccgcttttgggtttttgttggggcattttttccccccccttttttccccccaaaaatacatttttttaaaggcccaaaaacgttgggttgcattta

SEQ ID NO: 688653 - DNA, 265 bp, Homo sapiens
ttttagtagagacaggtgttcacatgttggccaggagttcaagactagcctgggcaacatggtgagacccctgtctctacaaacataaaaataaaaaaaattagcctggcatggtgcacacccgtagacccagatactaggaagactgaggcaggagtatccttgactcctgattgaggaggctgcagtgagctaagatcaggccactgcatttcatccagcctgggcaacagagtgagaacccgtctctaaataaataaataat

SEQ ID NO: 688654 - DNA, 380 bp, Homo sapiens
  misc_feature (113)..(113): n is a, c, g, or t
  misc_feature (203)..(203): n is a, c, g, or t
  misc_feature (275)..(275): n is a, c, g, or t
tctccctgaactggttattatatttcctcacttgaggaattcatactacaaaaatttggggttctccagtggagaagaatggaggaattagcctaggcaaaacaaaaacctcnaagtgctgtcatggagaatgtagcaggagaaaaatgactttggggaaaaaagacctgagagagaaagatatattaaatggggtaaaaganatacaaggagagatgatgtggattatgcagagggtctatcactgagctggtagggggcatataagcctgagnacaaaccttgaaagtaattacaagaagaaaagaatctccaataattagaaagagtctggtatttcatagccctaggagcaaactggttggtttgagccagcatac

SEQ ID NO: 688655 - DNA, 896 bp, Homo sapiens
  misc_feature (97)..(97): n is a, c, g, or t
  misc_feature (174)..(175): n is a, c, g, or t
  misc_feature (183)..(184): n is a, c, g, or t
  misc_feature (199)..(200): n is a, c, g, or t
  misc_feature (209)..(209): n is a, c, g, or t
  misc_feature (218)..(219): n is a, c, g, or t
  misc_feature (227)..(227): n is a, c, g, or t
  misc_feature (231)..(231): n is a, c, g, or t
  misc_feature (233)..(233): n is a, c, g, or t
  misc_feature (266)..(267): n is a, c, g, or t
  misc_feature (269)..(269): n is a, c, g, or t
  misc_feature (283)..(284): n is a, c, g, or t
  misc_feature (318)..(318): n is a, c, g, or t
  misc_feature (329)..(329): n is a, c, g, or t
  misc_feature (332)..(332): n is a, c, g, or t
  misc_feature (339)..(340): n is a, c, g, or t
  misc_feature (346)..(347): n is a, c, g, or t
  misc_feature (363)..(363): n is a, c, g, or t
  misc_feature (367)..(367): n is a, c, g, or t
  misc_feature (377)..(377): n is a, c, g, or t
  misc_feature (398)..(398): n is a, c, g, or t
  misc_feature (405)..(405): n is a, c, g, or t
  misc_feature (410)..(410): n is a, c, g, or t
  misc_feature (414)..(415): n is a, c, g, or t
  misc_feature (419)..(419): n is a, c, g, or t
  misc_feature (486)..(486): n is a, c, g, or t
  misc_feature (543)..(543): n is a, c, g, or t
  misc_feature (574)..(574): n is a, c, g, or t
  misc_feature (623)..(623): n is a, c, g, or t
tgctagtacgaggctgggtttaaatcggccgagggcgcaggtttccttagctgagggggcagctccgcggcggcgttcggggtctccagtagggctnacgctccggtgctcgcacaatcccccgcctcggctggcaacgggcgtcctccactccccgagtcccggcagccgccnncacccagnngcgccccgatctggnnccctgcccnggaagatgnntgccgtangccngngcccgcagttatagccgctgcctggtgcagctnncntccgaccgagaacnnctgctaagctccgcatgcagagacaggcaggagntagacacccgnganacaccanncacccnntcctccggggggcggngcanagggggcacnggagagcccctcgagcgcagnaggccgncccgncagnnatgncagaagctgaggaagatagtcattctgatactgtcagagcagatgatgatgaagaaaatgaaagtcntgctgaaacagatctgcaggcacaactccagatgttccgagctcagtggatgtttgnacttgctcaggtgtaagctctagcaatttanaaaatcgaccttgcagagcagcaagaggctctctccagaaaacatcggnagataccaaaggaaaacaagaacaaggcaaagaagacaaggctcgagaactcttcctaaaagcagtagaagaagaacagatggagctcttctatgaagacatccaagttatcgtaagggcaatgaacttgtactgatatagagtacagataattataccgggctcagatgtgatgcgtggaaaaagtcttgcggtatgaattggcagccaatggaatatagttatacagagaaacataagattggtactgttactattgaacaaaatataaga

SEQ ID NO: 688656 - DNA, 207 bp, Homo sapiens
gtagtctagggcgtacgtgtatgaatgacgaacggacataccaagggacagacgttgaaatcatatagaggttaaactctagcaagtatagaaatctgtttagtggaatggagtagcagctaatctttaagacccatggatagcattttagtagtagcacttaacatacagaaaagaaaaacaaatcatccagcttctgatcttcga

SEQ ID NO: 688657 - DNA, 137 bp, Homo sapiens
  misc_feature (30)..(30): n is a, c, g, or t
  misc_feature (126)..(126): n is a, c, g, or t
ttcctgtctgcatgaatgataacaataagnccaagtcatcaataatgcaatgaaaattttttaagtgaaagcaagtttattaagaaagtaaaggaataaagaatgcctacttcataggcagagcancctaaaaaaaa

SEQ ID NO: 688658 - DNA, 328 bp, Homo sapiens
  misc_feature (2)..(5): n is a, c, g, or t
  misc_feature (60)..(60): n is a, c, g, or t
cnnnntcgcatcctatcacctaaatatattatgctgtggaatatatactttggaggaganagtgtgctcagaacttagacgggattgggtaggccaagtatgctaagtgtacaagtatattttttatttttacaccttaaacaaagaaatgtggtcactaaaaataaaagtatatatataggaattaatgtactcttgctttgtcaagctgttggctataagtttccaaggtattatgttactctaactctaaaaagtgatgtattctgttagcaatgtagtatttcaaataaaggcttttacataatagatttagggttgatggggt

SEQ ID NO: 688659 - DNA, 170 bp, Homo sapiens
atgtatataacgttggaacacacagtaaccctgttgaagatattaactggatgcagctttagcacggatcctgatgaatttagagcgaatcatcagcctctggatgtcaaaagtaacaagattcatgtagtgcacagtgggctcacatttaacgaccgtatccgcaggaa

SEQ ID NO: 688660 - DNA, 234 bp, Homo sapiens
  misc_feature (232)..(233): n is a, c, g, or t
cccccccccccccaaaattttttttttttcccgggggaaaaaccccccctttttttggggaaaaaccccttttgggggggatttttaaaggggggttttttcccccccaacccctctgggaaaaacccccccggggggggagttttttttttttcccccccccccccttttcctttaaatttccccccccccccccccctttgggggaaaaatttttgggggtgttttcccnna

SEQ ID NO: 688661 - DNA, 868 bp, Homo sapiens
tgtacgatgttctaagaggtgattactacatatgcatgcctgtatcaaagtatttcataggccgcggtgtggtggctcacgcctgtaatcccagcacttgggaggctgaggcaggcagatcacaaggtcaggagattgagcccatcctggccaacatggtgaaaccccgtctctattaaaaatacaaaaattagctggggctggtggcgtgcgcctgtaatctcaacactttgggaggccgaggcgggcggatcgcctgaggccaggagttcaagaccagcccggcaacatagtgaaaccccatctctactgaaaataagaaaaattagccgggcatggtggcgtgtacccgcagtcccagctacttgggaggccgaggcaggagaatcacttgaacccgggaggtggaaggctgcagtaagcagagatcgcgccactgactccagcctgggcaacagagtgagaccctgtctcaataaataaataaataaataaataaataaataaacataaaaatacaaaaattagctggggttggtggcgtgtggctgtagtccagtactcgggagggtgaggagaagcatcatttgaaccgggaggggaaactgagtgagcaagacggcagtggatccagctgctgtagggattctgttccaaaaaaaattttgtaaaaatcggtcccatattatatactatatgactgggaatttaaatacattacaagaaaatgactgtggcgtcgccgggaatttaacttttggggggccgagaagaaggatggttggaacgaaaatgggtcaaaggggggggtaaaaggtggggaagacagaaacaggagagtgcaaggaagtcacttctgtctgcctaa

SEQ ID NO: 688662 - DNA, 430 bp, Homo sapiens
ctcctagctgttgttagtatgtgcgctgcatgtttccaaattcgttaccctgacaacccggagaaaatgggctttgtgagaggtctttgacagtatgggaaacccataacagcactttcggttaggcctcctctccatacttcttggttcttgactgcgttccaatttattacgggggttaaaaaatgaatagtgaataagtgagtgtgcccttctatgatgttgactacccacccagagtaagtactgatctgattgtgaggagagtggagaaggtggtatagaagctgaaagggttaaaaatatgggctccagtgaacctggggaagtaattaatcactctgagcatcagtttcctcattcataaaatgaagattgtagttgcacctagttcagaaggttgttaggattaaataaggtaatcagtgtt

SEQ ID NO: 688663 - DNA, 775 bp, Homo sapiens
gctggtacggcgggaatgtagggatcgcaccatcccagaagctgctgttagctcgccggtctcggcactgccgaccgttcagcccctgggctgtccgcccttcccctagcgttacttccggtccctcgcagatgggggttcagtgcggctcccaggaggcgtgaaccgcggaccatgagcgtgggcgttcatcggggccggtgcagcgtggacctatgactcgtggacgcggggcgtacaacggcgcgcaggcatccgtgtgggctcacaagataatagccagcgtccccagaagtgaacctgcccacggtgtccgcgctcaggaagatgggtgtgaaccgtgacacgcagcaacaaggagacggtgaagcactagcgtacgtcctgttctctggcgtgtgcaagccactgtatcatccccttcatcctggatgagattggggccgacgtgcaagccagacacatcgtggtctcctgtgcggctggtgtcgcacatcagctctgtggagaagaagctgatggcattccaggcagcccccaaagtgattcgctgcatgacgcaacacaactgtggtagtgcaggaaggcgctacgagtgtacgccacgggacacccatgcacctggtggaggatgggcagctcctgtgagcagctcatgagcagcgtgggcttctgcactgaggtgggaaggaggagctcatacgatgccgtgcacggggctcagtggcagcgggcctgcctatgcattcatgggtctggacgcattggtgatggt

SEQ ID NO: 688664 - DNA, 359 bp, Homo sapiens
ctggaatcgagcactcagcagactaaagctgaatctcaacaccagatatagggatctctgtgtacatcaataatctgtttgagactgatctcatgcctgctgcaatatagatttatcgagacacaaatgaaccagcggataccaagaggtctcatatctatgggagtagacagatgatactggagacagaggcatcagacgagctcaaacggtgtgaagatccacgcttgatgctcatgggtttcaagccgctggtactgctgaagcaccattacctgacgcactcaatgtgtgagcacccagagtagcacatgtggattgtgagcttccttgttcagcgctcagctgatcaggcggcg

SEQ ID NO: 688665 - DNA, 112 bp, Homo sapiens
aaaaattccccccctgtttttttttaaagggacaagaaggattggggttaaaaaaaaaaataagttttttcccccctcccccaaataaaaaccccaaagtgttgtgttggga

SEQ ID NO: 688666 - DNA, 174 bp, Homo sapiens
tctagaggatccgcgttatgtctgacccaccagttctcgttcttctagcgtgaagattttgcagagcagcccaagagaaggttatattcccagaggatgtcagtcccaaggaccagtagctgccatcaggtataggattctagaaaactaatctggcatcaagcactggagatg

SEQ ID NO: 688667 - DNA, 142 bp, Homo sapiens
acaactatgtgactatgctggaactctgtctttgactcaatggcagaagatggatgggagccagccttaggagccttccagaggaaggcccatctccagcagtcttctgccttgatcgaaggactgtggcgcagcacattca

SEQ ID NO: 688668 - DNA, 168 bp, Homo sapiens
aatgcagcggactcggagctcgtagttggactgggagcgggcgggcggtccgcgtgagagagccacctgctgtcccctgcctttgctctcggtgccccctcgatgctcttagctgagtgtccctgggcccgaagcgtaaactttgaaacaatcagagtgtccaaagca

SEQ ID NO: 688669 - DNA, 625 bp, Homo sapiens
ataatactagcatttaccatctgacttctaggaatactgagtattgatcgctcacacctcatatcctccctactatgcctagaaggaataatacgtatcgctgtgcattatagctacgtcgtcgaggtaacccgtcaacacccacgtccctcgttagccaatattgtgcctatagccaatactagtcttagccggctgcggaagcagcggtgggcctagcccgtactagtctcaatctcgcaacacatatggcctagactacgtacatagaccgtaaacctactccaaatgctaaaactaagtcgtacccaacgaagtgtatattactaccactgactatgagctttgccaaaaaagcacagtaatttgaatcaacacaaacacccacaggctaattattagcatcatccctctactattttttaagcgccaaatcaagcaatcatacctatttagctgttccccaagctttgtaccgtccgaccacctaaggaaacccgctgcgctaatacgtaactgacgtgattcctagccctcagaatcatgggaaagccaagccagtatccagtgaagcagtatcacgaaaaaagtctactgctctatactaatctcccgagaaatcgct

SEQ ID NO: 688670 - DNA, 369 bp, Homo sapiens
aggcgggggcccccccaaaccccgaggccccggaaaccgacggggcgggcggcaggcagcgctccttcaacagtaagccccccctttgggcagcaaaactgtgggtgacatgatttttgtaacggcctcggcccgctccccccccctggagttttcccaggcccccatttgtttttgagtggccaaaattatgccaggctgccctataccctggggggttttgccctgggccatgcccccccgtttttccattatggcaaaaacctcccgtcaggacctgacccgtttttgttttaggccgggtcaacagtgcagcctggtccctggggggtgggccccgggtccttaataaacccgccactccctcga

SEQ ID NO: 688671 - DNA, 860 bp, Homo sapiens
aggcggcatcgtcgatgcttgtgtcaggagtgacgtgccaccctcaaccccaatgagggattgcgcgcttcggcagttcggaacatctataacattgtttactctcaacgcggtagaaagtggaagttgccttctagactgatcattgctgtaaaagccgtgcagcaatggacggtgcttgtatctcgaagccgcgagaccctgggatctgtaccgaggacatccctgagtctgtcaggtcttcttgagttcatactgtggctgccgtgttacacaggcgcacccgtgtgcactgtaactttgtgtgctcaagaaattatacagaaacctacagtctgttgtaaaaaggatgctcgcaccaagtgtctgtaggcttggggagggatcgtttctctgtttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaagggtcttgtcttcaacctcccccgtccgttgtcccattttgctccggtgagggtggccaattcccttttctttcccttccattctcaaggctctcctgtttccttcagggtccagtatgccttttgagtttaactgtaaaagggaccccgggaattgacacagtttacacagtggatgttaaaaacgggggtgggtgtaaccgtgtttgggtgggataaagaggccggagaggtggtacccgacaaaggtggtcgggggcgtccaggaaaagggcacagagc

SEQ ID NO: 688672 - DNA, 404 bp, Homo sapiens
  misc_feature (371)..(371): n is a, c, g, or t
aaatgccagaggggtttgacatgtggataagggaataaactcgctctttgaggtgtttggcagagctgggtggtgggctctggttgaatttgaggaagtagtttttaaaacccataggctgggtggccttgatgttggcgagagctctgtcactacaagtttaggcagaggttcacagcccttttctgatggagctgggaagggttagcagattaagctcagttaacttctaaatctatagttcccaaacttcagggtgcatcagaatcacccaggaagcttgtacaatatgcagattctgcttatttaagcagctccttggatgattgtgattcaggcctcactttgagaaactatgctttatttttttnatttttttattttttgagaccccgtctagggga

SEQ ID NO: 688673 - DNA, 289 bp, Homo sapiens
ccgtttccctaaatctcgtaatcctcatcgtcctcatctctgaggcagggaagcacatgcagcatatacatcgactgctgatatcaaatatacatcatcatcctcatcactcatcctcgatcaatcctcctcatcctcctcacatgacataccatcagaagacaggcaagaaggctgctgcaacctcagcaaagaaggtggtcagtttccccaacaaaacaggttgcagatgccacaccagccaagcacgcagctgtcactccaggctacaaggcagcagcaacacctg

SEQ ID NO: 688674 - DNA, 1043 bp, Homo sapiens
gaaacccgtctctactaaaaataagaaattagccgggtgtggtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaaagcccacctgaaaccttgatctctttccacttttgttgggcccttcgcagggggaattactcgagcttgtgggttgttgtacatagtgcctttcccctctatttcaggggttgctgtctgagggggtgtttattttgtatgtcataacttggtcttggtttacaatctacggtttaagagagcggcccagagtttctgcagccatttggtctcctacttcgtgggttgaaatttttttccccccccggtggcacgggggaccccaggtggttaagaccgcacatcgggaagacaccgcgggatgtgcggaagggggtgacgggcgtcccccccgtgctgtgatacaataagcgccagggaggggtttaaggcctccagcttttaaggggttgtgacgccccttgtgggggggttcagggcaacctgtgttttgcccagcggttccacgttgttgcttttgtgattgggcgcccaccgggcggcaaacgaggcagggatgcccgcccaacgttcttccccagaattcgcccgtgtggatctcgtgggccttatacagggggcggctcgaaaagccttgttccctcaccgcggtctccgcgggttttggtggcccccgggacccccttcgcgtttattttttgcccccctgttgggcaaccggggtagttgtccccaagaacagcaggaggaggcggcagcggagagcacgttctttggggaccggccggtctccatgttgtgcccggcgttccatattcccttttgtgtggggtaaccccggtaaagagtaccccccttttcacgtgggtctggcccttaaattggggccatggtttccatccgtgggtcc

SEQ ID NO: 688675 - DNA, 132 bp, Homo sapiens
tatgagctgaacattgggtggtgcccactggttagctcagcttgtgggtgtgacctgagtgaacttcagtgtcagttggtgcatgaatagtggttactgcagtctgaaccagtggctgactctctccgcttg

SEQ ID NO: 688676 - DNA, 156 bp, Homo sapiens
aatcctgacgggttaaaaaaagtaaaaggaactcggcaaatcttaccccgtcctgtataccataaacatcacctctcagcatcaccagtactcagaggcaccgcctgcccagtgagccaagattacaccactagcaccccagccattggcgtacaa

SEQ ID NO: 688677 - DNA, 279 bp, Homo sapiens
  misc_feature (8)..(8): n is a, c, g, or t
  misc_feature (50)..(50): n is a, c, g, or t
  misc_feature (62)..(62): n is a, c, g, or t
ttttgtanaatcttgctgtttcccccaggctagagtgcaagtagcgaaancatagctcactnagtcttgaactcctgggctcaagggatcctcctgagtagctgggactacaggcaaatgtcaccacacccaactaattttcctatttttctgtagaaatgaggtctcgccatgttgcccaggctggtcttgaactcctgggctcaagggatcctccaccttggactcccaaagtgctgggattacaggcatgagtgactgcgcccagcccaccccacc

SEQ ID NO: 688678 - DNA, 1348 bp, Homo sapiens
  misc_feature (1348)..(1348): n is a, c, g, or t
gagttgcgctggtgaatagcgggctactgtctgggcgacagcagctgccgcggaccagagggccggggccgtggggcgggatccgcagtcgggagtcgctacctccgcttcctcggcttctgcgcctctggggctgccgcctttgtcgggccatggtcccgaccgacggctcgtgctcggagaggcgtcacatgaggccaccagagcgtcgcgcgagtcctggtggagcacagagaccggctcgagagttcgcaggcggagaccgacgaatgggtcgtaacaccggggcattgccttagcgattggcgcgatcggcaggaccagatgagcccatgtgtcgggtaagagagattcagacactaatagtactcggtaagggcatcaatctaggctcgcggggcgcagacagaaagagcccgggcaagggatctactgagcatgaaactgggcctgggttggagccatacagtgtaaacctaggaacggatctcctttggtagaaggacgtgcttgaaaacatctccgtggatatttgacatttgatacggtgggtaccccaggaggtcgcacgtaggaaaagcccatgggctcttggggatagcccctcgagctttatcattcgggtttatcgggacgtttctagtgaatttgggcgggcccacaaaggagggacaaagccaaagagatcactgcggtgcgtcgtcaggaataccgtgaagagcgtccctttgggaccattgtattcaagcaatgagtgctcgggagacaccttgctaaactcagcaactattactgggggggcctaaaaattccggctaaggaaagggcttgatagggaatcttccgattcccgttggaatggaaaaggagtgagtcccgtggatttgtgggagatttatcactcaagatctaactcgaagcttcccctgtggaaaggcaataagccaaggggcaagaaacaccagaggacacggagaaaaaacagcccttttttataatcaaaaaagccccaagttatcatttttcacagaattgttcccttggtcggagggtatcccaaggtaagtaaccgggaagcaaaggttgcccccctggtgtgcccagagaaggccaactgaggttgtggaatcgggtccacacggaacaaagtgttcccttggtgcgataccacgacgggccagcggcgcaacatggctttgggcccacagctataccacacgaactggagagagatcttccatctccaggaaagcccacaggagacacagaggtggcacacagcatcctgggggactgtctggagcaccattttttccacgaacaacatacctcgtcacacaaagaggcn

SEQ ID NO: 688679 - DNA, 941 bp, Homo sapiens
acggcggcaaattctgcagctgctcattgaggacatgagctggcatctttcccggtaggactgcggtcacgtctgtagccacgcactaaggacctgggtaggcgtcatgaccctgggagcagcggcacagctgcgactgcgtatggaggacccaggcaggctcctcactctgccgatctgcagcgcgcctgtggtttgtgcaccaaggacccacccagacaggcgttcttaccctgtggacagcggcaactagctgggtgctgtgcaccccgagagatccagctgggtcattcttatcctgccgcaacgtgtggtctacgctctgtgcgtctagcgtagtttctgatgcgtgtggtacatggctagctacagctgcggctgaccactacggacccagacgggcgttcttgccttgtagacttgtgtgccacggggcgtgttggcgcggggcaacccacgaatgcagtgctgaagtgtattaccctgcgacttggcccaacacattgctgcgcagccaggactcaggctgggagtccttactctgaggtggagtccttaccctatcggactgtggcacaactgtggctggccaagaacccaggtgggcgtcttaccctgcagaccagtggcaggcctgcgcatggtcggaactccggttgagccgtctcatcctgtggggccgtgtttactgttgcctgctgtgcccttcaggaccctgtggggatcgcggtgttgtgggtccccctctttggcggacctgtgaatcccgtggccaggtttcacggcggaccctggccaggtgtcttgctttgtccccaacgcaccggcctctcgtgcagaaaccaactggacggtaaaggccccccttgatgaacactcccctgactgaccggggacattgcccggccactgttggtacccacgaggcactaccagggccc

SEQ ID NO: 688680 - DNA, 225 bp, Homo sapiens
cagactgcgaggaattatgtcggggagaacatgtcttggaagaagcagagtaggggtaactcaattagaaaatattaccattacgttcgccatggaagttgtctcacctttgcagtggaatcacagtaagagaggctgtgaggatttgtttgccttccaagccacagcaaaaagcagagtttacagggcctggggagcaactgagttacctgagggcacggaaga

SEQ ID NO: 688681 - DNA, 494 bp, Homo sapiens
  misc_feature (64)..(64): n is a, c, g, or t
  misc_feature (121)..(121): n is a, c, g, or t
  misc_feature (182)..(182): n is a, c, g, or t
  misc_feature (226)..(226): n is a, c, g, or t
  misc_feature (443)..(443): n is a, c, g, or t
gacattccagaggtcgcccagctccggcgctgacggttgtggaccgcggacgtcgctgggacanccctccccgctgctcggcgcgcacctggcccggcgtcctcgctgcgcttcgctccgnctcctcggactcggactcgggtttatatcgcgcctcacttcatcccagtccgggcgagcangttgggtttatgtctttatttgacgaaaacgagctgttcacagnattggtacctgtattggggaaacatagcatacaagcaagaagcttacagcctcagtggcgaaaattttttcatgtcagagacccgagaactcttgcagtccgtttatgtcatcccttcttctccaagacagaaagataccaaaaaagttgcaatcaaagatctcttcatcttattgataaagcactaataagcaaaatgtctgtaatgtcaccgcancgtgtcagacagtctatggtacaagatgcccgtctgattgcaaggtgaggc

SEQ ID NO: 688682 - DNA, 129 bp, Homo sapiens
aagaactctcaggacgttgcacgttactgtggggcgcacagcacagatggacgcaggtgctggggctccagtgcagttgctgccacacccgccggggtcctaccacactacacgcagaacgcgcctaat

SEQ ID NO: 688683 - DNA, 764 bp, Homo sapiens
tccaaaccattggctttaatggggttatatactttctgggcagctgtaaaatcaaaacctggggggaagccaatcggaaaccccgagaggcccagcgaaggagtccatctgaggtacagaacctgtggtgcttctgccatgtgttccctgtggggcaggggcattcccatttctccccctgtagtgctttttctctccgtgaagagaagctccaacagacgtgccagcccaggctctgaagtgtgcagagggtgggacctccgtgaacacagctcggggggattggggcagaggcaaacagcccctccgtgtgtttcacctgtgcagaacggggttgggccaaaggtgctagtggagcaaactgtgggttgtggtggaagccctcgtgtgtgtgctgaggaactcagctcccgtgcacacaggagcctgtgtgcgggggccagcaacgcatcgcagccgtgggaagaacagccggggctttcccatagcctcgggtgccaacaccccgcaggtgcaacaccaatggttccacctaacatgctcaggggcacaggctcaggcagcaaacgtgttccacccaccggggcaggagaacttgtgggcagaatctgatgtgcctggggagaccctttggttgagaggtctcattcaaaccaacaatgtgtccccattctggtggaagttccagagtcctgggatggtcttgccggaatctggggcggtccaggtggcactcgtgccctagccggtgcaatggtctgtgc

SEQ ID NO: 688684 - DNA, 146 bp, Homo sapiens
  misc_feature (64)..(64): n is a, c, g, or t
ccttcagaagctggtggtggcgtcctggaagagagactgcagatggtaatggagttatagccanaagatcgtatgtaagtaactttagaaatgtgtcatcgtgtgggtgtcacagttatgtgcttaaggactgctgagcgcccctg

SEQ ID NO: 688685 - DNA, 675 bp, Homo sapiens
agcggagtgtgctccccggcccctgccggaggcctcgcctcccggctcacctcccacccacctgccgctgcggctctccgcgggagatctcacagtctggagacagggtcgctcgctctcacggtaggctggacagaacgcgggctgtctggggcctctaaggaacagtgcccatgcatgtataagggcatggcgcgacaggaaaacggcaaagaaaggcaacgacacaacgaaggagggttccaaactgcaagctgtcctgcacgggcctgcagtgactcgcccttccattacagcactgcagactgaacggctaacgctactcccattgggcacatcgaggggcagggagagacgcccaagggaagcggccatcacgacggggctacaccaacaaatactggcaccagcgacggaaccacgcgcttcccacaagcagaaaaacgggtccccatagcgcgcaacccagcccacatcgcaataccacaggcccattccaccgctggggcacaaacctggcgccacacaaacccgtaacaacagaactcaccacatcggcgaaccaacgaccccaacagaccgccaggaccgccaccaacggccgacaacaccgccggccagtctggaggagacagcacggaaccaacgcagcccccactcaacacacgagccaac

SEQ ID NO: 688686 - DNA, 490 bp, Homo sapiens
  misc_feature (396)..(396): n is a, c, g, or t
aacgatggtcctcagcttcactagaagctgatggacaacagatttaaatccatattctttttttaagcagggctcagaagacctactctgtctaaggaaactatgggttccacatctattttgcacattccccaacacacacacacacacacacacacacacacacacacaaattcagagcatcaagagtgctaagtgtatctaagcacgagtgctaagtgggggatcccagagccactcagaattatcctaaccttagagcagggatagacggggagtgtatactatatatatatatacgtgaacaaatatatatattcctagagtcataccctatgctcaggtggggggacatttttctctctctctcttttcaacacaaagtctcactctgtngccgagggtggagtgcagtggtacaatcatagctcagtgtaacgtggaactcataggctcaagcaatcctcttgcctcagtctctcaagtagct

SEQ ID NO: 688687 - DNA, 613 bp, Homo sapiens
atcccagcatttgggaggccgaggtgggcagatcacgagatcaggagttcaatgactggcctgaccaacatgatgaaaccccgtctctacaaaaattcaaaaattagctgggcgtggtggcgcatgcctgcagtcccagccacccaggaggctgaggcaggaaaatcgcttgaacccgggaggtggaggttgcaatgagccaatattgggccactgtgctccagcctgggtgacagagcgagactctgtctcaaaaaaacaaaaaaaaatgttgggtcttcagaaaagcagccacagtatattcttagaccagggggagccattggggatctccctcttgggaggtgcagtcccagttctgggttggcacgtcccagtaaagtctccaggcagaagctctatatacaacttttccccacaataatccccggaaatgggggggactagcgctttcaagaaattctgggggggcgagtagaccccatccagttatttctagtatcccggggtgatgcccagcgactttcagcccatttggactgtcatatcggcttctccaaggcggctctgtgtttccctcaacgtggcttggcctccattggtttgtcctctg

SEQ ID NO: 688688 - DNA, 186 bp, Homo sapiens
gggaatggaacacacagctgagttaaataattctctccttgtgcctaagagaaggcatttacacacaggaaaaacaagagcattagaacgttcggggcaaaaacttatcaagttggaatatatctcccttcttcttgagaaacctacgcagtgtactacctatacaattccatgttctaacacaag

SEQ ID NO: 688689 - DNA, 487 bp, Homo sapiens
  misc_feature (445)..(445): n is a, c, g, or t
ccaccttggccttgccaagtactggggattataggccctgagccgcgtgcccggtcctcacccggcttggtagacacagttaacaaggtgtccccgatatttggggtatgtcctttggttctttcctattggaatgtatagtgcatgatgataagtgccagttaggtctggggagtggtttctaattgggcagaccagggtttttcatcttggcattaactattactacctttttcagcaggttggtaaggaaggcaggtctgactactagtggcagggatccggtacaactagacagggtacctaagcaaatccaagctttccctaggtgcctagaggggggagacacttcagatctggtgtggtatccagggtttttccaggtaaatggtctcaccagcggggagctgggagtagggcttgcaaagggagtttcctcaacagnttctttccacctccagcctgaaatatggggttgcaaactgtt

SEQ ID NO: 688690 - DNA, 184 bp, Homo sapiens
tgccatacagatgttgtgctcaattaccccatgtgagtgcgtgactccttgggagctcctgctccctacagggggctgcaactcctgtacttgaagctgagacctcatatgaggtggccttcgtgtggtcagagagtgtctggaagctgctgtggccatcttgaacaattcaccaacctccaag

SEQ ID NO: 688691 - DNA, 365 bp, Homo sapiens
  misc_feature (94)..(94): n is a, c, g, or t
aagggttttttccccccacatttcccgttggggtggggaaccatgggccgccgggaaaaaaattcaaaacccccccccccggggtgggatcccnggggccctttttttttttttaaaaaaccccccctgggcaaaaacagggggggggggggggacctttttttttttcccggggtgggttggggtttggcccacccccccccccaaaaaaacctttcccttttccccgggtaatttgttgggggggcgggaagccccccccccccggggtttttgggttgcccgaggaatttttggccggaccccctttttattttttcccgggcccccgggtgggaattaagccccccccccccccctgggga

SEQ ID NO: 688692 - DNA, 400 bp, Homo sapiens
taaagcatttgtgatgcgctgcttcagtgcctccggatatcaccgcatccactctcatgtagacagaaatctttatcttccccgttccaggtctctctcgtcatgccagtactgaccttatctataatcattaacacataataaagaaaatgcgatcctgtgaacaatatattatcatagagaatttgtggagtactgaacaggtccctcatccctcacccagagacttggtctccttcttccatgcttgatgtgtcctcgtctccttcaaagtcgtggctgtttcgttcagcttactgcagccctggtgtcatcagccgtcgggtcgtcttcatcaatacccagaccaagtttgatcatcctgtagatcctgttagcatgtgtctggggatcttccaga

SEQ ID NO: 688693 - DNA, 257 bp, Homo sapiens
cttttccaaagccccacagagtagcacacagtgtatcccgagtccagaagaaaaagaatgagaacacctaacttcaccgactagatgaagaagaatgtatgtcagggtaatatgcctgctttacaagttctaaatgaagattgtccatcaataatgcccatctggttgttcagccttattcttcaagaccattttctttaacaaatcacaaggcttcatctgcaccagatagcgatgtaggactgataccagcagat

SEQ ID NO: 688694 - DNA, 976 bp, Homo sapiens
ggtttccagcggtgtactcacggcaggttcttaccgtatgcttaagcgaggcttcggtctcctgggatttctgtccgggctcctgtgcccttcgtccttctgcgccagagcaggttgcggtgagcactcctcagagctctttctgcatgccctgccggctgctttaccgacagcgggctgagagccccgaggtatccataaatgagcctgctcttggaacaaactcaggttgagggagaccccgtgggaaccagcgatgtgaggcagatgacaactaccagacaactcgacaattccgcactgagagcgatatagcaagtaacatcgatctccgctgactgaatagccagttggataagtactggtactccagagggcacaccaattcttgaccggggagaactttcttaatagcagggatcactgggtctaatgattgttacggaaatgtctgggaagcttgcaagacagagggtaccatgaccaattccctaaatagtccccagtcatgatttgccacttcttggtggactgttggcttgaatagtacttgcttgggaacgtgacggactcggtgagcacaagttgtgttagcgggcattcgctagttgaatcagaagcagattgtccctagtagaataggttggggaaccgtcaagtcacggaaagcgcgaaggacgtaataaccaggagtcagcaacaaggcaattgacttgcatacgcatggtatgataaaaacccaattccaattttgggacattcaaagaggagattacccaaagatttatcaaggcctggtgcaatgagtaggaccttaggacgaagacatgggggcataaacgaacttttaaaaaggcatctaatggagaatggctgcgaattcggttccaccattcgctaattgactgcgtaatcgggaacattcgccgagagacggagtttaacatgtgctcagctgtgaatatacaggccatgg

SEQ ID NO: 688695 - DNA, 128 bp, Homo sapiens
  misc_feature (50)..(50): n is a, c, g, or t
  misc_feature (85)..(86): n is a, c, g, or t
  misc_feature (120)..(121): n is a, c, g, or t
gcgctggggtgtacagtctagcatcactacgtggtggacatcccgagctnggtgtctcgtctcctacaatggcctgtccttctcnncgtcaggctgccctacccaccggtttggcaacannacaccaa

SEQ ID NO: 688696 - DNA, 352 bp, Homo sapiens
  misc_feature (38)..(38): n is a, c, g, or t
tcctcttcaggcatgggatttccaaggctccgttttantgcacccttcagaatcgattcttctgcactcttgtttccttcctctgttaacttgatgccttcacttactgctatgtagttcactaaatcctatcatctgttcaagactcttagctactcttaaggtaaattaaggcttcctaaattcatatactttctaccatagacctgacagtgggttaaataacaaacagctccaggattattcaattcttcttaaatagccatgatttaaatgacaaggaaggatattaacttctgagaatcattaaaattgcacttcccccttaaatcaataaaaatatatttggtga

SEQ ID NO: 688697 - DNA, 436 bp, Homo sapiens
  misc_feature (285)..(285): n is a, c, g, or t
tagatgggagtctggctctggtcgccaggtgggagtgcaagggggcaatctgggctcacggcaaccggcacctccaggttcaagtgattctgctgcctcagcctcccaagtagcggggactacaggcacctgccaccacgcccatctaagtttggcatttttagtagcgagggtttcacctgtgtgggccaggcgggtttggtgggccaatggtctctaaactggcgtgtcaaaaaaagggggggcggatagggggcgccctttttttcacccaaagcacccggntcccatttggtcgggtaaaacatcagttacatttatataacaccatataattttaacgaacatttcacacaatgttatttcatttggggctccataatcattcagcttaaatttatcactcaggctacttaccagccaagagtaatctggg

SEQ ID NO: 688698 - DNA, 113 bp, Homo sapiens
gaccagaccagactgactgtgagttacgttgacacctccaagctggtgtttgatgggctgatggaagaaggtgacagcaatgcagctctaagagtcttagtttcttcttcctt

SEQ ID NO: 688699 - DNA, 186 bp, Homo sapiens
tatctatactgacctatctatactacctatctatactacccatctatactgacatatctatactgacgctcgggcgaggggggttcatagtagaagagcgatggtgagagctaaggtcggggcggtgatgtagagggtgatggtagatggtcagtatagatatgtcagtatagatgggtagtatag

SEQ ID NO: 688700 - DNA, 214 bp, Homo sapiens
tgtgtctacacaaacatcaagtatattataataactattagctttctgatcattccaacatatgtaattaagcgctcagattactctaaccagaaatataatacttgtataaaactaaccttttcagccaggtgagatggctcatgcctgtaattctcagcacttcagggaggctgaggcagggaagatcgcttgaggacaggcattatagggt

SEQ ID NO: 688701 - DNA, 252 bp, Homo sapiens
  misc_feature (160)..(160): n is a, c, g, or t
  misc_feature (240)..(240): n is a, c, g, or t
  misc_feature (244)..(245): n is a, c, g, or t
gctgactgggaccaacaagccacgcatgcgtcaagagtgagagtccgggacctaggcaggggccctggggttaggcctgagagagaagagaacctcccccagcactcggtgtgcatcggtagtgaaggagcctcacctgacccccgctgttgctcaatcncttcccaagaacagagagaaaagggaacttccagggcggccgggcctccgggggttcccaccccatttttagctgaaagnactnnggcagag

SEQ ID NO: 688702 - DNA, 456 bp, Homo sapiens
gatgatcgcaatcttgttggcaacatctagggcatcataatcaggagccaagcgaacatacgccttcttctctccgtcgggccttatcagggtattgactttggccacatcgatgtcatagagtttcttgacagcctgtttgatctgatgcttattggccttgacatccacaatgaacacaagagtgttgttgtcctctattttcttcatggctgactccgtggtcagtgggaatttgatgatagcatagtggtcaagcttgtttctcctgggcgcactcttccgaggatattttggctgcctccggagccgcagggtcttgggccgccggaaggtgggtgacgttcggatcttcttctttttgtggctgtggacgcctttcagcaccgccttcttagctttcaaggccttcgctttggcttcggctttgggaggggcaggagcttccgtcgacgc

SEQ ID NO: 688703 - DNA, 458 bp, Homo sapiens
gctaataaaaatacaaaattagccgagtatggtggctagtgtctgtaatcccagctactcaggaggctgaggcgggtggatcacttgaggtcagaagttcaagaccagcctgaccaacatcgtgaaatgccgtctttactaaaaatacaaaaaattagccgggcgtagtggcggacgccggtagtcccagctactggggaggctgagacaggagaatcacttgaaccggggaggtagaggttgcagtgagttgagatggcatcactgcactccagcctgggtgatagaacgagactcggtcttaaaaaaaaaaaaaggtgggatctaagtaagacgggatggctaatctaataagcaaggggatatggttcccaagagtattcacagacggtcagtgggggtccctgggaacaatatttacgtgggttcctggaaatttatctaaatatgaccctttt

SEQ ID NO: 688704 - DNA, 182 bp, Homo sapiens
caccatccaagcaatcaaagtgcactggtcccaagcaaaatccccagtctatctcagcagtcacttctcttgggcagcccattgcaagtggcacatcatcctggtcctgtacgttcacaaatgtccgcaccagcatcatttcacattgcagtgcaaacatcacaggcatgctcaagccgctt

SEQ ID NO: 688705 - DNA, 478 bp, Homo sapiens
acgcggaacaaattgcaatataatgtgataagttctttaaaagaggtaagagcaccgtgctttgggagcgtggaatagggacaaagcatcatcttgcctgcttgagccaggggacacagaatagaaccccactatctcatttaatctttacaactcttttgcaaggttccctggttgtgaaaatacatgagataaattatgaaggccactatcatcctccttttgcttgcacaagtttcctgggctggaccgtttcaacagacaggcttatttgactttatgctagaaaactgaggcttttgggatacgcccagaaattcctgatgaccgcgactttcagccctccttaggccaagtgtgccccttccgatgtcactgccatcttcgagtggcccaatgttctgatttgggtcttgaaaaaatgcccaagggatctttcctctgacacaactcttgttgaacttgtcaactcctcgtc

SEQ ID NO: 688706 - DNA, 362 bp, Homo sapiens
gtttttttttccattaaccaaatatccgacagaaatgcttgtgggaagataattccttttggctagagcttatactccacattgtgagctttttaattttctttccttggtggtgggttgggacccaactgtgcagttgcgggagctcatcacagtcctgttgctgggcaagttctccctgtgaatctgtgttttccccttgtacctacctaatgaaagccaaattagataaatttttaatcaaggagatgaatgatgagtttttccttagaaaagaaaccacaaggccccacagtactggatacaataaaatgtgaagtttttgtttgcatgtatgctgtttggcatggctttaatgtcag

SEQ ID NO: 688707 - DNA, 377 bp, Homo sapiens
ctgtaattacttaggaagaccaaatggcaccagagataagactcccttagatccccacttagatcaccaccctttctcagggggtaataaagtcatcttccttggaatgtagcaatctataaccaatcaaagcactgtaacatatgcactggtcttgtatggaaaatgttgtaatcctgctaaaattcctctctctttgcctgtggaagtgaaaccttaacttctccagtttggaatgctcaccccattcctttggagtcaatgcttactgggtggctattctcaaactttgcactcaaagaaactctatacttagtcttattttctgaatctcattatttaaggttgacataataaacaactaatagtaagtaaaa

SEQ ID NO: 688708 - DNA, 218 bp, Homo sapiens
gacctatgtggataatcgccccagccaaatttttgtataatagttactgcgcgacttttgataggcccgtgacgatcaccatatgagccacgaccccctgcatagtaataatcatatccggagccaccttgtggatcataagccatgccgccattgtgatgcactccatgtatctattgcagagtcccaagttgcatcagtactgaaaccaaccatgc

SEQ ID NO: 688709 - DNA, 473 bp, Homo sapiens
tgaaagacgacgaaggggctacataatggtaaggatgaatgcacaagcagagctaactattctacatatatatgcacccatacaggagcccccgattcataaaggcagttcttagagacctaccaagagacttagattctcacacataataatgggagactttgacactccccctgtgtcatattagacagaacaatgagaccgaaaattaaccagaatatatcggacttaaactacagctcttggaccagcagacctacagaactcagaacttgaactccgctttggaccaagcagacatctacacaactctcccacttcaaatcaacagaatatacatttcttagcagcaccacatacgcacttattctaaaattgaccccataattggaagtaaaacactacacacccggagtgccaaagaacggaaatcacaacagtctcttcagaaccacagtgcgatccaattagaa

SEQ ID NO: 688710 - DNA, 170 bp, Homo sapiens
catgaaaattgtcaaacccaccagacttttttccctcatctgcttcaactgttggctgcccgggacacgaatgaccacttcattctctccaaaaggcctcaacttttttttttttttgagacagagtcttgctcttttgcccaggctggagtgcaatggtgcaatctcca

SEQ ID NO: 688711 - DNA, 201 bp, Homo sapiens
aggtcttaccagtcaggatctatcacgaagatctagcatcccaggctctgagacggagcaccaggtgcaaggtggactcttactggatagttgtagtcagacagggtacgaccatacttccagctagttttccggcaaagatcaacctactgctaggtcaggaggggatagccttcctatgtcttggatactttgccttga

SEQ ID NO: 688712 - DNA, 403 bp, Homo sapiens
ctatttcctggtgtaaaaagcctatgataagactaaagtagggatctatttgactaaaccagttctggtataaccaaagagttatcctcacagtgaaccgtgcaagctacaaaatgggagaaaatattcgcaacctactcatactgacaaaggcctaatatccagaatctacaatgaatctccaacaaatttacaatgaaaaaaactaataaccccatctaaaaagtgggcaacggatataaccagactcttctcagaagcaagatcatttatgcagccaaaagacacatgagatagtgctcatcatcactggccatcagagaaatgcatatcaaaaccacaatgagataccatgtcaaaccagttggaatggccatcattgacaagtcaggaaacaacaggt

SEQ ID NO: 688713 - DNA, 190 bp, Homo sapiens
ccaaaatataaagaccaatgacaccatgaagaaattgcatcaactagtgtgtgagataacaagatagcatcatgatgataggatcatattcacacataacagttattaaccttaaatgttaaatggacctaaatgccccattgatggagacacagatggaaccgggcacagtgggctcatggccattaat

SEQ ID NO: 688714 - DNA, 433 bp, Homo sapiens
agcgggacggacgcttcggcgacgtaacgaatcgctgtcggacgtgctgatatcggggtgatagctgaaagacgtggagatcagacaagctcgtctgatcaatacagactcatcgatgcattcatctcatctgatgactcaatgttgacaaacgaactcaagtcatctgggtgaagtgtcgcgagtctgtgcactcagagctgattaaccctaaaggcttaaggaacgggcactgtaacagagacaccagcccctgtatagacactaaatgtacaagagtgtgagctatttctggtgaagtgtccaaaaaattggacgtgtggttaaggaatttctcgctgaccttgtaataatgttggagcatctgtcagtgcgatgaagattatattggtctggacagtctaactggttcgattgttgataggattgagtg

SEQ ID NO: 688715 - DNA, 570 bp, Homo sapiens
ccataattaacgcttagtcatagacgtccaaaagcatttaagactgattgtgcgttgaagtttataataaattatattacacatgtcttgcctatttggaggtaaagatatatgcttcgtcaagatatcacttgtgtcatccctctaaatataagatccaaatagctcagcctagagtgattctattttattattttgtacctgtatatgtactgtttattaaatcgatattgcttaggacagtataggctactggcactttagaataaaaagtccgccaaacccagacaaatggtttatgaaccagaggtatcctgtggaaagagtctatatgcatgagtctgtgcctctgtgtgcactcgtgaatgcttcttggtgtgcctagattttattgcacaaacctgagtatatctcttctacattgtcagtcatgtgttctgtaccttcttttcgtttccattgggcatgctatgggaaatcggtggattgcgtgtgtccatgcatcagtctttaatgaaagcttgaagaggtataggtcatagtcagagtatgtgggccaatggttgatat

SEQ ID NO: 688716 - DNA, 701 bp, Homo sapiens
tcgcaggtcaagagcaaggcctagaagtccgtggacaagcacagcgacgagtacaagatccggcgcgagcgctacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcaccacacggacggacgtccggtcaaaactattggcaactggggcacttggcagacgacggggagccacgtcggcgccgggcgggaccagggccacaggtttacgaagattgatgcaaatcaggtattaaaacaatggctgaacgcgtgatgtacacgggactgacgcaacccacgtgtaactgtcagccgggccctgagtaatcgcaattaaagatgttcctacgggcattgttgctgttgatgttttgttttgttttgttattatggtcatatatagtaatataaaaaataaatcataatttcataatgagaaaagaggcagtcagattccggagttctccgtcagcatcag

SEQ ID NO: 688717 - DNA, 366 bp, Homo sapiens
gtctagagtgatccctctctgactgaggacagatgcaagaagaggatggctactttgcacgtcagggagtctgctcggcgaacttgttctcctcagagaacgtgcagactgtgagagctgcctgccttacagggacttcagtatcagagttcttaacctgggtcctggaatccataaccccctgaacactgcttgcaaatgttataaataatacggacattttctggagaaggagttcaaagcttcctgcagatatcccaataagtcctttatctgaaataaattaagaacctctgccttacattcctcccgagatgtcgagtctcggtgggggctctgagaggctgggggtgaccccggcctttt

SEQ ID NO: 688718 - DNA, 425 bp, Homo sapiens
ccgtggatgtggggctttgtgagtgggcacggtcactgcttcatgtctcactttatcattcgcagcaacttcgtgtacgacgacgggaaccaacccctcgccatggacacgtcgtgtcctccatagaagccagccatccttctcctcgtggatgagcagagtgatgacatctccctgtgcaaagctggagtaaggtcttgtaggagcccggcagtgtgcgggaaagatgagtcttcacttgtctgctatctctcatcatgttcagtcccgttgcaaccgaaactgatcgcagtaaactgggatcttcggaagtacctgttgaattatttaccctttgtgaattcggggcaggcgtggctgggtcattacagcatatcgatcaagggactggtatatgctctgcctgaaggagcggggggcatctt

SEQ ID NO: 688719 - DNA, 310 bp, Homo sapiens
gggcgggggagagacgatcggctctgggagactgtgaagtgttttcatcctctgatgaacctggtgctggtaatgtcttgttcagtgtgaattctctctcatacaaaacgttataaatattctctattcagaagtctggtccacatgacacccaggaggcaatgtccttaaagacgcttgccggccgggatcacccatgggtgcgagggcccagtctgtgagactctgttgtggcgccattcacagcaagtccatcttgggtctgtaagtgcacgcaggagcggtgccttcttgaatctccacctagtga

SEQ ID NO: 688720 - DNA, 337 bp, Homo sapiens
ggtgtgaggaggagcaggctctggatcagaaccctctacgccttgctagctcagcatcccacagaggggtcttcccgctcacagccacagagggtttatcatcgcttatagagtaagagttacctacccgtgcctgtaggccatcaggtacatcccgggtgctgccacctcacacctgcgatgtccacattgtgaaccgggttgaacagaacgcagcctctagaggctggagaaaatacaccaagcatctgacacagatcacccttggactgtgggactataggctatcttcatttttttcttcatacttttcttggtttctaaatcggggatcctc

SEQ ID NO: 688721 - DNA, 219 bp, Homo sapiens
ggggccggcctttaaaaggccttttgggggttttttttttcccggcccggggtggggccccccccggggggtttggtgggggttttggggttttggaggccctttccccccgggcttggggttttttccccttttggtcccggccccggtttttggggggggggggttttttgctttcccccccccttttttttttttgtttttttgggggtttttgga

SEQ ID NO: 688722 - DNA, 454 bp, Homo sapiens
taacagattaatctatatggtggattccattatattaaatggtcatctctatagatgcggaaagcagattaatggtctcctagggctatgggagaggagtaaggaatgttaatggatatgggttttttggggggatgatgaaattattctaaaattagattgtggtgatagttgtacaattatgtgaatatacttaaaagacaattgcataggaaacatacatatacacacaggcacagacacacaaacacaaatcaaccaaaccaaatgtatttacagattgaatttgccatacaggtcactgattcatgactgctattagtggtggaaaaaagacaagaccaaatattcttgatatgactaaccttcagattagtaggaaagatgagaaacatacataaattataacaacaaaaaggaaagaattctgaaagtaaaaaataaggcccacatc

SEQ ID NO: 688723 - DNA, 390 bp, Homo sapiens
tttcaacagagacaggtttattttgggaataaacctgagaggggcttctggccgatttcggtcagggacattctcttacagactaagggcatttaagggtttaggaagggggagcctaccgcaggctgcgaatgtttctgtgtgaaggagagttttattgcagagttggaatatctctggctggaggggaggttattctcaggattggcatgtttctggtcagatgggggtttatctcatggttgaaatgtttctgctcatactgacatgagccattaggctgatgttttgggctggtttttaatcacggagaacttaaaatggccatgtttgtccaagatggcaatgctcctgctgcacacccacccacccacagggtacttgggtcgc

SEQ ID NO: 688724 - DNA, 319 bp, Homo sapiens
ggcagacggggagttaggacactgaagatggtggcctgctccgaagccctctcaggactgggtcattctgatcctcgccaggtgcaagtagcagtggggcctgatcccgagacgtgagtcacagggcccagctgtccctgtgcttctgtcaagggcggcacaatatctgtccttcaacgcatcagtaccatcccctcaagcatcatccccacatcatgcctgaaggaacataatgtggtgcaggatcccacccctcagcctggaagttgtgaagccagaccatgatctcctttaacagatcagaattccatctcccatg

SEQ ID NO: 688725 - DNA, 171 bp, Homo sapiens
  misc_feature (8)..(8): n is a, c, g, or t
gaccccgngatcgcccaacacagacatgcaagatggaaagattacaagaaataagatggtacttggcaaacaaaaaaccccatctgggagggagaaaaaattcccttacttcttaaaaactcccttaatacttaaacagttctaggggaatcagcgttggggataacatca

SEQ ID NO: 688726 - DNA, 731 bp, Homo sapiens
  misc_feature (182)..(182): n is a, c, g, or t
  misc_feature (185)..(185): n is a, c, g, or t
  misc_feature (193)..(193): n is a, c, g, or t
  misc_feature (197)..(197): n is a, c, g, or t
  misc_feature (199)..(199): n is a, c, g, or t
  misc_feature (223)..(224): n is a, c, g, or t
  misc_feature (274)..(275): n is a, c, g, or t
  misc_feature (284)..(284): n is a, c, g, or t
  misc_feature (294)..(294): n is a, c, g, or t
  misc_feature (304)..(304): n is a, c, g, or t
  misc_feature (307)..(307): n is a, c, g, or t
  misc_feature (319)..(319): n is a, c, g, or t
  misc_feature (503)..(503): n is a, c, g, or t
  misc_feature (514)..(515): n is a, c, g, or t
  misc_feature (522)..(523): n is a, c, g, or t
  misc_feature (539)..(539): n is a, c, g, or t
gcacaggcatccagccaggcacatccctgctcaccctgatgggcttcaggctggagggcattttcccagcggcgctgctgcccctgttgctgaccatgattcttttcctgggcccactgatgcagctctctatggattgcccttgtgacctggcagatgggctgaaggttgtcctggccccncgntcctgggncccngntgacctcacagacatgcgtaggcnngcggaaccaagtgatcgccccgctgacagaggagctggtgttccgggacnngtatgctgnccatgttagnaccgtgcatnggncctgggccctgntgtgttcacctgtcccgctctttcttaggagttgcccattttcagccatacttattgatgcagctgcgtctccgccagatgcagccgtggggaacatcttcttgtctgctgcgttccagttctcctacgacaggtgtcttcggtgcctacacatgctttcctctttcatccgcacaggacaccntgattgggccnngtttctnngccattccttctgcanttacaatgggttaccgcagctgtttgtgcggcttggagcacacccacagaggcggccctgcatgcaggctattgcctgggtgtgggatcttcttgcttctgtccaggccctcagggaaccagctctacgggcagctaccctttgttgctttgtacggcagtgaccaaaggtcctgtgccctgactatacatg

SEQ ID NO: 688727 - DNA, 243 bp, Homo sapiens
aacctcccaaaatcatgggcccatgtgaaagcactgaaccactgctggaccagggtgtaagctcactgtgaccatagtgaaggtgtttttgttagacatgggtccccaaagaaagtcaagtaatagtagcagagatggaaatgaagatgcatatgaaggtatttgtacctgacccggaaaatggaagtattgtccagcatatggagtgaatatgtcatgtccatgtgtgaaaataccatatga

SEQ ID NO: 688728 - DNA, 333 bp, Homo sapiens
ttcctttaatctctggtctcctataatctctatcggtacagcttggtcaccattttttttaatttcctcactggaggtagtcccagaaaaaaacacaaaacctcaaaacggtaacctggaccttataattccctctctcttccttccttccttccttttccttccgtccacacgggtaagacctataacaccaaatggacaattacacccaggttaattcgacccgggaggggaggtagctgaattcggtctcaaagatttatttccaccaaatagtatttaggcttgggccaggaggggattaagaccaggagagccgtctaggcggtgact

SEQ ID NO: 688729 - DNA, 132 bp, Homo sapiens
tactgccgttgcctctactccggttcctctactctgccggttcctctactccggttcctctactctgccggttcctctactgagcaggattaccatggcaacaacacatcatcagtagaggcaaccggcagt

SEQ ID NO: 688730 - DNA, 427 bp, Homo sapiens
tgaacacacggaagaaataaatacacacaataacacataagataacaaaaaagataaggagatagaaacaaataaccctatatgaaattacctgaccaacaaatagaggcaggctatattaattaaacatatactagcaaatgaaaaaactccccgaggtgactaactcaaactccatcatttcatgcacatgaccattggcttctgtgttctaataccatagccacatccaaatccagaaaggctcctgcaccccatgctcaaaaatgcaacctcaagtccctgaaggtcctcagcacagactgacattaacaagcctgtgttcagccttcatccagaacctccaggaaaatcaggagcacaaacacagagcaaagcaccgtttctttaaaccatggctttaactgtcgaatgagactctgccaag

SEQ ID NO: 688731 - DNA, 704 bp, Homo sapiens
cgggatcggcacacttgctgagcatttgatgcttctggaagctgataatcatgtggtaacttgcctgcagccatcatccgtgtgacccaattttagcctcatctggcatagattatgacatctaagatctggtcaccattagaagagtcaaggatttttaaccgtatacttgctgatgaagttataactcgaaacgaactcatgcctggaagaaactagatcacaccattacagttccagcctctttcatgttgaggatgttggcttcacttaatcatatccgagctgaccggttggagggtgacagatcagaaggctctggtcaagagaatgaaaatgaggatgaggaataataaactcttttttggcaagcacttacaatgttcttgaaatttgtataagacatttattatatttgttttcgtttacagagctgctagtgcaatttataacggttatggtgtctttggagtttttccctttttttgggataacgctaacagtgtggttgtggatatgattgatgtgtcatgaattctgggagatttgtagtaaaacaaaaacgtagtcagaatgttgtataaaacttgtttgtccgtgtatgaggagtgatagaataatgctataagtgcaatattcttccctaaccttcaaatgtgggaggcttggatcaatgttgaagaataattttcatcatagtgaaa

SEQ ID NO: 688732 - DNA, 418 bp, Homo sapiens
tccataattccatctacccaaatcacggaataggaatgataaaagttataacaaaaatttgataagggtgaaattggaaagattcctaggatatatgtgatgcactgggttataaaataaaattccattaaaaagcctaggattgtctcccactgacagtacagcaagcagaagccaaccagaagaagaaacttgccttattaattcatagctctggtaaaattcccctgcgaggcaaccaatgccccatcccatgtctgtgcacggttattctacctctgcaatttgggactcaaatctctggtcatctctgtaatttcaattcctagaaagagctcctaaactgatcattgtgttcctagtaattagaagagtaactgtgacacagaaagggttaacaaataagaattataaatga

SEQ ID NO: 688733 - DNA, 855 bp, Homo sapiens
  misc_feature (855)..(855): n is a, c, g, or t
agctgatgtcatcactatgactactaagcagagcgtaacctcaagagaatctttttcgaccccgccgtaggtggagaccccattctataccaatgacctattctgatgggcggtcgccctgagcttgatatctaatcctaccgggctccgagaataatcctcccatatggtacactgtaacgtgactgccgggaaagaaaatgacgccagtgtgtgattccatagggtatggacgtgagctatgatatcagtggggctctcctagggtaaatcgtgtgagcacaccatatatttacagtaggaatagacgtagacacacgagcatatttgcacctccggtaccataatcatcgctatccccgaccgggtcaaagtatttagcgtgactcgccagactccacgtgaagcgaatatgaaatgatctgctgcagtgctctgagccctaggattcatctgttcttttcaccgtaggttggcctgagtggcatggtattagcagaactcatcactagacatcgtactacaggacacgtactacgtggtagcgtccaggttccacttatgtcctatcgaataggagcttgtatttgggcaatcatagggagggttcattcacttgatttgcccctattctcagggctacacccctagacgaaactagccaaaatccatttcagtatcaatatccattgggtaatctaattttcttcccacaaacactttctgggctattcgggattgcccgaggtactccgactaacccgttggttacccaattgaaatctaatatttggggcatccaactctaacacgagaataaaatcggttgggagccgtgacagaagccatttgacn

SEQ ID NO: 688734 - DNA, 997 bp, Homo sapiens
  misc_feature (997)..(997): n is a, c, g, or t
ggctggagctggacttcttcgccttctcctcggctgtggatccctggatgagggggtctgcgcccggtcacctatgacgacggccggtgcaatgcccagaatgggcagacactacacgtgtgtgaactagacgatctgctatgagctgcaccgcgaccccgcgaggtaatgctcataattggcatggtcacgagagtattgctgtttcccctcggatcggctgctgttcagaaccttcatggtgccctatcgtgcctgggacatgctttaatgcaagtacgatgatccgaccaaggtagtgcctccacgaggattcgtgtctcgtgactgcattgtcgcagcgcctacggagcgggaagcaacgggagctgtcactaccctgcgctgaagagcaagtcgtcggtggtcgcaagcctgatcgcctacgggcacagggaccaccgagacttcttgatttgcgcgcgtggaatcgtctatacgcagtcgtactcccctagtcccgggagggaagtagctgagggtcccaggtctaacgatcccgagatgggttatcccggcctgaagagccaggctctggcaacccaaacccagattcaggacattgaagtgcttcccaggcattggcaggaagggcgcgcttacggcaattgctcagaggccattgcaccgagggtgaccccaagctcgtgatgaagggtcgcgtgcgaaataaccagagggttcagaaatcatttaacctagctaacccgatagtagttggggggggggaggaaaccggagtgacgcccctagttgcgcaaggcgggcacgtacacgcggggtgcactttgcgggggaaggcatctgtgtgaacgcttccccgagctaccccgcgcgccttgcctttctagaccctcgattggcctctttggtccccggtttgccggacctccctgtggggactgcggtggcacgccgcggggtggggggccctttggctcgggggccagtgggggan

SEQ ID NO: 688735 - DNA, 393 bp, Homo sapiens
gtattttgtaaaaactaaaagaggtgatgtaggaaaatcacccaagaagaactagataatcaaaatagacctacacagcaagtgctatgtgcaaattaacactaatttataattattgggagatgccagggaaggcggtgaatgccaggagccccttcctacaggcgtgctccatcagcgctctggacttgatacatttacggtagccaggtaggtcgctggcacccatattgacccccactgtgggagaagtccctgaggtatggggacccgcaggggagggggaggctcagaggctgagcccacacgtaccttctccccgggtgtgacagagatgcgccacacgcagtgcatgtgagcagagtagccattggggtattcagcggaggagaa

SEQ ID NO: 688736 - DNA, 932 bp, Homo sapiens
tttggtttgtgtgctgtggttgcgggcggggtgttgctgtgggttggtggtggagcgcgtggcgggggttgcgttcgcggtgctgcccgtatgcggtcgtacgatccgttcgcgaggggtcggtgggcccgcctttcgctgtgttccgctgattgggtcgacatgcggttgtgtgaccaggtggctccctggagacttgtgcggcctcatgcctgtgctcccgggctgggctgctggggaatggcggccggtggtcggcctccgtgatgcgcccagtgcggcgacgctctccatgccgaccgccgtccctgtcccttgggggagcccctccgttttcccctgggccgggtgcaccaggcctcttgcctgctggggattactcgatctgaaccgtccttcctggtagttcgcgtcctcgcggggccttccctttgaggagctggaggggtggggagctagaggccccctatgcccgtgctcaaggttactgggagtttgggctgccctgtgttgcctgcacccttccctcttccctctccctctctctgggacccctgggtacacagagatgggatgctccgacagcgtctcccattatgaactaatcttgaccctgtgctgtcagataccccgtttctggagtcacatcacgtgaggagggatgtgggtaagagagcagagggcacagggtgctgtggacactgtgggtggagaagggagggtggcccgcactagtaaaggaggaatagtgcttgctggccaaccaggaaaaggaggaggtgtcttggggtgagggattagggagagagaacaggcagataattggacaagggttggtcaaggccacctctgcctttagtcccccaggcctctttctgcctgaaagttacacccatttaacaggattttaccagtaatgaaaaagaaaaaaa

SEQ ID NO: 688737 - DNA, 254 bp, Homo sapiens
  misc_feature (33)..(33): n is a, c, g, or t
gcgatgagccggtccgctgtgcggacatcctcnagttagaaaaagtttagatcacataagataaaatttctgctgggtaaaagtttcatagtcaaacaataaattattaagtactttcaaagaggcttttttcatcagaagtgattctatatactcattgattttgcaagaactcaaattaagggactactgaccacaagatacaacagctagttacaagtaaccactgtgagggttgaggatggtccgcacag

SEQ ID NO: 688738 - DNA, 648 bp, Homo sapiens
  misc_feature (413)..(413): n is a, c, g, or t
gcacgaggacagttgagcaaggaggagagaggtggactgtttgtgctgcagctgaccggttgggagcagctgagaaaagaatgggcagcgcatggatgagctctttgtgctgatccggatggcttctgctcccaactggctagctccctggccagctgctgtgctgggatcattgagttccgggcggccggctggaagacaacgccagctgcccacaagtattactacagcgaagtctccgactaggcctccagatcagggctttctcaccagcactggcctttcttctacccacctctaaagctggcagtggagtctctgcctcacccaaagacttttcccttccagactttgagtgtcttcccttctagactttcccatctcctggggagatgatttccacttatgcccgnggtcctgccctgagccccttttcccaccacaacccaccacgggcaggcagagaagggcaacttccaagagccactgccctgtgaaccattagtgcaactactaccttgggggcctcagttacacatctggaaaagggtaagcataagccacggtgggtatatttggatgcaaaggggtgggggcggcgcccaaggccccacgctttttatacaattttgataaggcccccttgcc

SEQ ID NO: 688739 - DNA, 933 bp, Homo sapiens
ggggaagatggcggtggctggggcggtgtcggggtagccgctggtgcactggtgcacccagcagttgcggaagactttcggcctggatgtctagcgaggagtatcattgcatgtatcgttttgttcaatggatagtgctgcaagagatacgagaagtatgttactgagtctcctccagggaaaatgagagggaaagaaaggtcaatgctatagaagaacttataacctagatatggtaaggagaatgatcaggatgttgatttcggatcctttgcagcagtgctatcacacatagatagatgaaattttagatcgggtcacgaaatcatggtgactatctaatatgctggggtagggaatgaataggtgacgtagaacagacaggaagttccgtgcatttactgaaactgatacgactgctgaggttaacatcgacctttagggatctcgggccgaaggcccagaggaggaacagttgcaagctgccggtacgagaaggagagaccaaaggtgttgtccactgttatacaacaagtagaggggaccggaacaggacttgcagtaccgtgcatccctgggtacgtactcacgccattgtgtcaatatgcctgggcgcccagcaagctactaagctcaatctaatcaactggtcttggatctgtggggcgccattgtcatgtggaaccaagaatggccttccagagcccggtgtgactttatgtctggtgcgctactcgtgggtgtgtacctcgatgaaggaacgaagatagttttacaagtggtgagatcaaaacagggagtcgcagaaactggcttactggaacacttcatgttcaggaagtggggagcattcgtggtaaaagggtggacattgtctagcaaagggaaccttccttgcatcattaagaattgcgaattaagtttgggtctggg

SEQ ID NO: 688740 - DNA, 232 bp, Homo sapiens
aatttcccttttttggtgttttggggccacccccccttggcaaaattttggcaacaggaaatcatggcccttttaatttttccttttattgggacaaggcccctgcatttccagggggcccttagcccctgggttttttttttttccccggagcttagggaacaaaaaactttccccctttggggtgatggtgccaggcctttttccctccaattaagccctttggtgtcca

SEQ ID NO: 688741 - DNA, 393 bp, Homo sapiens
  misc_feature (184)..(184): n is a, c, g, or t
cttactagaacttgaataatgcacctttggaatagggcttttgtcatttctcttccagaaggagagtcatgctatgtggtgccaagaggaaatttgatggctcagctcactaataaatcttgtggacaaacttaatttcttcattccatagataaagaactgtgaatcctattgaagggtcttnttatgttctttctggcttcccaagtcagtaaggtacctcaaaccagggagataaaagtgcctgctttgagcattgctacccaggtgctgaaggtgaacatgggtgggaatctagggattttgggaagcagacaatgggcttttagcttaagcgcattcttcaagcttcagtggacatctaggtctcaggataggactttgaggcccttg

SEQ ID NO: 688742 - DNA, 333 bp, Homo sapiens
cgaaagctcattatcctcacctaatttggcatttttatgcttattttacaaagctgtgcaagcttgggaggctaggggtgtactatggagtataaagctctaaacagaaagctcttctatcagattttggccgctttcagatagagaaagtgctctgaaatgctgacggtaccttggaggagaaaatattagatgtcaccattttaggttaaattattggacacactaatttcaccagaatgtccttatagaaataggtattggttaagacaagatgagagtgtggtatgcatagaacgggtgcttgaaagtgaatgccctaactaaatcctt

SEQ ID NO: 688743 - DNA, 199 bp, Homo sapiens
caaaataaccttggactgcagtgtaacaatgcaattagtacaactaaccaagctacactgaaacaagtccccctaggcaggggtgtccactatttcatcttccctggcaccgacattgtcatgacattcttcttggcgccaccatgttaaatgacactaatcactacaccatagtctcgtatgtagcttacacaaagaa

SEQ ID NO: 688744 - DNA, 113 bp, Homo sapiens
  misc_feature (36)..(36): n is a, c, g, or t
tgaccttgaggactccctccgactagcccgacaggntgagcaggaggactagagctacaatctggaccagtgagaaacgcaggtcgcacagcttgctgtcgggctagtcgggg

SEQ ID NO: 688745 - DNA, 309 bp, Homo sapiens
agaggatcctcattggatagcggataggggctggaagctgtaggataagtgctgcagagtgaactgtggcctttgaaggatttgcacaggagacacgggaacccctgtcaggacactaagcaggcaggtaccaggacagagccatcctgggagaggcatgggtgctgctagccacaggagagcaggggctgtgtgctgagtgcagggagtagggagcaggtctgaggggtcaccaatgcagggtgacaggctgaggaggcacagtggggtggagggatctgggactcggctttggtccttggctctgag

SEQ ID NO: 688746 - DNA, 247 bp, Homo sapiens
acataaaaatcaccaaattacaaattacccttttgtgaatccttggtagtactgaacaatatctatgaggctttttctttcatgggaagagggagggaaaggagcaaggtgacatcctactaaaaatttgaattttgatcccaaaatgtaaatacaatattcatatgatacttttttgtggtaaatacccgagatgaatattataattagataagttatatgaaaagaaaaattccatgtctaaata

SEQ ID NO: 688747 - DNA, 367 bp, Homo sapiens
  misc_feature (19)..(19): n is a, c, g, or t
actagtccacggttggctngtgggatatgactgtacgctggaatgtgtctcaaaagggtgtatgttcaccaacatttgtaaattatatgacatgtttctactgatttacattataatgtaatagattttttacttttaggttaaaggcatgttaaactatcaatcacttttgatgccttaattgtattttttttcctattactgggtttttttcaggggcagggtctcgctctgtcatctacgctggagtgcagaggtgccatcttgtctcactgtaacctctgcctcccaggctcaagcaatcctcccgcctcagcctcccaaataggtgggactagccaaccgtggactagtgggtaccgagctc

SEQ ID NO: 688748 - DNA, 373 bp, Homo sapiens
ccgtcgtgctcaggtctacaaataggaaactatgccatgatacctgagccttgacatcatcacgttctccagtttgtgtttggtattggaagttaaaacatgattcccttttcaagtttggttcttgagagactcacatggtgttgctcaagtacgttttgtgacaggcaatagcatcttaagaattcttaagtccaagaagggacttgctcctgatctccctgaagatctctaccatttaattaagaagtagttattgttcaaaagcatcttgagatgaacagaaaggataaggatggtaaattctgtctgattctgatagagaggtagagtcaccctttggctcaatattgtaagacctgagcaagccagg

SEQ ID NO: 688749 - DNA, 1240 bp, Homo sapiens
  misc_feature (575)..(575): n is a, c, g, or t
  misc_feature (600)..(600): n is a, c, g, or t
  misc_feature (621)..(623): n is a, c, g, or t
  misc_feature (625)..(625): n is a, c, g, or t
  misc_feature (634)..(634): n is a, c, g, or t
  misc_feature (770)..(770): n is a, c, g, or t
  misc_feature (774)..(774): n is a, c, g, or t
  misc_feature (1133)..(1133): n is a, c, g, or t
tggtgattagtgtgtgtctgctactaataccatggctgcctgtctagccatatcgctgaaggactattgtgctgggtgggggcccgaacttctgggatgggacaaaccattacaccatatagggttctgttcccgcattgcattgtacgctggtggttgtgtatattggtctaccgtgtggcacgtacgaaggcgcattcatggggtgggccgctgtgtacgaacgtgctaatgtccagacacttacacggttgaaccccgcagggtccgcggatcccccaaacattgcgcgtgtatggtcctgcgtattcctagggtgaatctgtggacatcgtatcgctagcatgccaacgccgtgtaaccccagggaacgcggagaccaccgagggctgacctagcggcgccgctgtgtaactgagctgccggtttagcagtgggaagaggggaacagagagggccgctccctctctgccctggactttccacaagagcctgcctgggactggccagcgccactcgcttgtcacactgttccatcctgtagcagtctgacacacagctaaggagcctcatancctgcgggggctgcagagccacacnccaagtgcctgtgcccagagnnntncagtcagcngctcactcctccagggcacttttaggaaagggtttttagctagtgtttttcctcgcttttaatgacctcagccccgcctgcagtggctagaagccagcaggtgcccatgtgctacatgacaagtgcctcagcttcncccncggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccaagactcntgtttgtgccgaggtgtattaataaatatctgtggggggaagatgccccgcgcctggagaatgctgtttgtggaagacggaaaataaatgttttttctctattcaca

SEQ ID NO: 688750 - DNA, 377 bp, Homo sapiens
attccacttccttttcaaatccttatttcataactccttaaattgaaggtatattttcaaacttctagtaaaatatctttaacaacccagtctttttcatgggtagtttttcagaatatagaatattaaaataataaatatccagaaaagattagccattttctatcttgaattcttacttcaatgccccataagaaagaaaagaaattgaaaacattacttgaaaataaattgaacatttgatttgatttaatatcattgatttcgatatgaaacacatatattacaccctatatcagtgtatataaaactgattcatggattctgagggaatatagacagattaaccaaaatgatccctgatataagagtgttta

SEQ ID NO: 688751 - DNA, 1114 bp, Homo sapiens
ctgcctgcgcgcacccccggggcttcgtgctccgtgcacggtgtcgctgcccagctttcctgcacctgatgtgcctgcctgtgccagcctgcctgccatggtgtgcctacctctcccatgcccaacactggtgaatgtgctcctgtgtggactggtggtctggctgcccctgctgccatgcctgctgtccctactgtgcttctccgaccatgcaacggcttggctgctgtctccactggagtgatgctcacaacttgtattacctgatgctggacatgtgagacatgccagtgtatttcttgtctactgatgtgacattgtgatgtgtggatgtgacaggtttgcccttgatagcttggtgcacaagatcatccgttcgcttgcataatccatccaaaatgaatcgaagaaatgtgccgtaacgacatgtggaatgtggcaaatgcctaaacaaaggcacatggggcgtatttaaagtcaacatcgcaatttggcaccttatacctattgtgcccttaaagtattggcaacttggcccctgaaaacgaagtgcataagggaacaccacaaccgttatggcaacagagtggaatacaatcggtttccgagaattactccaaacacaaaatcgcaataggcggtttctgggtggccatagaccgagaagttggccaaatttatttggggcccaaaattgtgtgtttagggcctctgtgggagaaggacgagccaatacacaaatatgcgtgttttggtggcacgacagcagtcagtagaaagaattattgggaaatagtcatagagtgaaaaaagtttttgtgggaacagtaatagaagacagataataatggggagaaatgagacgtacagaagaacaaaaggggatatttatagaatatggtcgtaccaccgtctttagtgtgggatgaaacgttttatgggcgggacatgcagaaagtaggcaagaaaacttttgttgtggcagaaacagtttagaagggagattattaggggagaggaagaaagaatccgcagacgagaacaaaagtttttgggggggaaaacacatgactgtgtgcgaacacatgagtgggagggagaccccactttttga

SEQ ID NO: 688752 - DNA, 113 bp, Homo sapiens
cggatcagcgccatggtggccacagaggacacacaggggtcagcagaggacatgtgggtgaagacagagggtcttggtttctctctgacgactggaggttgaggggtaccgag

SEQ ID NO: 688753 - DNA, 246 bp, Homo sapiens
  misc_feature (2)..(2): n is a, c, g, or t
  misc_feature (27)..(27): n is a, c, g, or t
  misc_feature (60)..(60): n is a, c, g, or t
  misc_feature (92)..(92): n is a, c, g, or t
  misc_feature (190)..(190): n is a, c, g, or t
  misc_feature (219)..(219): n is a, c, g, or t
  misc_feature (225)..(225): n is a, c, g, or t
gntcagaatcctaaattcagggcgcanagacctttgacgaaaatcaggcgcaaaattttnccccggccacgctcgacgaagcgcaggaagangaggggcaagtcgaagcggtaatggacgcagcgttacgtccgaaacgcagcctgtggcgcaaaatggtgatgggagggctggctctgtttggcgcaantttgtcgggcagggtgtacagtgggacantgaatncctgggcaaacccaggacttg

SEQ ID NO: 688754 - DNA, 192 bp, Homo sapiens
tgggagctcattactacatgagctgggctgatcgcctcacactttcatgggttctgctgcacacatgtgccactgtgcgcttgcaagctcatgggcccggaccctctaactgcctgtggtgtgaccagccggagcacgtcttggagctgttcttgtggggagtgcagagggccactgcactggccgaggctg

SEQ ID NO: 688755 - DNA, 510 bp, Homo sapiens
ctagaggatcccctccagtaatgtgtgccaggctggagtacagtggtgtgatctgggctcactgcaacctctgcctcctgggttcaaacgattctcctgactcagcttcccgagtaatagggattacaggtgttcaccaccacacccagctaatttttgtatttttagtagagacagggtttcaccatgttggccaggttagttaatgttactctctggttgggggggcagtgatatgtttgggcttttttcccacccagatctcttcttgaattcccatgtgttgtggaagggactcggtgggaggcaattgaatcatgggggcaagtctttcccatgctgttcctgtgaagtgaataagtctcacgagatctgatggttttaaaaagaggggttcccctgcacaagttctctctcttggcctgctgccatacatgtaagacatgacttgctcctccttgccttccaccgtgatggtgaggcttccccagccatgtggaactgtaagtc

SEQ ID NO: 688756 - DNA, 742 bp, Homo sapiens
gaggaggtgggtcggaggacacggccctttgtggcccggtttggatttgacgtggtgacgtgctgtggatacctcccccaggtgaatgactggcgtgaggactggtgtcgtgttctatgcccggcagcgcattctgcccccgatggacatggtgtagaaggagtctggggacagtggaggccctccagcttatggtctgctctgcagttaaagatccctgacctgttccgtgacctggagatcatcccagtcgcttacgtccactggggacctctggggtggaaactgtagcagaggattcctctgggccggtgatattatgacgccagtcttctttctagctgtgccactctggaatatgagctggcaatagctggcatgtttgggggctttaggcagctccttttactccgcctaccactggtaaaatccccaaggacccaggattcgagaagcgccttcagaccgtatcagactctttgcactacttgaaccacctggaatcatttcggatcggggtacagaggatcctccctgaacatcatgaggaatctggttcagtgagcggtgccttactctggaagggaggcctcaggaggtttctccacagtcctcttctgggcaaattcttgtgtcttcacatgccggactagcttaagaccaatgcacgtagctaatttcagagccttgcaacagctgtatatctaaaaggaaggtttggcatccaacgatgacacatgag

SEQ ID NO: 688757 - DNA, 393 bp, Homo sapiens
ctaatgtattaattcccagtcacttattatagtttttaaatttgtccttttcaatattctaattgtctctactctggtaggtagttatgttacattaagatcattacagtggtctcctggcaagtcctgctgctggcagtatctccctaaaataacttttattaggacaatattctgcttaaggtccagaatgcttatgggttaaatcagttgagtgttgtgttcttgatctctcaccaatgagccccaatgttgagcttgctttgtttccctgccccctccattctgacccctgcacctggataaaacttttcttgactccatgccccatagcgtgagatgttctcccctctgctctgctattataatcccaccagccaggcgtcgacgcgg

SEQ ID NO: 688758 - DNA, 471 bp, Homo sapiens
tcgcaatacactgctcaacacccaggagtccttggctagtgaactcacacattataggatatatcacacgcgtggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttg

SEQ ID NO: 688759 - DNA, 152 bp, Homo sapiens
acgtctaactcattgtataatagcatgggatactaacttttaaaaaattatggtattctcctgcttaaagatatcacagaaaacttatataaaaatcaggccctttttgtacgattttaaaatttgtatctttactagaacatgagaatctt

SEQ ID NO: 688760 - DNA, 414 bp, Homo sapiens
cacggcgggtgtactacattcaggagtcagcaggttgctgtagtgtaaaaaatgacagggtttgttttattaagggtttcattgcattaagagaattagaaagtttcattttattaagagaattataaagtttcagccagagtagtcgctcacgcctataatcccatcacttggggaggccgaggcagacggatcacctgaggtcaggagttcgagaccagcctggccaacatggtgaaaccctgcctctactaaaaatacaaaattagcccggtgtggtggcacatgcctgtaatcccagctactctagaggctgaggcaggagaatctcttgaactccggaggcggaggtggcagtgagccgagatcacgccattgcactccagcctgggcaacagagcaaaactccgtctc

SEQ ID NO: 688761 - DNA, 620 bp, Homo sapiens
tacacctcaggcggcacgaggtagatttttactctcatatcagtgacaaattgctctgtatttatgctttcactctatattaccaaggtatccataccaattatataactggttataccctcatgattataaagatgaccttttttaccctaacatccttaaaatagcctacaaacacatcataagttgctctgctccacaggcagcaacgccacctgaggtgtatactacttggggatccgtgcacgttaacgattactaggactatgcagaaaccagagagtttaagaataccgcatggcctttcctctcggtctggctgtgtatgatcttgttgggtcgcgtccgagacgggcgcgcgtaccctatgttgtgcctgttgcttaggtctattgttggctttgcttgacacattctttcgtcggtccgcgggcctcgctctttcgtggcctgggtgccccctgcgttctctttttttgtttggttctcggttgtgcttagtgcctgggctcttcttattgtaggctctacctgtatacggagttattcttttgcttgctgcgtttggtaaattgtactgaattatgtgcgtagtttttttagcaagagttctctgtgtg

SEQ ID NO: 688762 - DNA, 415 bp, Homo sapiens
tttgggattagtagaaaagtgttgttttattctccaaaaaaataaaataaaaaaaggggagtttttttaaatgtattattacccccccccgcttaaattgtatgagatggatggtaatatataggaggttggtaattacatattgggtgatatataagtaatgtggtatgtaaattgtgtgaaataaaaatttatggggtgttaatttttagtggttttatataagaggagttgtaagttatgttaatgataaagtgtatgtttttaattaagtatgataattttagaaaagatgtgcgtatttattgtagtgtgtgtgaataagattgatgtatttggtagtgtgggtaaaatatggatgtatattagtgagtggtttttattggatggttgtttattggggggtgattggtgt

SEQ ID NO: 688763 - DNA, 174 bp, Homo sapiens
  misc_feature (21)..(21): n is a, c, g, or t
  misc_feature (51)..(51): n is a, c, g, or t
  misc_feature (55)..(55): n is a, c, g, or t
  misc_feature (76)..(76): n is a, c, g, or t
  misc_feature (90)..(90): n is a, c, g, or t
  misc_feature (107)..(108): n is a, c, g, or t
  misc_feature (112)..(112): n is a, c, g, or t
ggtttcgcttctcttctgcangttcctcttctgtggcatcagagtgataancttnttaagtgagagagaagagtgntaccccctctctgnctcctcctcacacggtnntgtnaacaccacggcttcagcaggggagctagtccatgctgaggccttctccagcctttctagcga

SEQ ID NO: 688764 - DNA, 182 bp, Homo sapiens
aacgataaacttgattgggaagggcggggtaggaattaatagaaggagattggggacagctcagatagctccgcggatgtctggaaacaagactctgcctccggtaagccccccttctggccgtaggctcgaccttcctgccatatccattggacagcagcccccgaatcccggcctcccca

SEQ ID NO: 688765 - DNA, 220 bp, Homo sapiens
agtctagcactttgggacgcgaggactggagtgatcaacgttgccccggagctcaacggccagcctgggcgacactggtgagatcctgtctccatttacaacgaactagaacaagacacacaacttgaatagagaagatcactcattactcccactgtcatatatattgctggttttgtacatatgttcattcatgtgttttaaagcagtagtcacagga

SEQ ID NO: 688766 - DNA, 370 bp, Homo sapiens
tgtattaccatctaagaggaaacaagcggatgcatgtacgtgtggttctccccttccacgatctcggcctcatgggtcttgcccgatgggctggatcacctgggactgtcatatcctggatgctaattccagggacttcacaggctgaggtcacaatgactaccaacgttggccactgaaggagcccgacgcctgcgggtgatgctctctttcacccggccctcgcctgtcaccttcacagagaaggggctgccaggcacgtgctggtcggcaaacttgatgttgatgatgtagttgcctggctctgtggggcagtaggtgaccctgcacgtcccgtcctccaggtcctctgtgttgatgtccaccttgc

SEQ ID NO: 688767 - DNA, 624 bp, Homo sapiens
ggccctgaaggtgccactccagtgcccaccagccttgtccctaataaacattaaggtggtatcaaaaaaaaaaaaaaaaaaaaaaaaaaacaaaaacaaaaacaaaaaacaaacacaacaacaaaaaacacaaaacaacacaaaaaaaaaacaaaacaaacacacacacagaagcaacaaacaacaacacagcaaaaacacaacaacacagacgaggggggcgggcgcgcgcgcgccgcccggcgcggcgcgcggaggggcacagaacaaacaaacaacaggggggcgcgcgggcgcgcgccgccgcgacgaccagaagcgaggtacaaacaacgaaggagcggcgaaaagacgcagcgacaaacaaaacaggaagagcgcggggccaacaaaagagaagtaaggggaggagcagacaccacaacaagacaaagaacaagcaggccgggggggggagcgaagagacgatgatcgttaagctagaaaaaccaacccaacagagaaggtggagataagagagaggaaccagacagcgaggcgggatcaaaccacagcaaggagaagcagcaaaagaagcgaacaagaaataaaaaaaaaagccccccagcacgcggagggggggac

SEQ ID NO: 688768 - DNA, 107 bp, Homo sapiens
ctttacgtagtgagcttggcactgctctacgacctcagagatatagaggttaataagacagatcagatgctactttttgatttgtaatttcttcatattaggcacag

SEQ ID NO: 688769 - DNA, 119 bp, Homo sapiens
atgtgacttagaggatccctcagccatcaaaccatagaatggactttagaggccgggcgtggtagctcatgcctgtatcccagcattttgggaggccaaggcgggcagattcacaaggt

SEQ ID NO: 688770 - DNA, 91 bp, Homo sapiens
acggccgtgtattactgtgcgagagattcgggtagtggttcatcctgggggtggttcgacccctggggccagggaaccctggtcaccgtct

SEQ ID NO: 688771 - DNA, 1046 bp, Homo sapiens
tctcgtgagaataggcaaaaggttcgtcgaacagacgcgaaggtctctgtaaacctctttcaacagctcacagataatgtcgcctactcgcgctttcccaccctcctccaagttgtggcccccctgttgccaatcgttggggggactaatcatgtccagcctgttcctatggtaggtcccttcggaatgtgaacaaattaccccctctggtgcccgttttcaacgtggcctgggccccctttgtagcttgggcccaacttaccagccccgatcgggggaggcgggtcccaattgtcgccgcggcttccaaaagccccatgcgcttctaaatcgcccgtggcctaccctgtgtccggttgcagcccagcaacacatccacccgctagcactttgcctacggcggcatggacgacatgcccttcgtaccctagcaagagtggctacccatcctagctttagcgtgctcaagcttgctaagttcctccagcctttgctccatcccccaagtcggaaagtagaccggtcactcttgtgcccgccccactgtgtcgcggatcggcggtccatgagtggtcgacgcaccaacgatgggttgcctcccctactcgacgacgatctctaccgaaggtggacgactttcgataacgtggatactagcggcggactataacgacggcgtgaacacgtatgacgtgctccggcaaattcaggtctgactttgtcagccctgccgtttccagcgagtcagaaggtccttctggaacagtgtgaatgcccgctgtcagaacgatgatccagttttcacgcggaaagcagaatcaccgcacatgagcgagatgatcggggaatacagcacattgtcttgctcaggtgacaagtcacagtacaactggtcttctctctgactcagtctgtggagtcgtggttggagatgaagtggtagcttgataaacccggtacctggtggagcgaggccttgcccagtgggtagaacagctactacacaagcgctttgacccccatgctgcttcttgagagtccggtta

SEQ ID NO: 688772 - DNA, 211 bp, Homo sapiens
atctagaggtcgtttcgtgtgtgtcatgcactacggggcattgcgtcagctcccccaatgatgatgctgcagccccccagagagagctctgaatgtcaccaagtaaccatggcccatgctccaggccccaactccgcccagactctccccgctctggatcctgcactctaacactcgaatctgctgctcatgggaagaacagaattgctcc

SEQ ID NO: 688773 - DNA, 277 bp, Homo sapiens
cacgtgcacttggcacccaccacacacacacacacacacacacacacacacacagacacacagacacatacgcacacacgtgcacacatgtacacacggatacacacacacacacacacacacacacagtgtatatctgagcacgcccctcgctcgtggtcgtctccaactcgttgacaccgttctacagagattatatgtgtgaagagatttatatatagattttttccctgttttgtcccaacacactatatactttacaaacacaaaaaaaaaa

SEQ ID NO: 688774 - DNA, 372 bp, Homo sapiens
  misc_feature (222)..(222): n is a, c, g, or t
atgacgaactgacgagaagtatttgtggaaggacctgaccctggaccatgcctatagctatgctgtgtgagaatgccaaggagcatcatcgccgtgtggctttgacaatcaagcaagactttcatagttctctgcacctaggactacatggcggatgatgctcagggtttctacaaagaatgtggtgaatgattcaaaaagcaatgttaccgttcaaccaangtgaaaaggcattttcaggcttcactagacagcagactgcattagggaagatcagttttcctgccatccaggctgctccctccttcagcaactcattcccacagatcttccgagacaggacggatatccagtgccttatcccatgtgcca

SEQ ID NO: 688775 - DNA, 488 bp, Homo sapiens
caggactctacgcttgtctttactttaatctcttaatccatgtcatcttagtaagctgagacatgtatgtcgcctcagcaccctgtgatgatatgcgttaactgcacaaattgtatgtaaagcatgtgtgtttaaacaatatgaaatctgggcaccttgaaaacaagaacaggataacagtaatgttcaggaaacacgggatgcttgaccatcaggtctgactgcctgagagcctgtggctggaacagagccatatttctcttcttacaaaatgcaaatatgtgagacatattgatgaattctttttctcagcaaggaacagacctgaagaaagagaattgctttccttaaggggagtgtctctgacaatgtgccactctgggaatgtctgtcttatacagttgcagctaagggacgaactaatgcccccggtctcccataagtgctcccagtgcctcatataggacgaggaaatacctgcactagta

SEQ ID NO: 688776 - DNA, 496 bp, Homo sapiens
ccctggagggagagtcggagctcagccccaactgtgccagcagcttgtcctggacgtcatactggctttcagagttgctgacccctcactcactgtggggatcattctctctgagggcatgatgaggcccaggaaaatagtcttggtaatgttaaatatgatcgggtacaaatacaagttttaccacattctacctaatatgttttctgttgtaacacaactcttttctgttcgatgtgtattatggttgtccgaaagctaaatgacgatttaggaaaattttttttaaaaagtaaatcagtttaatgtgggaagtacttaagtggtattataattttacattttcaagtatattgcataaagaatgtttgaaaagtaacggtttttcatggattcttcaattagacaagcctagaataactagagtatgtggctttaacataataaaaaaggacggccgctcgcgatctagaactagtcactagttctagatcgc

SEQ ID NO: 688777 - DNA, 157 bp, Homo sapiens
cgctggctaatgaaaattgatgctcatgcgctgcattcaaagcaggttgatggtctgtcctgaccagtccacagctggatgctctgtacctggcgaaccactggtccaccctgagagccatgtctcatggacatccccatagaaaccctccaggctt

SEQ ID NO: 688778 - DNA, 122 bp, Homo sapiens
tcagattcctacttacccagttactacatgtccctccattggcttctcctattctttgggtgaagctgcttgtgtctacgtgggggtgacacagccatgccctaacttaacttcttattgga

SEQ ID NO: 688779 - DNA, 467 bp, Homo sapiens
cggaaggataatccaaaaaaaggaggatgctgaaaagtgacccaagaagggaccccagtaaataagtctggactcaagtccccaaataaaaaaagattcaaaggcaaactctaagacaagctctgtttttggtcttgtttcataaagtcatatagaaaaaaaatataaagacgtttccaactgtagttcataactgctgtattcatctgtgaaggattgatgacttgaggctctctgaccagggtgtccaataagaagtgcttagtaaagactcatcaggttggtttccaacacacagcccacattcagtctatacccaaaatagcaaagatggtgctacaccaactgctagtgaagatgcttcaaatgggcagtaagatagtaaatgtacacacccctgcaggtctgcttcacttttattttctttccaagtacagtttcaagaacagtttattaagtaaagcaaa

SEQ ID NO: 688780 - DNA, 839 bp, Homo sapiens
  misc_feature (100)..(100): n is a, c, g, or t
  misc_feature (116)..(116): n is a, c, g, or t
  misc_feature (120)..(120): n is a, c, g, or t
  misc_feature (124)..(124): n is a, c, g, or t
  misc_feature (132)..(132): n is a, c, g, or t
  misc_feature (137)..(138): n is a, c, g, or t
  misc_feature (152)..(152): n is a, c, g, or t
  misc_feature (164)..(164): n is a, c, g, or t
  misc_feature (169)..(169): n is a, c, g, or t
  misc_feature (173)..(173): n is a, c, g, or t
  misc_feature (580)..(580): n is a, c, g, or t
gtaaatcatcctttaggtcgaggagtaacaatacaaatggatttgggagtgactcaagaagtgaagaatgcacaagaatggatcacaagatggaatttancaaaccctagcctgcntgtnaaantttttttnttttnnagaatatctgtaanggtactgacttngctgncttngaagatagcctcttttttttttttttcttttttttgtggcagaaaacggtgtgttttaaaagtcttctcccgcggggggtgtgtaaacagtgttcaatgcggcgagaaataccggggcgtaccagcaaattttcttctactctttttacagaagaatttgggcgtcataccgggcgtgtgtagcaacaccctcatactttcaatataatctaccctccaacatcattaagtctgtgggcactccgtcgagaaaatataggtgtgtgtcacccacttgtggtgtgaccgcacccctttcttgggtctataaacaattgcgagcgaccatgtgagaaaagatgtggtcgctccaccaaattagaggtctgtccccattttaataaaagactatagtgttgctatatcanaaaaattacaggcgaggcggggggggcgagcacacttaatctactcaacagtgtgtgttctgtgtgcggacgcacaaaacaaaacatacttttttctgtggagcgagactatacttgttggatgtcgtgcggggaacaggggagggaacaaatcaacctgacgtgcgaagcaaaagaggggggcggtgcttactgatggtggagacccccccttgctgttctggcggccaaacaggttcccttccccaacgaggtgtcg

SEQ ID NO: 688781 - DNA, 357 bp, Homo sapiens
ctacaggatctcagttactggcatttgtgggacggagtctaaagctaactgaggctaactgggtgatcaagaacatggagatggcatagaggaaagaaagcactaagaggaaattttttaggaaagaagaaaataaattcagcttttaagtgtggatgatgagtagtttgggatatacccaggggtgttattaaaatattgaatgaggtataaaatggcatcaaccaatcaacacagatgccaatgttagcttatataggcacttgtcagttcaggatatatgatgtgggctggagggagctggcagaacaaagtactggaaggtcacagtgctctttagcctgggccagagtcaat

SEQ ID NO: 688782 - DNA, 244 bp, Homo sapiens
actcatccactctcggctcaggctctgtgcgagtctcctcacttcaaggtctggatatgactctacttctagcggagaatctgataaataggtgtcagacttgctgttgaccctcttctcctcttcctttatcttccttttcgtggtggtctctgaggcgtccaaggagacccttcatttccgtgtattcctgtcgtagctgctgtctgttacagattgcagtcatccttcccatggtgctaga

SEQ ID NO: 688783 - DNA, 342 bp, Homo sapiens
ttggtcgtctctgaggttcccccgggttcagctactcatcttcactcagcctcccagtcgcagggattacaggtgtgcactacataccaagctaccttctgtatttttagtagagacggggtttcaccactgttggccaggctggtcttttacttctgacctcaagtgatccgcctgcctcggaatcccatggtgctgagattacaggcgtgagcaattgtgcccagccgagttatctatatttgaattgtgtgatatcccgtcaatagtaccaaagaaaacacacatttcacatatagataacttggcacggcgcggtggctcacacctgtcatcatagca

SEQ ID NO: 688784 - DNA, 569 bp, Homo sapiens
tggaggaaaacgcggtcgtaaggggctgaggatttttgggctccgcacgctctcctgtgcctcctgtgactctcaccgcttgtttcgcttcttcgccgaggacccaagttcggctcaggaacgcccgcgcgcagaagccagtggttttaaaggataccggaaaaacccccgtgtggacccggaggtgtggcaatttcaccgaatttcgaattcacccttaacaagtccgacaaggttaaaatctcctttggaaaagggtgttgtgtgcgtgacttgaataagaggcccaaaagaaaagagattctctcaaggtgtgaagaggcaccagttctcgattgcctataccagagaactttgtgaaatctcacttacagagaaaaaacctcctttgggggtgaagggttcctaaacacggtgggcactccgttccccaagatgtgagaaattttcaacaacgcagactcattgtgcttttgtgcaacagccccttcttgacaaattgtgtgaacgcaagattttactttcccttcagtttttttgacccagggattttgagggtgaattccccc

SEQ ID NO: 688785 - DNA, 259 bp, Homo sapiens
  misc_feature (122)..(122): n is a, c, g, or t
gaatagattaatgccactatgaaaagggttgctaaagtgtattcactctcttctgcttgcttgccatgtgaggacacagagttcacccctctcttgccttccaccttctgccatgtgaagancagtaagaaggccacaccaggtaccagcatattgatcttggactttccagcctccagaactgtaaaaggatacatttctgttctttacaaattgctgggtttcaggtattctgttagagcagcagaaaacgaactaa

SEQ ID NO: 688786 - DNA, 253 bp, Homo sapiens
taggagtaagtccaatggagggtgtgaagacagacaatgaccaccatcaacctgaaggtggccgacgcagtgactggctccgtggtgcagattcaatgatcaagaggcacacgccgctagagcaagctgatgaagtgcctacagcgagaggcagcggcttgtcaaatgagtgcagatcaaattcagtgttcgactgtggcagcaatcaatgaaactgacactccagcacagctggagatggaggacgaggaca

SEQ ID NO: 688787 - DNA, 94 bp, Homo sapiens
  misc_feature (21)..(21): n is a, c, g, or t
  misc_feature (86)..(86): n is a, c, g, or t
  misc_feature (89)..(89): n is a, c, g, or t
cattatgtcattttaacttanaattcaagtagttttaagactcttgtaactcaaaaatgtttctttaatacacattttcaaactanagncaaat

SEQ ID NO: 688788 - DNA, 470 bp, Homo sapiens
agcagagacctgagaggcaccaggcccagccgtggcaccacacacctcccagctctgcagacgagatgcagcgactatgtgtgtatgtgctgatctttgcactggctctggccgccttctctgaagcttcttggaagccccgctcccagcagccagatgcacccttaggtacaggggccaacagggacctggagctaccctggctggagcagcagggcccagcctctcatcatcgaaggcagctgggaccccagggtcccccacacctcgtggcagacccgtccaagaagcagggaccatggctggaggaagaagaagaagcctatggatggatggacttcggccgccgcagtgctgaggatgagaactaacaatcctagaaccaagcttcagagcctagccacctcccaccccacttcagccctgtcccctgaaaaactgatcaaaaataaactagtttccagtggatc

SEQ ID NO: 688789 - DNA, 593 bp, Homo sapiens
gggacaggcaagaaaacatgccatgttggtaaagacaggaggtgtaaaacacctaattggggctattaataagatggatgatccaacagtaaattggagcaatgagaaatatgaagaatgtaaggggaaactagtggcatttttgaaaaaagttggctttaatcccaaaaaggacattcactttatgccctggtcaagacttactggagcaaatctcaaagagcagtcggatttctggccttggtacattggattaccggttattccatatctggataatttgccgaaccttaatagatcagttgatggaccaatcaggctgccaattggggattagtacaaggatatgggcactgtggtccttggaaagctggaatcaggatctatttgaaaggccagcagcttgtgatgatgccaaacaagcacaccgtgaaagttcttggaatactttccgatgatgtagagactgatacccggaccccaggtgaaaaacccctttgtgaatctaataatcttttgcaattctggacgcacatttgatgccccgatagtgattatagagcacaaatccataatctggccaggctataatg

SEQ ID NO: 688790 - DNA, 139 bp, Homo sapiens
ctgatatgtgtgtgcacgcgaaacagtcctgctgtcgtagctggccaccgctgataatcgtcccaggcgcggttgtaggccgactgcccggcattggtcaggcagaagccatatccctggccaggttgcaggccctcga

SEQ ID NO: 688791 - DNA, 835 bp, Homo sapiens
  misc_feature (530)..(530): n is a, c, g, or t
ggctgcgagggcaacgccaagcaatttctacacctgggaggctggctgatgatgcgttgcgggggagagtatgagaatagaagtgctcgcatgagttagcgggggttggcagggtgagtagtggtacgaccgatgtgtgaggggtccatagataaagtgtgtcgttggaagtcgtaagttgctaatgacgatgtgtaagtaattcttttccggttgggtggtcatgggagaacggattcgaccaacaggtttccaggatgaaggctacttgtatggtgcttctgtcgctcacaagagaagcatgcgcatccatcgttgctatcagtccaatgaggatgagggactgagcgctcgccatggtgactcgctcttatgtgattccaagatactgaccctgtgatgctttcacctataactggtctgtggaggggagatgacaataccgtttgtatacccgggaggagttgcaaaacgtgcaatgtggcaaacagctttgagaacaagaaaagagaagatgccaaagcttcgcntttgccacgtgagaatccggaaaattcggaagaagcgaattttaaacattcttaatatgtcagtctgttagtctgtatggcttattgcctttatggtgtatctgaagaataatatgacaggatgaggaaaacaaatcgtggtgatttatgcaccagttttgattaatacaagtcacgttttcaaaaatttggattacatatataactaggtggtattcgagatgtgagtctaccatctttaattatggttcactgtgtgtgagactgaattgctgcagtggtaagatattaaagcatttgatcac

SEQ ID NO: 688792 - DNA, 368 bp, Homo sapiens
ttatggggacagggcccccccccccccttttttttttttcccttaattggacaagggggggcccggccgggggttttttggggttggggcccattttaatttttttggccccccccccaaaaaaggggggggcgggtttttttttcccctttcccgcccaaaaaaaaaaaaccccgggggttccttttccccccccgcccggtggggaggggttgccttttttaaaggcccccccccccctggggggggccccttcccccccggggggggggccggggtttggcctttccccccctttccccccctgggcccccaaccgggccctttgtttgggttttttttaaaaaaaaattggggggggggggcca

SEQ ID NO: 688793 - DNA, 372 bp, Homo sapiens
cagcaggcttgattagtcttgaaaagataaacaaaatgactacccttagctagactaggagaaaaagactcaaatcagaaatggaataggagacattacaactgttatcacagaaatacaaaggatcacaagaaactactataaacaattatacgccaacaaataggatagtctagaagaaatggatgagttcctagacacatacaacctaccaagactaaatcatgaagaaatagagaatctgaacagaccaataatgaggaaggagattgaatcaataataaaagtctcccaccaaagtccaagaccccatggcttcactgctgaattctaccaaacatttaaagaaccagtaccaatccttcttaagct

SEQ ID NO: 688794 - DNA, 731 bp, Homo sapiens
gagtatggatagtgtgcacgttctggactggcagatgccatgtcgtgaagcagcaactgtgttgtagagttcctggactcgcatcctagccacacaatctcagtcacacactagacgagatgcgcctatgcgtcctgctctctccaggatgtctacaaaattggtggtattggtactgttcctgttgggcgagtggagatctggtgttctcaaacccggtatggtggtcacctttgctgccagtcaacgttacaagcggaagtcataatctgatcgtaagatgcaccatgtacgctttgagtgaagctcttccttggggaccatgtgggcttcaatggtcaagaatgtgtctgtcacggatgttcgtcgtggccacgttgctggtgacagcgaatgatgatccatcgattggtagagctaggactgggctttctatcgtggtcgtcatggtgattgatccttgaaccatccaggtccaccagtaatgctgccagtgacttatgaccactgtatgtggatttgccacaacgggtcacattgtatgcaagttttgctgatctgtggacatgattgatcgccgattctggtaggtggctggaagatgggcctaaattccttgaagatctggtgatgctgccattgttgatatggttcctggcagcccatgtgtgttgagagcttctccgattatccagctatggggtcgctttgctgtcgtgctatgagacgca

SEQ ID NO: 688795 - DNA, 858 bp, Homo sapiens
cggctcggaccgagcagggctttccttgccagtggattgtgtagagtatacagccagtctcttgtcttctgttcgacatggcatcttctgatattcaggtgaaagagctggagaagcgcgcttcaggccaggcttttgagctgattctcagccctcggtcaaaagaatctgtccccgatttccccctttcccccccaaagaagaaggacctttccctggaggaaatccagaagaaattagaagctgcagaagaaagacgcaagtctcatgaggcggaagtcttgaagcagctcgcggagaagcgggagcatgagaaggaggtgctccagaaagccatcgaggagaacaacaacttcagcaagatggcggaggagaagctgacccacaaaatggaggctaacaaagagaaccgggaggcgcagatggcggcaagctggagcgcttgcgagagaaggacaagcacgtggaagaggtgcggaagaacaaagaatccaaagaccccgcggatgagactgaggctgactaagttgtcccgagaactgactttctccccgacccgtcctaaatatccaaagactgtactggccagtgtcctttactttccctcctgacagatagtctagaagccgatgtaggaccgtataggtagatccagaccgtgagatgttttagggggctcaaggggagaaactgaaagtgttttactctttttaaagtgtggtcttctaatgtagctatttctcgttgctctttccactcggccatcgggtgcgggtaaggtaatccgttgacgcggaaagtttggacatttgggcgttctcaccctaatgtgtttttcccttgggccattgccattcc

SEQ ID NO: 688796 - DNA, 284 bp, Homo sapiens
tgagccatatgtctggtatattgatcaccataaagcgggtctgctagaatgacgctgctgagagaatcagttcgtgttctgcacaggttcaatgtgaaatgcgttgactgcgaaatgtgcgagttccttttgtacatttacaaaagctttatttactctgttaacttttacctcattcataatgtttatcttcttaagattagtggtaactggttttgctttgtttttagccttaaagtttttttggctggctatgcgaaatacattcctggacttcggccctc

SEQ ID NO: 688797 - DNA, 458 bp, Homo sapiens
tgctgtagagttctgtgtatagcttgtagaaatgtatagcatctgtcaattaaggaaacaaaaatcactactatgttgccccacttatagagccctgtgtgccagcctgtgtgcctgtgattgcaatgtgagagcgagtgtaatatggaaaacctaccagaggggtgtggttagtgccctgaagcgcgtgtgtaaaggcactggggaggcgtgtcttgcaaaagcaactgcagaaattccttatgatgattgtgtgcaagttagttaacatgacccttcatttgtaaaattatataaaatttcttttcataatatgctttccgcagtcctaactatgctgcgtttaataatagctttttcccttctgttctgttcatgtagcacagataagcattgcacttggaaccatgctttacctcatttcaagaaaatatgcttaacagagaggaaaaacatgt

SEQ ID NO: 688798 - DNA, 1003 bp, Homo sapiens
gaagcctcagatgtaggagtctgccgatcatgccctgttgtgcagttcgagccagcacctgtttctggacctgcctaagctggaggaagcgactggagagagtggtgggcggaggacattgcctggcagtgacgtggagcacccatatgcccagttttatcacccgtgcttggcgttcgggatggcctcaatgctcaacgctgactagtaactccgagaacgctcagacatggggatacccctgtacccttagaaggttttgaagacaaggtattcgtatgtctggtttgatgccactattggctatctgtccatcacagtcaactacacagaccagtgggagagatggtggaacgaaccaaatgtagtggatctgtttcagttcatggtcactctataatgtgccttaccagaggttagtcttttcttgctcaatccctaggagctgaggataacaataaacttggtgatgcataatttcaattgtctatcggatgtagctgatactatgaggatgaggaaattcatctaacgagaggggtgtgggagtgttgggggacatgggcaggacatcggggatccctgttgaaatctggagcgagctatctgatagtacttcgggctgaggggcggagattgggtggtctccgaggaggggatctaggtgttgaagaatagttgctgtgcctggtatagtgatcgtggggaaggttcattgaagaagctgggaatgttgtgtgtcctacgttcttggggggctatgtgcctgagatggtggtcaccctgattgaattagggcctggtggcccattgttaaccctggaagtccaggtttcacacgtacttgacaaggtcgggatccggaatcgtggacggattctaccaatttcctgggaccacaatttcgtggatagagccggaacgataaagagggggtgaagacagggagaaatggttggagaaacgagccttagaaacggggaggaaacgagcacccacatag

SEQ ID NO: 688799 - DNA, 365 bp, Homo sapiens
tggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaaaacacgcacacacgcaacacaatgttttcacgcctgtaaacctagcacattgggaagccaaggtgggaggattgcttgaggccaggagttcaaggctgcagtgagctatgattgcacactgtactctagcctgggatacaaagtcaccccctgtctc

SEQ ID NO: 688800 - DNA, 324 bp, Homo sapiens
  misc_feature (113)..(113): n is a, c, g, or t
  misc_feature (153)..(153): n is a, c, g, or t
  misc_feature (178)..(178): n is a, c, g, or t
  misc_feature (214)..(214): n is a, c, g, or t
  misc_feature (245)..(245): n is a, c, g, or t
  misc_feature (251)..(251): n is a, c, g, or t
  misc_feature (270)..(270): n is a, c, g, or t
tttgcttttcatttggccaactttgtccaaagtctccgaaaacaaaaacccaaccccggagctgactctgtgggccaaacactagagatgtaaccaaacaactccctagtaancggacttgctttccattgccaccaccccaactcggggtcntttcctcgaagaactagtctctacntatttccttcacccaggacctctcagacttcccgcnccatcgttgtaaagtccagtgtcccaatacntgggcntcctggagcactttgcacntatattaatattgttgtccatcacattgtattattgttctggttctcatttctg

SEQ ID NO: 688801 - DNA, 353 bp, Homo sapiens
tcccagggaatggtccatattatcagagggaaaggttatttaagtatgccagttaattgtcctgctgggctgaatttccatatagtttttactgggtatggggggggtgtggtatttattatagcattttaaataaggggaattcattttttattaaagtcattttcacgttagagcccaattttgggatgtcctactctaaagaaatataacacagtttcttttttaaaagagttcatttgttgaagcgctaatgaaaaataaatgttattaaatagtttgcaaatgactacttataccagtatgcatataatttttaaatatttgaaaggagagaggtggaatgaataaaa

SEQ ID NO: 688802 - DNA, 102 bp, Homo sapiens
gtcggactgcatactgggcgtattggcatgacctgcagtggaagctgcagctacgctaccaggagatctccaagcgaactcagcctcctcccaagctcccct

SEQ ID NO: 688803 - DNA, 258 bp, Homo sapiens
cagttatgaataccactcatacacgtcgtcaatattttgcagctatgtcctctgtgagctcatagccagtcccgcagctgctgtcccgctggacagaggaaagagcccactgtgatgatgcagagattctccaacgccagcagctgtggctgcccgatgatgcattcattgaccatcttcacaggaaaacaccatcagaacagacagctggatagcccacgaaagcagagagcagaaccacctcgatcaccctgtgtc

SEQ ID NO: 688804 - DNA, 282 bp, Homo sapiens
cgattctcagcacgggtgctcgattctcagagggtgctctctctaagctaaccgtgactatagaagctattacctaacacaattacatcagcaccatatctccacctccatctatcacctcaatccaaaaaagcataataaaactttacttcctctctttccttcttcccactcatcctaaccctactcctaatcacataacctattcccccgagtcaatctcaattacaatatatacaccaacaaacaatgttcaaccactaactactactaatcaacgcc

SEQ ID NO: 688805 - DNA, 345 bp, Homo sapiens
  misc_feature (190)..(190): n is a, c, g, or t
  misc_feature (242)..(242): n is a, c, g, or t
  misc_feature (268)..(268): n is a, c, g, or t
tggaggaatactgctggctagcagagtctggtggcgctctctgagtgcatcatgtacaaggtccccctcatcagaagagaagtcctttaggcgcacctctgttctgagcgttgccctggtgtaagacttcctgaagaagcacaacctcaacccagccagaaagtacttcccccagtgggaggctcccacnctggtagatgaacagcccctggagaactacctggatatggagtacttcggcnctatcggcatcggaactcctgcccanatttcagctgtcctctgttttacacacggtcctccaacctgtgggtgccctcagtctactgccccagagtggagaag

SEQ ID NO: 688806 - DNA, 238 bp, Homo sapiens
tccctatccaaatatcccaataatcagccattgctaacttttttttttccaaattttctcagcataatggcctcaattctaaacttggtttaagtgactagctcagtgggcaatgccagtgattagagaagaacataatcttcatggttgtggccctgttttctgagaaatgtgtgtactcctagcttgaggagggtccagctgatctgggaatattctcatgtcaacaaagaaaagc

SEQ ID NO: 688807 - DNA, 1353 bp, Homo sapiens
ttcagttccctttaatgacccccatctccctgaaagggcaggtgcaggcagctaggtgatgggcaagaaatgttcacttgaagacttggcccgtgattgaaggcttgtgcccacatgtgcgtggaaggcccccttcccaggaaaagatactctcaaaccagcgctcgtgggtctccttcgcgtgccaggattccagttttccgccagtggtgttattgactctcgtatagttccacctgtgccaattctgtggacttcaggcggaagaggcaagctctcctgtggcctcggaaagacccagaacttccagaaaagtggagcgtgcatattgggtgggttctccaaacacagggattgaccaccgtggccaacagggcatttcttctccttcaggctgtgtgttccaagttcggctgtgagaaccattttccaaggttgattgaagatctgtgcaccgcctcaagtgaagcggctcctgacagtgtggacgttctctatctcgaggggacacagccgaatatacttccgagaaagtataccccaagggggttaaccaagacgcgactccttttatttcaacaggtggcttccccaggaaacatttattggagcagtgggccccaccaagatagaaagcgtgtgttgactcccctccatttttgggcgaggtttaacgtgttgggcgcccattataacaatttctccattctccccaacaccgacacaacagaggggagataccctccttgggagcgcacaaggcgtgtgaaagcccgaaaacggaggggggtctccccaattgtgggccccctttttgcggcgcctcttcgcaggcacaaggtctccgagtgcgggccctgtgttatccacccgtcttttttcatctccgcgatatctttcgcggttccctttcaaggggaatgccaatggggggggccatgtcccggccccattatatgttccttccctttcgctttttccgcggcttcgagccccgtggggggggctctacacatggcatatcaatcattttcccgcgttgtggaaaaaccgcatttatactaccttatcatccgcggttgaatgatagttggcctcccatatacataaaaggtgattgtgggaggctccctccttgtacaaaaacttttcatctacagcgcccattcttacacaacgctggtggggcccaacacatcattatcttcaaccacaacaaggttttacaacagcttttctcccccccaaaaagaaagaagtgccccggcgatacactctggaggcgtgtggtgctataactgtcaacgtgtctcaacgaagacccacataggtgtgtctgtggaacaacattgg

SEQ ID NO: 688808 - DNA, 331 bp, Homo sapiens
ttgcaggagagagaactgcttgaaccaggagacggaagttgcagtgagccgagatcataccactgcactccagcctgggtgacagaaagaggctctgtctcgaaaaaaaaataaaataaaataaaataaatgggctgggcatggtggctcactcctataatcccagcactttgggaagctgagatgggaggattgtttgagcccaggaatgtgagaccagcctggacaacccagtgaaaccccaaaagcccatctctgccgaaaaaagatacaaaaattagccaggcctcatggctcctgtggtcctaagctacttgggaggctgagatgg

SEQ ID NO: 688809 - DNA, 1910 bp, Homo sapiens
  misc_feature (488)..(488): n is a, c, g, or t
acgccatgcactccagcctgggtgatgagaatgagactccatctcaaaaaaaaaaaaaaaaaaagaaaaaaagaaaaaaaaaaagatgaaacttggttaaagggtagttatttaattcattggtgtacattggcttaaatttctaacatatctagaaattataaaccccgggaaagccaggaagtgttggtatcccttagggcttcatggctgacactagatgcaaagtaagcacacaacacatattggtgcactgaatgaatgtgtaatgaattgagcaattctggactcttacaaagggcttttatcatgatcaagagactattcaggggaattggcgaacatgggatttgggggggaagagcctcctttggtccaattatttatcttctcctccatcttttcctcctctatttcttcctctcatccaaataatacataaccatatccagccaaacccatttaaaaaatatggtccctaatgtaanggtggatttccagccaaaatgctggtaactggattctactgggccaactcttacgacaaaacaaaccacaacccaaaaagggggcggggacaaaaaagcataccgcagaggggcccaaaagaataagcggcacccacgtttcttgcgccacagggccccatatagaagacaccgaaataagagaggacagagcggagagttacaacggtcgcgcgcgcgacactgcgccctcggacactggggaagaccgtacccgggggtgggcactgggcacacaagaaaaagccgggaataaactacgggtcgcggacgcgcagtagcgcgccgataggcgtactatatagcatacgtgctgacaaaaacaatgcaacagacacacaaacagagacatacgcacacgcgtaccagactagacactcctacgtgcgctatcccactcaccacagcaccacaaaacaaacacatagccacgaaaccagcaaacgagcacacaaccaacacacacacactaacaaaatagcacacacacaagcagaccgaccgaactagaccatacaaccagaagcgaaacgaataacacaaacacaacaacaaaaaaagaaggacgcagaagcaacaagagcagagaaggagcgagaacagcgggcagggacgcgagagacaacagaaggagagcagcgagagagacgaagagaagggggagaaaaaggagagcggagcaacgcgaagagggagaaagagcgcagagaggagaacgaaggacgagaccgagacacgcaaggagacgaacaagaagaacgagcacagaagggaggcagacagaaaagaacagaccagagcaagcagcagagagggagaaaaagagaaggaacagaaaaaggagaagaagcgagagaaagacaggaaggcaccacgccaacagaagaaaaacgaaaagacaagaacaagcaagaagcagcaaagaacaaaagatgagaagacacaagaaaagagaaaagaatcgaagaacacgcgtgagaaaaaagacaaaacgacaagaaagacacgtacgtaaagatacgggaggagagtgaaaagaatagaacgaaaacgaacacagacacgacaacggaaagccaacacaaaacacaacaaacaacgagaggcagaaaggcagaggagcgagagaaagagacgagcaagaaacacagacagagaagagacgaaaagacaagagaagaagcagcaaaggccacagaaggcagcgcaggtgcgaaagaacaaggagagggaacagcagccggcagagaagcgagcaaggaacaacagacagaacaacgatcgaaagagacaaagcaaaagacaacaagaacaaaaagacacaacaggaacaacgaagacgacgacacgaagaaaggagcgaaggaaaaaacaaaaaaagcg

SEQ ID NO: 688810 - DNA, 404 bp, Homo sapiens
ggtacccaggcatgcagcgtggcacgttagcctacacagttacccaaataaagcataggcgatagaaagtgaacacctggcgcaatagcatattgtagcgcaagggaaacatgaaaaattactagccaagcactaatatagcaaggactaacccctataccttctgcatattgaattaactagaaattactttgtctggagagccaaagctcatacccccggacaccagacgagctaccttatagcagctaatagagcacacccgtctatgttgcacaatagtgggaagatttataggtagaggcgacaaacctaccgagcctggtcatagctggtgctcgaggcataattcttagttcatcttttaatttgcccacagaaccctctaaatccccttgtgaatc

SEQ ID NO: 688811 - DNA, 206 bp, Homo sapiens
  misc_feature (15)..(15): n is a, c, g, or t
  misc_feature (90)..(90): n is a, c, g, or t
  misc_feature (99)..(101): n is a, c, g, or t
tgccttgctacttcntgcaaaagtgattagaactaagatgcaggggaaattgctaacattttcagatatcagaaaccgcctcggtcattntctactaannnttcatgtatcattatttttacaaggaactatatataagctagcacataattatccttctgttcttagatctgtatcttcataataaaaaaaattttgcccacgac

SEQ ID NO: 688812 - DNA, 201 bp, Homo sapiens
  misc_feature (5)..(5): n is a, c, g, or t
  misc_feature (79)..(79): n is a, c, g, or t
  misc_feature (136)..(136): n is a, c, g, or t
tgcgncactccggccctcactgcacgcgccagcccttctttgtgcggtacgggtaaacagagggcggagccccccttgncctcgcctcccgctaaccattgttgcctccatctcttccgtagggcttctatttcgnccgcgatgatgtggctctggcagccgtgagccacttcttccgcgaattggccgaggagaagcgcg

SEQ ID NO: 688813 - DNA, 329 bp, Homo sapiens
tccactagtgtaggttaactttgagtaaaaaaaaaaaaaaaaaaattgtcccaaaacagggttaaaacaggggccccgttcccctctccctttccttttaaggggcataagggggggggaaaaccctaatttaagggtccaggattgaagggccccccctttcgggttaccttggggggccacaggtttccctttcccgtatacccccgggaaaatggccctgacctccttgttctgggccagggcaagtatccagcgcccattgccaagggaataaagtttgcccgggtttatttgcccaacctcttagcctgggttgcccccttttt

SEQ ID NO: 688814 - DNA, 115 bp, Homo sapiens
tatttactctaactggtagcacaatactgaccaacttcttcattcgctcatcatagtctgtccaatcacagacaatctgcaggcaatgagccaagttacaataagcatcaggaag

SEQ ID NO: 688815 - DNA, 120 bp, Homo sapiens
gcggccgcctactactactactactgctcgaattcaagcttctaacgatgtacggggacatgtaatcctcaagaaataaaaggaagccaaagagtgtatttttttaaaagttcaaaaaaa

SEQ ID NO: 688816 - DNA, 476 bp, Homo sapiens
gctgggaccggggcaatcgggcctccccgatgtcgggccagagggggctacggtgctccgccctccgcccctccaccacctccgacacacctcagggaggctcccagctgggccactgcatctcggagaacgaggggggtgctcatggctatgtcaacaccctggctgtggcctctcagaattgagggtgaagggcacgggtccattgcttcacgcggttgagagtccccaaagcccctttgtcttcataccgttctgtcacctagatttgatcagggtcgtacttcaggacagcaggtaacccttatacagggctaagcggccagggatgatcctatctgcacccatggggctgaggacggacttgagagggagacctagtcagttaacaggctgcagggaggtcaggtgcaccataacccgtctacctctcgttctccctactcctacccctaatccgtgacctccaaagtgga

SEQ ID NO: 688817 - DNA, 179 bp, Homo sapiens
cgcatgctttgggcagatgcgtggagcacccacagtgaggagtgcacagggaggactcaggtgagaggtgatcggagttgggcgggctgcaggagagaatgagagtggttcggattcgggatgcgtatcagggtagacccataggatatgcggcgttggatgcagtcggtgtccgaggg

SEQ ID NO: 688818 - DNA, 130 bp, Homo sapiens
aggcgaacattttgccaaagagcgtgtttccacctcgtgccctgggaagacagatgggcccaagcctggattatcatgaacagggcaatgcccagacaccgaggaagctttggagggttgagccagttat

SEQ ID NO: 688819 - DNA, 232 bp, Homo sapiens
ttagaggatcgcttatgctttgggacggcgctgcggaagcggggtgcctgaaggggagctgcttatccggcttcttcaactccttcaatgaggccaccagggttctggtctccgggatcatgtggtatgcccctgtggccatcaggttcctgggggctggcaagatcgtggagatggaggatgtgggtttactctaagcccgccgtcccacaagcacaggcggtaccgagct

SEQ ID NO: 688820 - DNA, 308 bp, Homo sapiens
cgatttttttacaagatacgagatttcgcccctcctcctttcacccaagcgccgataaagaatgcatctggctatgaccgacgataggaacaagcctgcgcctctgggtgagcccttcaagtgctcaaaaccttagcccggaggaagtcactatggcaatgccagttcccgtctccaagccgactgttggtattgatgtcgcaaaaaatgaattggtgatttatcacgccgatctcgatcttttggaagcaatcccgaataccaaagccgctatcaaaaagtggctgagggctttgccaggtagcgtt

SEQ ID NO: 688821 - DNA, 902 bp, Homo sapiens
actacaaactatcaatagtaccatgagcttggtcaaactactacatgagcgaggcatctctgccaaagtgtaccacagccaatttcggagcaaaccccgcgtccagcctcgtccgctaaattcccatggatatcggacttccatcaccaacaatgttcaactatctcaatcagcttggcctcttctccttcacctctttgagcctcgagttgcattctctctgagaattgagaggcctctcgacagctgagacattcctccaggagatgtatggcttgagacctcgccggagaccatcctgatggttggccagttgaagatgaacttaggtggacaggctgtaacgagactgtgcggatacgccagagtggtcaagaaccctggtgcccaagagaatggaagatgccaggaggcagaaattggtcctcaaaaatcagattctgctgtttatttaaattcaggtagcagtttattaggtggactaaggaggactcagagtcttccagtcataatgggtagctttgatgacccagtttgcacatctcaccccaacaatgggtgtccctgaaggggaggactgagcgtcagccaggttaacttgatctcttaatacaagtgcagccacatgaaggatagatatgccggacgacatgtggtctggtctgacttgcggagcaaaggatgtcgcaccggttgtgcatgtgcacgcgggacaggcgatggaactcacatgggatgagcccaagaggaatcgggagaagtttcaatgatgggccgacgtcagaggcgaaaaagctaaaaatcctcagagtatgttggagtaaggacaaagaacaacacaagcggaagaacggcttctgtactaacaaccacagtgcaaagtcgttaccaggggcacaaac

SEQ ID NO: 688822 - DNA, 860 bp, Homo sapiens
ggcagtcgctgcagccgccgggagggtccgtgacaagatgaagctcatcatcctggagcactattctcaggcgagcgagtgggcggtaacatacatcaggaaccgtatcatccaagttaaacccaggccagagaagtacttcaccctggggctccccactggagtaccccatgtggttggctacaagaagctgatgtgaatactataagaatggggaccttgtcctttaaatatgtgaagaccttcaactctggatgagtacgtgggccttcctcgagaccaccgggagagttaccacttccttcatgtgggaacacttccttcaagcacattgactatccacccagaaaaaacccaaattctgatgggaatgcaggtcgacctacaggcagacgtgtgatgccttgtgaagagaagatcaaggtgcaaggtgggatcgagctatttgtgtgaggcatcggccctgattggacacattgccttccaacgagccaggctccaagtctgttgtcccaggaccgtgtgaagacgctggccatggataccatcctggcaaatgctaggttctcgaatggagaactcaccaaggtgccaaccaatgcctttgaggttggggggtgggcactgtcatgatgctaagagaggtgatgcatccttatcacaggtgctcaaagggcattggctctgtacaggcatcgaggagggagtgaccccatgtgacgggttgctcagagatcccaccggttgtttgcgggagccctgggtaatgaacgcacgtataaggtagtggctcaagtgggcccgtagtacgaaaagaaagctttaacacggatctggggagtacagaaggtgaatgaaag

SEQ ID NO: 688823 - DNA, 127 bp, Homo sapiens
cggatctgacttaaggcgtcagtcataatccacagatgtagttgccccattggtctcagcagaatacacaaatgttgaactgcgtctcctcgtactgagcaggattaccatggcacacacatcatca

SEQ ID NO: 688824 - DNA, 124 bp, Homo sapiens
agggcaagccgagggccgacacgggggggcctgacacgcagcaggagggcgccgggcagacaaggccgggggcgaggaagccctgctggggcgctccaggagaccaacgaaagccgcaggcgca

SEQ ID NO: 688825 - DNA, 927 bp, Homo sapiens
aagatagctccttcatgcttttctcatggtattatctagtaggtctgcacacataacacacatcagtccacccccattgtgactgttgtgcctgtgtcatctgtcagcttcccaacaatactttgtgtcttctagttctctctctggtctctttctttccaaaggttgtacatagtggtcataaggtggctctaactccttgatgtcttgagtttcatttactcattttctctcctcggtggcatcagctgccatacacaacaatacaggaatgcatcaatgtgctgttgcttctctcaatccacagtcatcgcacttgtaacactgtgacattccacagagttactgccaccggtcctttgagctgtccaggctctgcactctctcacccatgtgccgcctccggtacctcactggctgccatcctgccttcatgatatcctgattcagcacaacgtggaccttaccttaacacggcatagcaactaaccgtgacgtgctccatgcctccatgcatgacacctaccccagactccgagcatccctacctaccaccacacagctcaccatgcaacagctgcctaccggcgagaccccacccaaccccaaaacccacagacacaccacagcaccacacccccgcacgccagcaccccgccccaccggcacggaactaacgggagtagcggcgacacgggcgagcagtggacacacccgaccggcaacaacacgcggcctccaccatccataaacaccccccacagccaccgcaccgtcccccagccggccctgcccacaacccaaccacgatgcccgcagaaccagacgggaccacagccacgcgccggacaccgcgtgcagccacacgaacaccggggcaccgaccgcaaaaccgcgacaacaaacagacaacacaccacacacgaa

SEQ ID NO: 688826 - DNA, 229 bp, Homo sapiens
catgtggtcaactggaccgcgactctggtcgaacggctgcgccgccgttatggcgaccgcatgacgatccacgccggcgatgcgctggccttcgatttcgaccagctgaagcagcccggacgcccgcttcgcatcgtcggcaatctgccgtacaacatctcgagcccgctgctgttccatctgatggagttcgcggaccatcgtgcggccaacaatgggggatcctcta

SEQ ID NO: 688827 - DNA, 560 bp, Homo sapiens
aacaaacttgtactgtttgcatatccgatagtaacattttagagtgcttcttttttttttggaaacagagtttcgctctggttggcccaggcaggagttacatgggcaggatctcggctcaccacaacctcgtgcctccccggtttcaggttgattctccgtgcctcagactccgtgagttagcgtgggatacacaggcgtgtgccaccacacctagctaatttggatattttaagtagagacggggttttcgccagtgtgggctcaggcgtggtctcaaactcccgatctcgggtgtgacccgcccaccttcggcctcccaaaggtgcggggattacagggtgtgagccatgtgcacccagtgtaagaagtgctctctttactatatcacgtgccttctttatagggatttatactagtctctaaaaattaatttttcattacagaacttttgggaaaattacttcagtaaatagagtagatatttaaaattcaccggcaggcctactttccagaagtaactctggttattaccattttgggtttacttttcccagtcc

SEQ ID NO: 688828 - DNA, 171 bp, Homo sapiens
cggccaccctcggcatcgaatgcaaggcactgaccgggttgaacgctctaagaggctgaaggctgcttcttggatgccaagctgggccctaacacggctctgtcacagcccagctgaaataggggaccccgtcggactggacttaaccaaaactccttgctgaactttccc

SEQ ID NO: 688829 - DNA, 468 bp, Homo sapiens
  misc_feature (468)..(468): n is a, c, g, or t
tcgcaggtcttattcacgttccgactgatgtgtatccgcaactcgccgaggttagttgggtcacggtgccagccgtgctgacaagaggactctcccgggagacgaatgaggaaccatctactactactgttcaagtacaggagcctggtccgaaagggctagaaaagcatacgacgagaactggctaacattcgagatccgtccagccactgacgccgagtgcagagacatactggggatgatcaaggagctggctcactatgcatggacgaacaaggaatattaactgctaacgatctgctggaagacggttttggagagcacaggtttcaccagtgtatggttgcagaaatgtcgaaagagcactggactccggaaggtaaccccaagccctttacagaagccagagagaccaagtgctatgctagaagatgctgtaggctgtgctgccactgacgacacggccgn

SEQ ID NO: 688830 - DNA, 120 bp, Homo sapiens
  misc_feature (56)..(56): n is a, c, g, or t
ggtcattaaaggtgaagagatcagcgtggtccccaatcgggggctggatgcccagnctgtcccccgtcatcctgggtgtccaggttggaagccagtgcctgtcatgtggggtggggcagg

SEQ ID NO: 688831 - DNA, 225 bp, Homo sapiens
aatgttgagctggtcagctgatcacagagttattgatggtgctacactgtcacgcttctccaatttgtggaattcctatttagagaacccagcttttatgctactagatctgaaatgaaggctgattaggcattcttgaactttttgagcttccaaggggattgtgaccctgctgtccagcacatgtcatcttccagttatatggacagcttggacgatgttagg

SEQ ID NO: 688832 - DNA, 1286 bp, Homo sapiens
  misc_feature (346)..(346): n is a, c, g, or t
  misc_feature (428)..(428): n is a, c, g, or t
  misc_feature (525)..(525): n is a, c, g, or t
ggccctctaccaactacattgtacacatgcacaccagccgctgcagggctcccatgggactgagtggggagcagttttcccctgggccatcagttcccagactcccctccgcccaccgccacgcatacatcagcagtgccgcatcgcatggacaagggctaaacatctcccagcgtatatgctcggcgaccactgtcaaccctggcgtgcgggtccctctactgcccattggggtgtgctggggacattaggcgtctctgggctctttggatcttcgcgtgcggcgcccctcgtcatgctccttcacttgtatcccatctggctttcacccataggtggggacctnggcgctagggattgccgcactgagcactatgagagacaggcgggcccagataggcccacggatactacgatatccttgggcnacggaacctttaatcgcacatagtctccttgggccgaatcaagtccaagggtggttggaatcgaaatcgggtagtgtgggcggttgacttggacgcncgcggcaaaggttaattgcccctttcttagctcagggactccgttcctgttttgtgcgagcgcgaacgagttgggggtgcgtgaccaactgtttggtgcgatatcccctttgcgcacgccaatctgtttccccggtgaaagttcccccgccggttagcgtaacgcgtttaggaaccaacgcgcccccccttttccgagggcataaacgaagggggaaaccgggcaaccggaacacggggggtacgacggttccccccccttaaatgtccccacttcggttacaatcctatgttggtcgcacgaaccaaggtgcccgcaccccttttggggacaccttccgcaggggcctggggggacatacctaagagaggttaacccattgacttttggtagggggtggcaacttggcggcacgaaaattgcgccaggttccccacctttacagttctggtccccaaagagggttgaacagaggggccccacgaacggacagcctcctttggatgggagaccaggctccccacactctttgcaccgcggttggggcgtcgtaggtgggcggcttcgatagtcaccccgcgataaaaaaccccacgatacaacattttatattggcgtcgattaccacggggggcaccacatccgaatggcgccaagattatatcaccgcccgcccgttgccactatccagggacaattggcgcgtgggcaagcgcgaaaacaacacacacatggagaaagacgatccaacagcgccaatg

SEQ ID NO: 688833 - DNA, 707 bp, Homo sapiens
  misc_feature (707)..(707): n is a, c, g, or t
ggacagtgttgtgggaagggacagttagatttacgccgatgaatatgatagtgaaatggagttgggcgtaggtttggtctagtggtgtagcctgacgaataggggagaatcagtgactgacagcctcttatgatggcaggatacagctacctatggataggacctactgagaagtcgcaatgctacagcgtgaggactgtgtcagggtaaaatcacagattgatctacgtagattgaatgtggggtacattgagcaataggctagtgcagtgccaatagaccgggagagttacatgaagtgagttaagagctacctcaagcgcgggttctacatagagcaccatgggcgatggcatgatcgagaaaaccatagttggcctgtagcgagagggcaagatagtaggagaggatcccaaactacaaacacacgtcttggaccgcgccggtgtggggagtgcctaaacaagaagtggattctgaatagaaggacaggaccgggaaggcgtaagtaacagcactaggtcctcggatagctgagcccccgttgagcgatgctcatttcacataacccgtaaagacaatagtacatagagtgtgcaagttggtacttaaacagaagatacacatccgggtaaatttgagaagagacacgtagccgacttgaaacaatttacgcgttcaaggagaacacatatggaccaagatan

SEQ ID NO: 688834 - DNA, 418 bp, Homo sapiens
ggggggggcccaattaatgcacaatatatgtagtccaaaatagcccctgatataactagaatctttaaggtattataacatatgatgaaaagtagtaacacttgtagtatggttctggttagaaagcactttaacaccaaagaaagttaagtttacaatgataaaataatatcaggaggtaagagaggttaaagagatggagaacacttattctgtaagccacacttctctgaatgtgccataacatcgtttgtctaaggccgtgagtgtctgtgattctgagtggaggttgaccatagtcggccgaaaaatcggtggttccttcatcaatagtcaagtcatgtcgttggcagaattagaagtcacgataaaaccccctggatctccagaaatgcatgtattccacgacaaacttggc

SEQ ID NO: 688835 - DNA, 198 bp, Homo sapiens
atcagaaccattctgagcaaatgagtgtcctaggggaagtggactgagaattgagcttcagtcgctactgagataatatgccatgcccagacgtacttcgctgaggcagactatattgtgtatagaggaaccggctcattctcctctgtgcctagccacagcaatcgtggtaggggcacattccttggcctttaggta

SEQ ID NO: 688836 - DNA, 1215 bp, Homo sapiens
  misc_feature (182)..(182): n is a, c, g, or t
cgttcgtccgtaaagacctgagatcctgtgctttctactctccaccgtgaacttgcatgatgcttcagccactcgctagcatgcttctccatccatacctacacggttcaccatggggcatactgatccgagaggctggccgcagccataacgggatgaccactggccaggttcacgagatncagtcgggtcagtaggtactatgcacgtggcgctggtaggactcatggttcccaggatcttcactgttgctcacctgctactcatcagagtcttcatgagaggcggagcatatggaggtcgcggtggtggccttgcgctaccagggatgagtcctggcgggtctagtgcgtggacattgcgtgacgtgcaatccatgaagcggaaacaaaggagagatcgcaattgtccacatgtcgctagagaacgcatccaggactagtgtcgcatcttgtatcctctgcgcacactggaagctcgtagtgtatggcttgcgaaggaccagaatcaaatcccagtgatgggacattgagcatcaagacctaaaaggccacgtgagaggctccattaaagtagagcaacttgaacggtggaaccacgaattagtccaagaatcaccttggccgttgcaccaatttacctgtcgagttgcattccattcccgaggtgaccctgtgacgtggactcaacgaattctttcacgttattagtgaccttgttgagcgcaaattaggccccctgtgaactctcctttcattgtcacagaaatttgggggcccttcttggcccccaggttccttggtgcataggcatgtatctagcaactttttcacagtgagcatcaaagcctaatggacaaccatcgggaagcgttggggccctaggggccaagcccagggcgccttggttggcatggtaaaaccggaaccctattcccaaattgggagccaacgcagattgacactggttgcaaccttaggaacgtgtaaaccacgcccaaacataagttccagcaaacggaataccatggctatgtccttgggcagcacccacggcacgcagtccgacggggttcattaaaagggtcacacgtaacactgtgtgtgcgtctctccatgggacacggcacagaaaagccctgcctgcaacacaacacggggacatcgggcctacagacgctgtgcttacaccaaaggccctccgcagacactggag

SEQ ID NO: 688837 - DNA, 582 bp, Homo sapiens
  misc_feature (440)..(440): n is a, c, g, or t
acgctctctctgtggggaaatggtttttcttcttgagacagagtctcggtcaaccaggtgggaatgcaggggcacgatctcagctcactacaacttctggtctccccagttcaagtgattctcgtacctcagcctcccgagtagctgggactacaggcgcccgcaaccacgcctagctaatttttggcatttttagtagagacggggtttcatcgtgtgggccaggaggggctcgatctccggacctcgtgatctgcccacctcggcctcccaaagggcggggattacaggcgtgagccactgcgcccggccctaggtgttatatttctaaagacatttttaaaaaatataaatcagatggtgccttctcggcataaaactttctattggctcccaatgccctgtggatggcttatgcggcttccacagctcaagcctgnttgcctatcttaagctcttacttctgtgaaggcacctccccctattcccttcttggctctgtcttctccatgtctgaagcactgactggctagtggactccactatgccgatatttcaccattactccatagttacgtctaa

SEQ ID NO: 688838 - DNA, 151 bp, Homo sapiens
gtctgtgaagtgacatcgtctttaacctgcgtggaatccctgacgaacgcgtgatgccaggaagacaggcgagctgaagtgcaactatttcttaagataatccactattgatgattatcgaatgttcattgtggagagcaattggttcaag

SEQ ID NO: 688839 - DNA, 351 bp, Homo sapiens
tcagcagacacagcatgtattgaatattgagcctattatgtaaccctacagtgacctccaagtgtttaaatgacaaggaagatttgcgcatctctcattttaaaccaaatgttaggcatgatttagcttagtaaggaaggcttgtcaaaagctgagagaggccaatagctacgtctattatgccaaacagctaagtcgtgaatgctaaaaacctcttcgttcagggaagttaaaagtgctactccagtcgacacacaaataataagaaagcaaaacaaccttattgctgatatggggaaagcttgattggtatggaaagcagatcaaaccagccataatattctgcaaagc

SEQ ID NO: 688840 - DNA, 131 bp, Homo sapiens
aatagtagtggacctgggactggaactcagatttgctaaggaaccaggcaggtttattcctgttttctgcacgggagcattttaaccagccattaaagaagcctcctttttaggtaaaaaaaaaaacaaaa

SEQ ID NO: 688841 - DNA, 1025 bp, Homo sapiens
ggacacagaggacagctggtcaccagtaccacgtatcctgtaaaattggagggccttcaaggctctcatacgctgctcagttacagacggggctcacgtacgcgctgctctgcgaacgaacccacttccatttaggcgagaccaaccggacccctgaatttctccgaaatctcctgccgggccgtcccatcattagaggggtgatgatggattcatgtgtgtctgagagcaatgcgcaataggctgagttagtgtgagccgaggtgaggaggctgcgtgtggaaagttacgtccgggaggtctgggagtacaccaagggtggatgctgggcggtgagcgtttgttgatacactgaatatagtgcctccgggaacatttacgcatgaggtgtccccactctttgggcatcatgtcgacgagcaacaaaaggacactgattaatgcaaaggaggactctgaggccgaattcctcggggctggctggatgcgtcaactaagtagaggacggagggacgtgtgtcttggtgagcagcgagacagacgggatcatccgcgcatgaaatgcgacagaatcgctctaggaccctgctccgtgggtctatacagcatggttgctatgaaacccttcttatctcggcaggggcttaacccaaataaggcatccgattgggttcctccacctggtaaacaagctccagtgccgggtgtcttggagcgaagtgaaactgtgtgaaaatgtggtccacgccgatgctaaaagttgggagacccacctaggaaggcccccccgtgcgagaccgctccccggcagaacagggacagccagggaagccgcgagggagaaagggctggcacgccccggtgggatggagatgtgcaccccaggctgtcgagcaaagccggcctcgctccaggcgcaaactggggtggacgcccccggccagagagcagccagcggagagagcacccaaacggcgaagcagaccccagaaaacaagaggctataccaagcacacagaacaagc

SEQ ID NO: 688842 - DNA, 1072 bp, Homo sapiens
ctccctagatgttaatgtttagggttgcgtgttatggctttaagccgggattccggtggtttcgtgccatgtgctatcgccagggtttattcgcgccagctgccatagattcctccggttacgaggagtgtgtggataggttgccttcacaggaaacagagtctttcgcttgaaggcaacacttctgtggtaatgggaaataaacgttgttaccaatgccatggctgagtcccctggctgcgtgattggcatcttatgctagctgaccgtctgagaccagtctttctgacacaacagtggaagcgcaagagtgccatcagagcagactttcagctaagatgggatcctttcttcgtcctccagatgtgaactttatagatcggcttagattttttgtccaacattggccatagcagatatcgttgaacaggcaggacatttgcagcgttgtcttactggactttttctcccaacaggacaatcccaggcagggggctgacatgtaagaggaatggaacctggagcctagtattaattgcccactctcccaccctacccagttgcagcccggtaagggcatggaattgggaggcctagggtgtgcatgaaagcttgggaagcactgtcgtctctcagacaggcgtcctaaagacctctaggctggaagcattaggtttcttgcaagtggatccaggggaccgaggggtaggtctcttgcactaccgccaggaacttggaccaaggcagagccaatcttgcaaactggcccatggatgggtaacctgcccggtagccagcatgagccacactaggaaagaggaggagggtgcagccaaacttaaggcaccggcaagtgttggtcagcactggaggagaccccgccagtggggtgaggccagccaagtcccatgtgttacgaatggtgggccaaggggctgtctgctaggtcaacatgtaggacatggcagagcgtccaggctggcaaccatggaagcctcaggaaagagctgggaggcaggaatggcacactgtcaggctgcccattctgactggaatagccggctcagcaagc

SEQ ID NO: 688843 - DNA, 869 bp, Homo sapiens
cggggtcggagccgtcggggccaaaggagacggggccaggaacagtgcagtctcggcccaactgcggacgctccctcctaccccctcgcgcaaaaagacccaaccggagttgagtgctgctgcccctgaaggccccaccttacacttgtgctggggtgccgtgagccatggctcccaggactgctccagaaccgagggaagctcgggtccctccaagctagccatggtgaggcgccggaggccccggggccccatccccccggcctgaccacactgccctgggtgccctcctccagaagcccgagatgcggggggccgggagacaacactcctggctccccagagaggcgtgggtctggcggctgagggccagggcccggatgcccaggttccgggactagggccttggcagccagcgcgggtggcgaccacgggcacccagagaaggtcctccacacatcccagcgccggctcccggccatggcagccttgcacgagcctcttcctcaagagccctctagggtcatggcatggccgtggcagcggggcgtggtggcgggccggtggcaggaggccggcctgaggggtctccaaacggccgcgcggttatgccaacccggtgtggacagccctgtccgactacggagcccagctgcggcacggatgagctggccctgaggcccgggtgaccgtgctggaggtcgctgtcccgcggacgccacccatctccggacgacgacgcctgtcgcccggcgccacggcgcgtgcgcctgtgcgcatcttcccgtcgaactatgtgtctcgcgggtcgcggcccggcccccttgcgaggtggccgcttcctggcactgccagttggcgaccgtgcc

SEQ ID NO: 688844 - DNA, 1078 bp, Homo sapiens
gcacgttagagcgtccagctcatgagtcgtgttgataacttgtcagacacacacacttttccgcgcgaatgcgagctcctaaagaaatcaaggactgtggaatctatagagctgatcaatcagcgggcacgatataggataagaaatagtacaggatgtgttaggtggcacccagggtccactatgaacgaacgtgagcctgtgaacgcatccaatgagtgccaccaatccaggcgtaccgtttccagacagcagcgttcagaaggggcacgagacacggctgttgaactaagcacagagacttcccacaaccacaagcggccccgcgtgaggagcgacgccatgacccccttcgatcgcctcaaaccgatgaccgcgaacgaagcacacccaatccatgatggaacgagagatagcgaacccgatgatgacgaggaaaagcgaaagcgggaagccatgcacatgcatgggccagcagagtgtgagagcattgccaagaatatgggagagccttcaaaccgttagtggcagaagggcaagaggaacaaacaagtagtaaccgagctgaaacaaagggagtgtatcgtacgaaaacgagtaccagaagcgcactaaaagaaagaatgcatcgagaaacaaggccgggggcaaggctgcagagacagaccccaacacatcggaagcgaacagtcatagcggaagacctgaaaacaagaccgaaaggagaggaacgcaaaacagtacacattggacagtgctagacccaagataaaccgagggaaatcggacagtagacaacaaggttacctaaagaccaccgagagttagctaagccctgaaactaatagaggaagactaccccaagagacagggtacacctaacgaagatataacaacaacacattggaaaaagaggcgccagaggaggaaagccaccttggacacattatagcacacaagagctagaaaaaaaaacggagataagcaccattgagagaaggacagccttaggcaagggcccaacgaggaccagagccacaagagataccatcaacaaatgctcgcgcaaacggatggg

SEQ ID NO: 688845 - DNA, 768 bp, Homo sapiens
  misc_feature (713)..(713): n is a, c, g, or t
ggtacccgggtcaggacggatgtggattggaggggagcatgggcagcatcttttaaaaatgcaaacatgatgatagtgcttcatgaaatgctaccagagccaccgtacctcctggccggtccattcctctagaggttgcactcctctgggcctcagggcctttgcacaggcagctcctgcttggagtgcctcctctccctctccccttgaccttgtcattgatcccgacccagtcttcagagctcagctcaaatgtcactcccttaaggaaagacttccttaactgtccccacttaggggtcccagttagctgttcttatacccccacatgccccctgaagtttggaccccagctgagtgcagtcactgtggggcactgcgtgacatctgtctgtcttctgtaaggtcaggggcccttcgacctgagtcaccgtggggtcccaggacctgccgtggcgctcactctctaaagactaaacagttgcagagaccagtgaatgaaagtgtcagggcctttcacacacatcagcttactgcatcctcaaagcatccctgtgaaagagggccctgctttaccaggaggaagctgaggcttggggaggccagggtcatgtgtcgatgaagagccactggtccacactgcccagtccccagcactccctccctgcagcgcccagtgctgacttggtacggctttcattgcttgttttccntgtgtttggatctttcatccttgatgtggcccgcacatccgtactgcccgggtac

SEQ ID NO: 688846 - DNA, 335 bp, Homo sapiens
tcacggagatttgcttctgttaagataattaaaatgactaatgggccaggtgcagtgtctcacgcctgtaatcccagcattttgggaggccgagacgtgatccacctgatccacctgaggtcaggagttcgagaccagctgcgccaacgtggaaaaaccccatctctactaaaaatacaaaaatcaaccaagcaaggtggcgcatgcctgtaatcccagctactcgggaggctgaggcaggagaatcgcttgaacccggaaggcggaggttgtggtgagccgagatcgcgccattgcactccagcctgtgaaacgagcaaaactccctctcgaaa

SEQ ID NO: 688847 - DNA, 797 bp, Homo sapiens
gtgatttcagtcctcgggactgagcgtttacgtctcgaacgttacctggtcccgtcggcctgtacaattaacaacgcctttatttccattgttctcgcaaataaaactcggtaggattagtgtccgcttattgggtgatatagtcaaagagaccaaatcccatatcctcgtccgactcctccgactcttcctatggcttcaaccttagctggggctgcagcagcagtcatggagcatgctgtggtggcagcagccacaggggtcatgcgagtccacaaaggcagatggatcagccaaaaaggccttgaccttattcagcaagtgggaaggtagtaatccgtctccacagacaaggccaggactcgtttgtcacccgttgatgatagaatggggtactcgatgcaacagttgggtagccaatctgcagacagacactggcaaccattgcggacaccctccaggaagcgagaatgcagatgttccctctgtgatatcaagcacttacagggttgtagatgctgccattgtcgaaccacttgctggatagaccagcccaaaggacgaagtggggagatgttgagctttgttcagcagcgtggtccagctggctcccattttgtctccgtcttgatcaagttgcgcatccactcaggattcaattggtgcccctggagatttcgtggtgatacctaagcctggcaaagggggtcttctcggccgagaccgtgttcgggctgccagtgacttcccttgggcaagggcccagcacggcaggttggccttaatggcgcactgtc

SEQ ID NO: 688848 - DNA, 104 bp, Homo sapiens
tacaggagctgattatccccaacactatgtacaccagctgtatgagtacagtgatatcttgaaggacacttgggatctctatgaagtttgactggacaagaaaa

SEQ ID NO: 688849 - DNA, 813 bp, Homo sapiens
  misc_feature (284)..(284): n is a, c, g, or t
accaaatctaatatagttacagaataactgcataagggcttcccttctggagactcttacccagcatgggaacagtgatctgcccacatgacaaggtggtatgccaggcaaagataactgcttttggttgtgaggtactcactcttcctttagttacccttagttatgtggcacacatgtgccttgatggctagtacgtcatccaaactggggatctggtgaaaaggctgtaaggtatccaacgcttaaaatatattagtatatgggtgcatgaacaacgaatnacttggaattctatttaccttcactaatgtgactacacggaacatttcattgcagttaaagagaaattatatcagtctattaggctggtgtgcagtggtatcatgcctgtaatcccagcagttgtgggaggccaaggcgggtggattaccagagtccgggagtttgagaccagttgacaaatggagaaaccccgtctctaataaaaatacaaaattagcaggtgtggtgggcatgcctgtaatctggtactcaggaggctgaggcaggagaatcgcttgaaaaccaaggagaccgagttggcggtgagttgagatgcgcattgtactccaggcgggaagaacagcgaactctggctccaaaaagaaaaagaaaaacaaaaaatttggggggcacggcccaaaactaaaacccacgtttggcgccgcccaaggtataaatggcaaggtccagaacccgcccgcagggggtttcccaaaaccggggcgggtcaaacccggtggcctcgtccacggccctccccccgcgcgg

SEQ ID NO: 688850 - DNA, 999 bp, Homo sapiens
agcgggtcgggcgcggttggctcacgcctgtaatcccagcactttgggaggccgaggcgggcggatcacgaggtcaggagatcgagaccatccgtggctaacacggtgaaaccccgtctctactaaaaatacaaaaaaagaagaaaagagcggcctccgcaagtagcggggattacaggtcccaaatctgggaagcacgggatcatgggaaccgatagaatcatcggggatatgaaatccagacttggaggaggccataaggggtcacaaagccaaaccttcatccagcccaggcgagacccacttcgtgacaaggcatccgagaaagcacactcgtggacaacacagggggagacagcatcactcgtggtagacgccgccggtcagacaatcatcccaagaggaacacggtgagtcatcaaacgtgacctacgtggtggaacaaaagaaagaccgatccgaggggaaggcccaaggcgtccacagagacgcaacgcggggatcacacgttacgttatccccagggggcgctgcggtgataccaatacgatccacgtggcacaggaaaacagccaacagtggggaaaacaaaggggccacgagggctaggaaacacagacacatcagtatcggggcacacaatcattacaagaggggcaccacaataaggggaaagcacccgatgtacgagtggatagaaacaccgtgggcgtacaacccgaattggggatcaatccaagaagagggcaccatgaagggaaacaagcgggaccacatgagagaaaacacagaaaagcacaattcaagtgggaccgtggagaaatacccacgaggcgacagatcccccccaacaacggggccgccaaaaaaggatatcaggagaaggatcccgtaggaaaaccaccgccgtcataggaacaactaaaggcactggatagccaacacacatccctagggggcaacacacctagcgagatcagcacatcctagtggaagcac

SEQ ID NO: 688851 - DNA, 132 bp, Homo sapiens
tcttctctatttatccccttgattcttttatcttttctcttctctttcttttatatctttgtctattatgtcgtttattatttcttgtctcttctcctctctgtgcttcttcctcctcttcttccgttctta

SEQ ID NO: 688852 - DNA, 398 bp, Homo sapiens
gcccactgcacagggcctcgtcagccatcttcttgcggccggtaaagcacagctcgttgcacaggctctggttcccaatgcccttggccaggcttcacagtgttcttacatcgacagccaaacccgcgtccacttccttcactgtgaaagaaagctatcctgggcacagtcgcgaatgtcacagccggtcacaaggtccacacttccgccaatccagcccccatgggcgccaccatatcacgggcttggggcacctctcaatcacgttaagtgtctcctggtatcagagtgatgatgtcgcggaggtcacatctgatccgggccacatcatctcctgtggtctacagatatgtccaaacccatgtccatcaggtcaatacccacagtgcacatttctc

SEQ ID NO: 688853 - DNA, 919 bp, Homo sapiens
  misc_feature (8)..(8): n is a, c, g, or t
cctttatnctctgttagacgacgcatctagcgatcgcacaatgagactgagagagagcagagccaagccacctcgttgtcaccttttgtgcgcaacttatggctcactctgtttggaagctttataatagaaggggtataacttataaagagcccgtgctggaaaaggaatttggtttttgccaacggtgtctgggtccggaatccccctggtcggcctcgttgtgccccattttttcggtgtgcccccgcccgcccgttctcaagggtttggccgcgcccggtgacctctgcggggacctctccgtcccccccgcccccctcgggttctgacgttcccttcccccgttttagtactcggggccaacgccgtgccctccttgttgcccaccaaggactctccccgaggttcttcaacgccgaattttcgcgccccgtgcagtgcacatacggaccgttcttcttgggacgacggtgaagttaggcccaccatacaccaaacatggcgcctgcttctcccccgcgatggaacaattctctcacgagggacgccgcgggtctcccccatgcacccaaaaggcgtgtaatgcacctccccatgagtgccaccctcggacgccagcggcccgcttccgagatacacccagaagggccaccaatctcgccctgtgctacaagagagacggtcctgagagcatacacaccccatgagaacagggtccccctgggcgacccctcggttcgaaaaagctcgttacccccgctgccccaacttttcggcgtacaaaaccgccgctaccagaagccacaagcggtaataggaggagcccccccagaagactgcacacccgacgcaggatggccagcggacacaagggacaacccgggtgggaaaaaaaaaagttcccccccccaaaaaa

SEQ ID NO: 688854 - DNA, 318 bp, Homo sapiens
aggtagctgttatgagctcctatggagtgtcagaatcatggaagtaaacatcgtgagaaacctgtgaagattatctcattcgtcttgtcgttatcgagtgttgctgttattatattcgacatgggtattatataatgttgcatttcactttcactgccactccttaaatatgtgaaaggaacattttttaccaaagtgtcttttgacattttattttttcttgacaaatacctcctccctaatgctcacctttatcacctcattctgaaccctttcgctggctttccagcttagaatgcatcccatcaacttaaaagt

SEQ ID NO: 688855 - DNA, 1097 bp, Homo sapiens
gagatgtggctttgggtttcatccttccccagcgatgggtctctacgtacctgatatccctggatatcaacgacaccgttcctcagacttccatgcctttggatcttccatgtgcctccccatattcctggacttcggagatggacctctcccaagccaggtcaaggaggtttgaggggagggttgccccatcatgcccctctgcttctgtggctgagcactttcccagctccagggcacgggacaactatcggccctatcgttgacccccaaatccagtgagctccagatgtcttccaaggcaaaagaggtaagcacgatcacaccatctttctgccctctacatatggcctattctggcgctagaccagatttggcgcggccaggagggacgaactccatatgggatggagcaagggaatctacatttctaccacatgtcacaacaacacacctgactggctcactcccagacctagacacacactagccagaacaaatgataaggggctcggcatgcggtggcgctaacgacaccaggaacacggcacaatgacaccaatcccaatcccttaccactgctaattaccacaatcacataccccaagcgatcaccataccaccttcacacaagtcacctacccaagcactgggttcatgtcgggagaaaccactcactaacaacatacgtggctgtggcccaaggaggagacaatcccccgaaccaagagtacaccccccgaccaacaaaatagacccaccctcaaccaaacccacacactacgcaaccaccagagacaccgcaaaacgcccacacagaaaccacacaggccaaagggcgaggggggcacacggggaaaaaacaaaagacgcaacggcaccgcaaagaacggcccactaaaatacagggcaccaactagacacaccccccagcgatcacaagcaggacaccccggcgaaatctcccgacaacccacccgcgagcacacacaccacacgggcagagagcccagaaaataccccacggcacaaccacgaccctccacggacaccgcggcaactgacaacaagcactcgcaagcgcaaaacgcgcctcc

SEQ ID NO: 688856 - DNA, 393 bp, Homo sapiens
  misc_feature (232)..(232): n is a, c, g, or t
  misc_feature (248)..(248): n is a, c, g, or t
  misc_feature (251)..(251): n is a, c, g, or t
  misc_feature (266)..(266): n is a, c, g, or t
  misc_feature (347)..(347): n is a, c, g, or t
  misc_feature (377)..(377): n is a, c, g, or t
ctgtgaccatcaaatgcacggttatttttaaagacttcagctaaccattcgaagaatttaactttcgataataaggagcttaagccgataataccgccgtaccagattaaggtattccagccgcctttatttttaaccacgtcttcccaggtaacgatacccagcagcagcatggttgccataacaacgattgccacggtggattcatcaacccccagagacttactgaaantccagcccagcagcgncanacaaagacaccgagnagcattttttcgcggattttcatcggtcctagttcggcaaggcccgcttttagcgatggttttgttatccaacttgtttantttctggtgggatacatggtgtaaattcanccagcgggggtgacca

SEQ ID NO: 688857 - DNA, 123 bp, Homo sapiens
ttgatactggctgagtttaacaatttgtgccggttgctgtcctggtgggtagcagaagttaaactttcctgtggtatccttatgttcatatcctctgttgtccttgggtttccctagagacaa

SEQ ID NO: 688858 - DNA, 1102 bp, Homo sapiens
cagtcaaccaaggtgtctgtgaagtgtcagcgtgggatcaggcagcagagcattttttcccctttgccttgatccttcgcaaggctgagaccactgggctgtgagagggaatggggtctaacggcacatatccacaattacgttgtagggcagatgggtcccatgtctggcatcattcagtgcatgctggctcgggaacgaagaagaacctggtgcttgagaaaggaagccggtcccctgacggtttctctgtgttgcctcgtcctctgtccctccattttgtcatgttgagtcagatttgtgtgtattcatatgcccgcaagatttcatgaagtattcacacagagagataaaggtagctatttatgtcccccatgtgggtggaggcacacggacagcgtgtgacgatgagttgctaagtgaaatgaagtccccttcgggataggtgacctgggccgtgatgttaaatatctccgggctcccagaagtgactggatttgccatacggaccgttcatgatcaatccacgactgttcacgacccttcaagaccttgcccctgggcgccaggctgcgatagacacgtgagggcctgtactaggaacgtgatagattcgtgaggttcgtaggggggcttataggccgctttgacgccaccatcttctcaatgcataccgctcgatcaccaatctgcaacattctgggacctacagttaaccatttttccagtgtcaagtttcgtgggatttgtttgcgcgcattgactgtgagctgccaattgggacgccattactgtgggtataccaactgcgacacttgcctaaccttattcacggttgacctcaaaagcagaagttctcccaagatctacatggtcctccatgaggtaagcttagtggactgacgatgggtgcttcccgacccatcggccccgtgggtaaagtcccggtggtagtttatacgacggttacgaagaactgcggggttttccccccattggtttgggcccaggggctgggattcttctaaacttccttgggcctccacgggtgttgaatccggccccggccttccgggtcgtccccaaagcgcttgagaatttc

SEQ ID NO: 688859 - DNA, 186 bp, Homo sapiens
tcagcaagctgttagcaaagcacttgcacgagaacaggctatgaacgaaaataacagagttcttaactaaaccctataagcattctatatgtatcaaggctaactttagccaacacagggcagcagctaggtaggcaaacgagtatagctatatataatactaaagctactaacgactagccctat

SEQ ID NO: 688860 - DNA, 342 bp, Homo sapiens
  misc_feature (2)..(2): n is a, c, g, or t
  misc_feature (137)..(137): n is a, c, g, or t
  misc_feature (176)..(176): n is a, c, g, or t
  misc_feature (186)..(186): n is a, c, g, or t
  misc_feature (188)..(188): n is a, c, g, or t
  misc_feature (194)..(195): n is a, c, g, or t
  misc_feature (197)..(197): n is a, c, g, or t
  misc_feature (204)..(204): n is a, c, g, or t
  misc_feature (207)..(207): n is a, c, g, or t
  misc_feature (211)..(211): n is a, c, g, or t
  misc_feature (245)..(245): n is a, c, g, or t
  misc_feature (256)..(256): n is a, c, g, or t
  misc_feature (260)..(260): n is a, c, g, or t
  misc_feature (342)..(342): n is a, c, g, or t
tnatcgttgtgtaaacaatagaatggaatgaaattacatgtgagaattgtattcaaatggctctagaacaccttaacaattatgacaaagcaattataaataactttttttccttagtaatatatattttctttttnaagtacattaaatatctgccatatctagggttagctagnaaagaccaancntaccanncngggagcncanctcnttgaaagattagactccaattttcaaaaatcctnaggtttactantttnataatatacagtcaagcagagggctaacttgggttgaaaagtattgattcttgaaacacattaaacaagcgttttacacttn

SEQ ID NO: 688861 - DNA, 256 bp, Homo sapiens
gaggaggtatgatcgagcgaggagcgggactctgagctggactcgagggtgaccgcttatagtggtcataggtggtgcttgtttgacgggcatagctgggtgggctgatcttgcgacccctcagccgcttctccctgaaactctctccgactggctgtcgagacgcggcgtccctgagtacatgtgccttctcctacctcaatgagccttgtgcatgccttgattggcctacttcctacctcgctctgatcttact

SEQ ID NO: 688862 - DNA, 237 bp, Homo sapiens
gtcactcgtgtaggatccctggttcaagggctatggttttgtacactttgagacgcaggaagcagctgaaagagctattgaaaaaatgaatgggatgctccttaaatgatcgcaacagtattttgttggggacgatttaacgtctccgtaaagaacgaggaagctgaactttggagctaggggcgaaaagaattcaccaaatgtgttacattcaacgaaattttggagaacgacact

SEQ ID NO: 688863 - DNA, 627 bp, Homo sapiens
gctgggtacctagaggatcctgaatcgaggtttctctgggcatttagtgactcggctggcttgcctcctccatatcagtgaggaagtgcagcgggaaggtttgtcatctgcagtgagtagaaagatgaccaaacacgattcgggccacaggtggattctggcacatttttagattggattggttaaaaatgtcatgttgtacacaagatgcaggcaaaggagtttttttttgagggacataatgcctataggcagcatgaacggtccgatctacccttggggaggagctccctgtgtagggacggagaaactagggggcctcgaggaaggtgttggttcggaagatggaggagacaatctttccggtgccattgatggtgccttcgctgtctgagctggactcggagtcgctgctcccagagtaggcactcaggcctgggaggatgccgatacatactgcagcagaggggcagtggatggaggggccactcagggaggtgttccggagagacttgcaggatgagggctcttgattcttgtcatctggctcagtgtccggtttcagtcttttcacactgatgccactctctgagctcttatgcttcacactccttgccaacagttcgc

SEQ ID NO: 688864 - DNA, 449 bp, Homo sapiens
  misc_feature (15)..(15): n is a, c, g, or t
  misc_feature (76)..(76): n is a, c, g, or t
  misc_feature (185)..(185): n is a, c, g, or t
  misc_feature (441)..(441): n is a, c, g, or t
aatctcccaaaatcnaccttcctctgtaggcctcctgaatcctgtgtgccttgtgggatccatggatcaggggccnacttcctgtgaccatgaaaaggccttatgatctgaccccatcgagcccagcctacccaagcaccctgcagagaagcctgctcaagaggtatggtcctgccgggcgcggntgtcacgcctgtaatcccaacactttgggaagccgaggcgggtggatcatgaggtcaggagatcgagaccatccctggctaacatggtgaaaccccgtctctactaaaaatacaaaaaaattagccgggcgtggcagcaggcgcctgtagtcccagctactcaggaggctgaggccagagaatggtgtgaacccgggaggcagagcttgcagtgagccaagatcatgccactgttctccagcctgggcgacagagncaagctgc

SEQ ID NO: 688865 - DNA, 150 bp, Homo sapiens
ttctcactgcggctggcgtgtggtactgcgggaacgctgtcgtttccattgagcctgactgatagggtgaggtcgtagattctccaagaagaactgaggttgtggcgcgagcaggtaggactattgttcccgtggcatcccccgagactt

SEQ ID NO: 688866 - DNA, 617 bp, Homo sapiens
cggaatcaagattgcagcaacaatagaagctaggagagagacgtgaatggattctccctcagagcctcaggaggctcaaccctgccagcaccttgatttcagacatccagactccagaactgtaagggaatacatctctgtcattttaaggcacctactttgtggtattttattacagcagccctgggaaactaatacaagttctattttatgaaagaggagatgaaagttccaaagaggtgacatggctctcctaaggtcacctggcaaaacgtcggcatccctgaacccatgtcagagaatatgcttcccccactcagcacctgtgaagggtcaagtgcactattagaaactcagcttgcaaatgacttagtcatgccctacagggacccatagtccacggatgagacaggcagaaaattgagcaaagagaatgagatgctgacaccaaggtactaggaaaggtccgtgggagtatagactgagggagcattctgatttgtgcagggtcaagaatttgacaaggcaggtgaaagaatggctggatgtggagcagcagatgtaaggagggacagttcctgtaagacttgggaaagagtcagacacgtgtactgttt

SEQ ID NO: 688867 - DNA, 276 bp, Homo sapiens
tttaaagcatttcataattcaatatgagcattttgtacaatgaccattacactttacacacatcaacaaaatcatactacaaaaatgctggatctgatttacaacactaattatggtttgaaatcacgcttacatcagtctcaaatttacaaaacctctcgtcggttctgggctagctgttgtactgctgaagttctctgatgtaatcattctcacccatgtcatatccccttccttaaagttgaggatggatgttaaaagtttcaacaaagttga

SEQ ID NO: 688868 - DNA, 204 bp, Homo sapiens
gcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctatgctgc

SEQ ID NO: 688869 - DNA, 262 bp, Homo sapiens
ttgctgttacggtgagctcaagtgttacaagtatccacttaaaatgctgtgtttaaaacgctctgtgatgctaattgtctctgagctattcgtctctccagtaaattgtgtatcacagtaaaaagtgatctctcgtggttcttgcatagttttcattgtgtttagtgcaatacctaagtcctccgtaacaccatagcacctatacagagttacactaggatgctggaagtgctcccaagaagcagagaaaagtcatgacatg

SEQ ID NO: 688870 - DNA, 379 bp, Homo sapiens
gtcggcgacttcatctcaaaaagaaaaaaaaagtacatcgatgatcacggatcacagatcttcatgacagataacaattttaaaagtttaaggctgggcgcgggggttcacactagtaatctcagcacttggggaggccgaggcaggtggatcactggaggccaggagcgtgagaccagccaggagttggagaccattcagcctcggtaagaggctgaatggaggtccttagatgtaatcacttcacaaagtgctctacagtttagattccgactctgcaggaaccgtgactgaagggatcgggtcggggggatggtattcatccggtggtatctcgggaccagctcatcctgggagggcatcctgtgctgtccttttc

SEQ ID NO: 688871 - DNA, 474 bp, Homo sapiens
gacctcagagggtgctcatcttcgattccgtctgccatataaatgcccgacttcaacgcagcagccatgtccaccacaccatctttatctaaagatggtgtgggcacccaggcaaattccgccttcaaattaccttccttaagcgagaaagacatttcgccattttcaatacgctcagccacattcagcaggatttgaccagcctccggcccttcgttgccgttttcaactgcaccgtttgaaatgccttcaatcaccaagcgtaagccaccttcaggaactggatcagatggtttttcgattgagtacttaaacgaacccaccgcattaccattgacatcgcggagacggagactgtagtccttcaagaagtcatcggctgcgatgtcgctcgcctgttctttcaaaatacggctaacttcgagcttgcgaccaacatccgcaaaagccgcattgtcagtattgtcaatggtc

SEQ ID NO: 688872 - DNA, 898 bp, Homo sapiens
  misc_feature (406)..(406): n is a, c, g, or t
  misc_feature (418)..(419): n is a, c, g, or t
  misc_feature (437)..(437): n is a, c, g, or t
  misc_feature (439)..(439): n is a, c, g, or t
  misc_feature (446)..(446): n is a, c, g, or t
  misc_feature (455)..(455): n is a, c, g, or t
ggggcgggccggtgcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtgggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaaggatggcatccccgtgagctcatgaggctgagcgcgcnatgagctgtggnnaagtcgaggtgacggtgntntgacccntgactcccntggaccctgatcgcttgtgatagctgctatgggtgctgagtgcagaaagatatcaagtgctgtaacacctgtgaagatgtgcgggaggcatatcgccgtagaggctggcgccttcacatgaaccacagattactattgactcagtgccgagcgcactagggcttcagccagaatgatgcagtgagcagcaatgaatgcacacgctgccagggtgtatggctttcttgcgaagttctctactggtggccgtgacacgttccacgttttggccccttgggtaaagaggcttccagggaagtcccaatgttgcacggttccagtgacctttccagaaagcgtatagagcccttggacaaccattccaacgattggacccactacaattcaaggcaccttgtcactatgggggaaggacgtatccagggctttagtgaacccccatg

SEQ ID NO: 688873 - DNA, 400 bp, Homo sapiens
ggtgttgcacggagttgcagtcggctgagatggcactgctgtactccagtctgggtgacagagtgagactctgtttcaaacaaaaaaacaaaacaaaacacaaacagtgcttctcaaatattggcagcatcagaaacatctgaagctggctaagttcagattccagagactagttttgtgggtctgggctgggcccgagattgctgctgctggtttgccgactgtactcggaggagtcatccttttatatttatttatttattttgaataaataaataaagcacttactgagtgcttaatgagccaccacgcctagcctgagtagccaccctttgcagaaatgtcctggaccattttaatgattccctttccaagaacccacttaaatagaggtctgctg

SEQ ID NO: 688874 - DNA, 901 bp, Homo sapiens
  misc_feature (406)..(406): n is a, c, g, or t
ggggcgggccggtgcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtgggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaaggatggcatccccgtgagctcatgaggctgagcgcgcnatgagcttgggcaacagtccgcatggtgacgcgtgtttgaccctgatctccctggaccctgatcgcttgtgatagctgctatgggtgctgagtgcagaaagatatcaagtgctgtaacacctgtgaagatgtgcgggaggcatatcgccgtagaggctggcgccttcacatgaaccacagattactattgactcagtgccgagcgcactagggcttcagccagaatgatgcagtgagcagcaatgaatgcacacgctgccagggtgtatggctttcttgcgaagttctctactggtggccgtgacacgttccacgttttggccccttgggtaaagaggcttccagggaagtcccaatgttgcacggttccagtgacctttccagaaagcgtatagagcccttggacaaccattccaacgattggacccactacaattcaaggcaccttgtcactatgggggaaggacgtatccagggctttagtgaacccccatg

SEQ ID NO: 688875 - DNA, 946 bp, Homo sapiens
  misc_feature (406)..(406): n is a, c, g, or t
  misc_feature (486)..(486): n is a, c, g, or t
  misc_feature (499)..(499): n is a, c, g, or t
  misc_feature (505)..(505): n is a, c, g, or t
  misc_feature (507)..(508): n is a, c, g, or t
ggggcgggccggtgcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtgggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaaggatggcatccccgtgagctcatgaggctgagcgcgcnatgagcccttgcgcgaacaaaaggcttccggaaggggggctgggaaccggggtgggtttttggaacccccctttgggggnaaacctccccccnttggancnncctgatcgcttgtgatagctgctatgggtgctgagtgcagaaagatatcaagtgctgtaacacctgtgaagatgtgcgggaggcatatcgccgtagaggctggcgccttcacatgaaccacagattactattgactcagtgccgagcgcactagggcttcagccagaatgatgcagtgagcagcaatgaatgcacacgctgccagggtgtatggctttcttgcgaagttctctactggtggccgtgacacgttccacgttttggccccttgggtaaagaggcttccagggaagtcccaatgttgcacggttccagtgacctttccagaaagcgtatagagcccttggacaaccattccaacgattggacccactacaattcaaggcaccttgtcactatgggggaaggacgtatccagggctttagtgaacccccatg

SEQ ID NO: 688876 - DNA, 414 bp, Homo sapiens
aaggtctaggatgataataggtggcaagtggagacactcaatgctgtgatgagtgcctcactagtggaatggagtgagtaagctttctgacctctataaactgaaggctatcttcagtcattgtttcatatattttacgtgcattaatcttcatataaacccaagaggtaaataagtataattatccttcattgttggtgactcatgttgcgacacagaagaatctgtaaactcttccagcatcaaccagtaaaaggcagaccttggatttcaaccaggcaacatggctcagatatcagttttaattactacactctactgtcaaagatttgtaaacactttgacaatgcatgccaatttcaagctatgaagaaacaaacacaatttttcacaacatctctcaaatctaatggg

SEQ ID NO: 688877 - DNA, 233 bp, Homo sapiens
aaatacagccaggtccagccaagtggtctggacagaacaaggctccggtgaagacctggaggcgacgtgaaagaagaagttcgggccacatagagggctgcgtcaccagtgtgctggggccttcgtggtccgagggccagcaccacccaagaccacacctggccgccgtggccgccccgtgggtgtgtccaacgaaagtaattaaggtcgtgtaggccttgtctggttataat

SEQ ID NO: 688878 - DNA, 204 bp, Homo sapiens
accttaagaggttccaccgctatttgatgcatcttttcctacccacatcttcatctcttaacgcatttgctaagctcctttcgaagttttctagatcttcagttcttacaagtagttagtattaacacgaaagcatttagaagggcttctagtatttacgcacacggtccaacacttagtctgatcatagagctagccgtgact

SEQ ID NO: 688879 - DNA, 160 bp, Homo sapiens
gggtcaagatacagcagcaagtgtcagtgactcaagacaccaccccctccaactactggggcccatgagcctctccctgactacaggaggtggagagtattgatcaacagggtaagagtaggttggttttagagtacttagatacaccctacactacagt

SEQ ID NO: 688880 - DNA, 359 bp, Homo sapiens
gattgttcatacgccttgtttgtgcgcgacaatacacagccctttaggtttcaccatgcctgggcaggttttcaagttataacgcggcccatcggcaaactccttgaacttaccgccgcctaccgagacgccgcccttcaggttcaggttaccgatcagcgcattgagcatcatcacagcccaactgttatagaaaccgttaccgctcatcatgccaccgtgagcaatcaccgacgcttgcagctggtaagacgtgaactctttggcaagtgcagcaatggtctcagcattgacaccacaccggctgccgtattcagtacacgtaaaacgctcagcagcctgttgcaggcaaaggaaac

SEQ ID NO: 688881 - DNA, 154 bp, Homo sapiens
ttcagtagcggagcatcagtaagcggtcagtaagcggagcggtcacgcctgctgggggtatgttgtgttgcgtgtgctgtgttcgtgtgtgctgtgttcgcgtgtgtgtgctgtgtgtgcatgtgtgtgctgtgtctgtgtgcgtgtacatgtg

SEQ ID NO: 688882 - DNA, 137 bp, Homo sapiens
ttcagtagcggagcatcagtaagcggtcagtaagcggagcggtcacgcctgctgggggtatgttgtgttgcgtgaaggaagaagaggaggcgaggaggtggcatagatctgccgcttactgatgctccgcttactga

SEQ ID NO: 688883 - DNA, 222 bp, Homo sapiens
ctgtgtctgttacaaagtttacaaccgaggccgggcgcagagacgtcaaaccggttatcccagcacttggggaagccgaggtgggaggatagcttgaactcaggagttcgagaccagcctgggcaacatagagaaacccagtctctactaaaaatagaaaaattagccaggtgtgatggtgcatgcctgtagtcccagctactagggagacaaagggaaaca

SEQ ID NO: 688884 - DNA, 558 bp, Homo sapiens
  misc_feature (6)..(6): n is a, c, g, or t
  misc_feature (98)..(98): n is a, c, g, or t
  misc_feature (105)..(105): n is a, c, g, or t
  misc_feature (139)..(139): n is a, c, g, or t
  misc_feature (336)..(336): n is a, c, g, or t
  misc_feature (485)..(485): n is a, c, g, or t
  misc_feature (501)..(501): n is a, c, g, or t
tggatncattgccccccgacgccttgaatgagccccaaacacaatttgtaaccttccctaaaacatgagattttttgtgtgtaattttttttttaaancctcatnagttatcgttagtgtattttatgtgtgccccccngacaattccttcccagcgtgcccccagagaagcccaaaagattgaataccccctgttatagaggaataagcagcaaacaaaaaatgaaatgggaagtccctctgaaactaatctgcttctgggacttccccaattaaaaaaaattaaaaagggctgggcacagtggctcacacctgtaatcccagcactttggaagnccgaggcaggtggatcacctgaggttaggagttcgagaccagccagaccaacatggaaaaaccccgtctctactagaaatataaaattagctggccgtggtgcgcatgcctgtaatcccagctactcaggaggctgaggcaggagaatnacttcaacccaggagnagaggctgcagtgagtcgagatttccattgcactccagcctgggcaacaagagtgaa

SEQ ID NO: 688885 - DNA, 515 bp, Homo sapiens
  misc_feature (55)..(55): n is a, c, g, or t
  misc_feature (176)..(176): n is a, c, g, or t
acatttttgaacaatttacctgtcaataaagcagaagacggcagttttaaagttnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaancccccctccctgggccaaaatttaaaaaaaattttaatccccccccccccccgggggggggccccgccacaaaatccccaaaaaagggggggaaaaaaaaaaaagggggggggtttaaaaaaacggggggaagaaaaaaaccggggggaacccaaaaaaaaagttgtgaaaaaaaaacccttttttggaagggggaaaaaaaaaaaaaaggccccaaaaaaagcttttttaaaaaagggggcccccttagggggaaaagggaaaatggggcggaaaaattttttaaaaaaaccgggaaaattttttttaaaaaaacttttttttaaaaaaaaaggggcg

SEQ ID NO: 688886 - DNA, 164 bp, Homo sapiens
gtgacacagactccaagtattacaagggttctctgatcctacctgaatgtcacccgacaagggctactggcaggtccacctgagaccaggtggaggtggccagcagagctgaccctgatgcaaaaggaggagctagatgagagccattgtggacacgaggcact

SEQ ID NO: 688887 - DNA, 396 bp, Homo sapiens
ctccacagactaggagatcagagaattttaatgtatgttcaatatgatcactcttgatattcttatggaaaagatagggaaatgcaaggaagagaaataatggtaaatagttgagtgattttacccaaagatgacagggagctttacaaaaacatgccagagggttctgtcttgggccttgacctagccactgtttttgtcagtggccaggataaaacagacacagtggtcatcccctcaaatctaggcagacagaaaatatattgactgccaaaagtaccataacaagatctgaaaaagtgggtcaaaagatgactcttaatagggataaatgtaaggtttaagaaaacttatggaacaagtccaaaagaggaaagaactttcttagctatagaa

SEQ ID NO: 688888 - DNA, 745 bp, Homo sapiens
gctgatgagccatctttgcgattgtccctcgatccgcctccttgactcgccgtagccgcctccgccgcgcgcctcctccgctcggcgcggactccggcagctttactcgccgagtagtcccgtgacactctcggctctactttctaccaagtcccctgtcatcagtgcatcagcgtgcgttcacctaaacatggtctggacgcagctcgatatgacaccgagctccgaagatcaccaccaaggacttaaaggagaagtaaggaccagttgtggaagaaggcagacaaattgggaagtagacggcgcccttggttaagcgtagaatgcataactgcaacgtgcacaaagtgcgtgcgcagcacgcgtatgcgcctgacagatcgtagggtatgaacgcaacatacgaggacataaatggcgcgcgagacggacgtcatcgaatacgagaaataggacatgatgatccgtacaggacagcaaccagacatttacacaaagatacttgcaagagaaacatggaccatggaaacgcaagagaataagaaaacggaaagaaaacataggaaaaaaaaaaagagaaacagtgcacagccaagacaagatgacaagaaaagctaacgtaaacaaaagcacaaaaacccgaggtacaaaaagacaccaaagaacccgaagaatgacacaacgaaaacagacagacaagccgacacaaaaaaaaaaggcaccagccctagaagccaagacacca

SEQ ID NO: 688889 - DNA, 156 bp, Homo sapiens
agctctgccggatagcatctcggagcttctatgattcacctccaggcagcgctggagggtactcaggagcgccctgttctgaaggcaggtgcagcatgggtatgctttcccagaggagactcttcgcccagtacgtcctgatctgctgccgggcca

SEQ ID NO: 688890 - DNA, 469 bp, Homo sapiens
cacgagggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaaaaaaaaaaaaaatttagccgtgtgtagcagtgagtgcctgtggtcccagctacttgggcctgaggctggaggattgcttgagcctaaaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacatta

SEQ ID NO: 688891 - DNA, 332 bp, Homo sapiens
agcggagctgttttgcggtgcctttccatcactacctttatactcatttgcctgcatatacattttcaaaagatcctgctctagtgcaggtgctgtggctcacacctgtaatcccagcactttgggaggcaaaggtgggaggattgtttgagcccaggagtttgagaccagcctgggcaacacagcaagacctcatctctaaaaaaattttttttaattagccaggcatggtggtgcatgcctatagtcttagctactctggagttagaggtgagagaacagcttgagcccaggagtttgaggccgcagttgagctatgaccacaccactgt

SEQ ID NO: 688892 - DNA, 896 bp, Homo sapiens
  misc_feature (252)..(252): n is a, c, g, or t
  misc_feature (281)..(281): n is a, c, g, or t
  misc_feature (305)..(305): n is a, c, g, or t
  misc_feature (309)..(309): n is a, c, g, or t
  misc_feature (346)..(346): n is a, c, g, or t
  misc_feature (365)..(366): n is a, c, g, or t
  misc_feature (370)..(370): n is a, c, g, or t
  misc_feature (372)..(372): n is a, c, g, or t
  misc_feature (377)..(377): n is a, c, g, or t
  misc_feature (389)..(389): n is a, c, g, or t
  misc_feature (400)..(401): n is a, c, g, or t
  misc_feature (413)..(413): n is a, c, g, or t
  misc_feature (422)..(423): n is a, c, g, or t
  misc_feature (425)..(425): n is a, c, g, or t
  misc_feature (431)..(431): n is a, c, g, or t
  misc_feature (434)..(434): n is a, c, g, or t
  misc_feature (441)..(442): n is a, c, g, or t
  misc_feature (444)..(445): n is a, c, g, or t
  misc_feature (455)..(455): n is a, c, g, or t
  misc_feature (460)..(461): n is a, c, g, or t
  misc_feature (469)..(469): n is a, c, g, or t
  misc_feature (481)..(481): n is a, c, g, or t
  misc_feature (484)..(484): n is a, c, g, or t
  misc_feature (522)..(523): n is a, c, g, or t
  misc_feature (527)..(527): n is a, c, g, or t
  misc_feature (549)..(550): n is a, c, g, or t
ctgacatttctggattttgctgttttataatttacccttgttattcagaggcatgcttacttatagaaactaaatggtctttataaaagtaattacttaaaaagaaatcaggggaagaaagatatctatctaatctattaaatctttataaaacattacatgcagagggggagctactcctaaatatttgtcatgattgcatggtttaatcagatttttttttttttatagcagccatattagctacctttncaatgggagaagagacagttcacacaatnccctggttagcacagatgtggacngagngcttggtcacctgcagggtagtaacccagtgatgttncttacagaagccaatatgnngaananctccnggggtgtgaccnatagtggatannaagaagaaggcngaagagagnncnattgancantttcacnntnngtatatccanttttnnaacatttngcttgacttttnaantttaggaagtccgtttttacctgagaacaatgtttaanntccngcgtcactctcagtactctcanngcccctcccaaacctataggtccttacgctggaaagctggttttctagaagactactcactaactttgcaatcttattaggtgtgcgtttaaaatgcgtaatgttgggcataatggtacagatacgcgaagacgtattgtttaagtgctgggcctttatagtattttttgttataagtttttaaacaacggtcatgggggttttcaaagggcggatgttgcaagaggctccacggggtatcgccacttggggcaagatggcgcgtttaaaaaatcggtttaatttgggaacaacgggcttttttgacatatatgcgtttttcattgtaaaaaacggcgctgcgatg

SEQ ID NO: 688893 - DNA, 515 bp, Homo sapiens
tgaattacatagcctagtgaggtcatagctgtggcaacgtcatagctcaatgcattactcacaggtttgcggtcatgctgatgtaaactaacctactgcgctgccaggcttataaacgtctagcacatacaattacatacagtgcataatatacttaataacaaatgactatatgactcctttgtgtatttactatactatacttttcattgtcattttagaatgtatttcttctacttacaaaataaaaaagttaactgtaaaatggccttaggcaggtccttcaggaggtattccagaagtcactgttatcacaggaggacagctccatgtgtgttattgcccctgaagacagtgggacaagatgtggaggtagaagacagtgatactggtgatcctgaccctaacgtgtgtaatgtgtgtgttcgtgtcttcattctaagaaaacgttttgtacagatgtacagtgtgtttgagtttaagctaagtgttatttcaagagtcaaaaagttaaa

SEQ ID NO: 688894 - DNA, 318 bp, Homo sapiens
ggaagtcccttgccttcttaaaagcccccccctttttttttaaggggaagggcccggtcttttcccaagtccccccagggggggggatagcattgttttggggtaaattatgaaaggcaaaatttttttaattttcccccaaaaacttttttattttgttttattttgaagaaggagccttggggcccccccttcccccttttttgtcccccaacttgaaaggtatgaggggttttggtttccctgggggggggggggggaagccggggtttacttgtacattgatttgagaccggttgaataaaagggcccccctta

SEQ ID NO: 688895 - DNA, 936 bp, Homo sapiens
  misc_feature (3)..(3): n is a, c, g, or t
  misc_feature (189)..(189): n is a, c, g, or t
  misc_feature (192)..(192): n is a, c, g, or t
  misc_feature (205)..(205): n is a, c, g, or t
  misc_feature (280)..(281): n is a, c, g, or t
  misc_feature (284)..(284): n is a, c, g, or t
  misc_feature (286)..(286): n is a, c, g, or t
  misc_feature (297)..(298): n is a, c, g, or t
  misc_feature (301)..(301): n is a, c, g, or t
  misc_feature (309)..(309): n is a, c, g, or t
  misc_feature (313)..(314): n is a, c, g, or t
  misc_feature (345)..(345): n is a, c, g, or t
  misc_feature (365)..(365): n is a, c, g, or t
  misc_feature (403)..(403): n is a, c, g, or t
  misc_feature (457)..(457): n is a, c, g, or t
  misc_feature (510)..(510): n is a, c, g, or t
  misc_feature (522)..(522): n is a, c, g, or t
  misc_feature (532)..(532): n is a, c, g, or t
  misc_feature (542)..(542): n is a, c, g, or t
  misc_feature (546)..(546): n is a, c, g, or t
  misc_feature (549)..(550): n is a, c, g, or t
  misc_feature (552)..(552): n is a, c, g, or t
  misc_feature (558)..(558): n is a, c, g, or t
  misc_feature (562)..(562): n is a, c, g, or t
  misc_feature (572)..(573): n is a, c, g, or t
  misc_feature (582)..(582): n is a, c, g, or t
  misc_feature (588)..(588): n is a, c, g, or t
  misc_feature (634)..(634): n is a, c, g, or t
  misc_feature (638)..(638): n is a, c, g, or t
  misc_feature (643)..(643): n is a, c, g, or t
  misc_feature (700)..(701): n is a, c, g, or t
  misc_feature (705)..(705): n is a, c, g, or t
  misc_feature (754)..(754): n is a, c, g, or t
  misc_feature (811)..(811): n is a, c, g, or t
  misc_feature (830)..(830): n is a, c, g, or t
  misc_feature (836)..(836): n is a, c, g, or t
  misc_feature (840)..(840): n is a, c, g, or t
  misc_feature (846)..(848): n is a, c, g, or t
  misc_feature (854)..(854): n is a, c, g, or t
  misc_feature (861)..(861): n is a, c, g, or t
  misc_feature (870)..(870): n is a, c, g, or t
  misc_feature (887)..(887): n is a, c, g, or t
acnagatggcattgtttggggttgggaaggtggacgatgaaatgttgagtatcacgcctcttacatttgaggtatcaatcattattggctagaaagtcttatttagtgagatggtaatggttgtagatgtcagtgatttgttccaggggacaatgagtaaactgagaagagcaaaaatctacaaatggngcnatgaaggtcagcnttccatgaagaagcagaaattgatgagagaggaagacaagagtagtcagagaagttaagacctggcagctaagtnnggngngggcgtgggcnnctntgatgganaggnnataaagcaaagattgagaagtatgcactggnggccattgtttctggttgtnagggtggggaagagtaaacggtgacagttggggtctcnttgcagtggattggggcatgaatatcaagtgaaatagtgcacagagtctgtttncaaccctttggccccgcctgattgacaagagaaagatgagatgcggcgggggnggcattcaaaanatgctagttnccgcctcttnttgnggnntntcaggncggngttgggcganntgagtatgntggcgnatggtagggttgggagtaaagtaaagataaaagaatttaagggttngggnggtgngatgtatgaagaagtaaatagttgggggttaagaagggattaaaaaagggaaggatnngggnatggaatgaaagattaagggaagggggaaagaaatatataatgattggnaagggtaaggggttgggttgggtattaagaaaagatggggagttgggtgttaaaaanaatgtttaaggataaaagnaagggnaagngaaggnnnaatggnaatattnatattaatnaagcaagggataatggnggaaaggggttaataaaagggtaagaaaaatgatgatggttggaattgg

SEQ ID NO: 688896 - DNA, 585 bp, Homo sapiens
gtgcgcctcgtttcgctcttcatcggcacccatgtgtgacgaacccgatatggctgagatcgagaattcggataagtcgcagctagaagaagacataaacgcaagagaaataatccgctgccttccaaagaaacgattgcacagtcgaagcgagcaggctaatcgtaatgaggcgtgcgccgccaatatgcactgtacattccacaagcattgccttgtcattttacttctattagctgtttaactttgtaagatgcaaagaggttggatccagtttaaatgattgtgctgcccctttcacatcaaagaacttctgacaacataggccgcgcccgcctttcccatcatgtctatctcatgtggctggcagggaaggaaaggacttgcatgttggtgaaggaataagtcgggtgtaacaagtggggtggggcgacagtgaaatctagagtaaaaccaagctggcccaaggtgtcctgcaggctgtaatgcagtttaatcagagtgccatttttttttttgttcaaatgattttaataattggaaagcacagtttttttcatatgcgcatttaaagtttaaaaactt

SEQ ID NO: 688897 - DNA, 440 bp, Homo sapiens
aatccctggcggctcaacgcatgttttatgggcgttgcgggatcgcgcgtgcgcctccagacgggagctggcgtgtcgggggttgcagcatcagctctagccttcggtggacaagcctctctcagctacgccacgcgaatacagagttctggtcactcacccccacccatgctaacacacaaggcagcgtcgggtgggagagagaaggccgtttctccttctgtagcctgggtctcccacgggccttccccgctgctgagcgagacaccagtagccaggtgaagggccacagcgggccaggccccgaccctgttgtgacccacctgggcaccttcccggaccagctccgcctcccctgccctcctctctccaggaaggagccagaaccctcacccctctcccaccctccccaggggtaaccccaggccaagcacagatag

SEQ ID NO: 688898 - DNA, 120 bp, Homo sapiens
atccggcggatgatggctgtgatgaacaaggtgctggctgtgaaagatggatggctgtggaatttcttaaaataagaaaacaataaggccggggctgtggtcacgcctgtaatcctaaca

SEQ ID NO: 688899 - DNA, 191 bp, Homo sapiens
gtgaggagtcactggtttaactgccgaatgtaccacatagttaaagaagaattaatactaatcctactcaaattattccaagaatggacgaggagagattacattccaagattccttctacaagaccagtaaaccaaagacacatccaaaaaaaaaaacggggaaaaagaaaagaaaattacggggccatt

SEQ ID NO: 688900 - DNA, 867 bp, Homo sapiens
  misc_feature (254)..(254): n is a, c, g, or t
gcagacatcaggtaagccaagatgggtgcatacaagtacatccaggtaactatggagaaagaatcagttctgatgtcatgcgctttcttctgagagtccgctgctggcagttaccgcccactgtctctgcgtctccagcatgggctccccgtccccagcccgtgtctgatcaatgcgcgccgtatctggcttctacacatggcccacagtcgacgcgttcacgttactattattacggagttcgctgcttcgcncgtggttggccgataaacgtcaccagttcctcaagggttgcatactttatcgcgtacacgtcctgttccattcgatagcgtagttgaaacaggctcacaaagtcttgctctggatagtcctttcaggatccgtttgcgagcatggcaccgcgacctggcatcgcctagctgtggggcctctgaggagtctctgtaattgctatacttgggttgggtagcaagattgccagcgatacataattctcagggagtgttcatttcctcaattgatctcattcacagtaacagctgaatcaggagacgaaatactccttgtacaaccccaagttggcatcatccataaactcaagtccgactagtctacagtggaagattgcgtgcgcgcatggacactactgcaggttccgaaaagacgccgtgagccttggtaatagcgggcagtaagttcgcagccacgactagttgcatggtctctcgccgaaggcacgcatcggatgaacggcgcaatattctccagtcttcaaccgttcaccgctgaattatacatgtaaaagttgtgtagcacattccatactttaatacacaccagagtttagtgacagtcccatgtctg

SEQ ID NO: 688901 - DNA, 129 bp, Homo sapiens
ggcgctgggataggagacacggaatgtgaaggcccagtcacatgactgaccgatgtggacctggggaccctgtcgcggctactacaaccagagcgaggccggttctcacaccatgagccccccaatgag

SEQ ID NO: 688902 - DNA, 708 bp, Homo sapiens
caggagctgctgttggcctccggcactgggaagaccctttggcccggcttgctcatcatacggcggtgaccttattccgtctctggctttgaactggtccgagattcataggggaagggccagaatggtgagggagctttttctcctggcaccggggacctgctcccatctatcatcttcatggacgaatcgactccatcggctcctccaggcttgaggggggttcttgaggggaccgtgaagtgccgcgcccgatgctggagttgctccacccgctcgacggctttgaggccccccaggacctccaggttatcctggctactaataggattgatatcctggactcggccctgcttcgccccgggcgccttgaccgaaaattgattcccacccccccatgaggaggccccgctggaccattttgaagattcattctcggaagatgaacctgacccgggggatccacctgagaaaaattgctgagctcatgcccggagcatccggggctgaagtgaagggcgtgtgcaccgaagctggcatgtatgcctgcgagaaccggcgagtccaagtcactcaggaggactttgagatggccgtacccaggtcatagccgaaggaccgtgagaaaaacatgtccctccagaaattatggaagtgagtggaccaacccttgtgtgtatctctcccataaagctctgtgggcccaga

SEQ ID NO: 688903 - DNA, 158 bp, Homo sapiens
agcactcttgtagtaaaccagtttaactgggcctcatctccaccttgtatttcacgtccagcagcaattcgtgcttgctgagtgccggacacacgctacgtctgtgtccccatcttctgtgcctatatctcatgctaacttacattgtgagtccagct

SEQ ID NO: 688904 - DNA, 387 bp, Homo sapiens
  misc_feature (47)..(47): n is a, c, g, or t
  misc_feature (69)..(69): n is a, c, g, or t
gcccttgaggctgaaggtcaagaaccagtggcaggaggctttcgggngtgctgacgacaggacatcccncggtaccgcattgtggagatccatcatcatgcagaagcccgagtctgtggacaagttcttcaagcgtgtcaatggcaaggacatcagctccccagccttccaggctcacatccagcgtgtgttcggtggctttgacatgtgcatctccatgcttgatgacagtgatgtgctcgcctctcagctggctcacctccacgcccagcacgtcgagagaggaatctctgccgagtacttcgatgtgtttgccgagagtctgatgctggctgttgagtctaccattgagagctgctttgacaaagatgcctggagtcaatgtac

SEQ ID NO: 688905 - DNA, 1311 bp, Homo sapiens
tgtgttatgaaattcacttagaaataaatgattctattaaaatataaaaacatccattaagcttgtcctatttccagtgactttagaatatcaaatctattattcgaaggacaataatgatttgatgtttagaagatcagcgtggtaaagtagcgacatagttatgttgggactgtgttctatatatattaaagtaggaagtgctattatatttactatgtgttaatgaagattgcactgtagttgatacattggtcaagatagttgccattataacaatcaaggtatggcttcagtgtactaattaggatatctggactattaatattcgtgatttggaggattaatcctatcgcgtttttctgtgggacagaagataaaagtagttgaattacttaatgctgcatgttggcttgcccgtgcccaatccaacatgtactcgtaggctggttgggcaatcagacgagctcgtaagtcatgaagccaatggagtaatatgactaaggttatcgaagagcatgtcctactgcacagtaatgtgaaggtaaatctgtcatgattagggaatctatagatattttagtaaggttgaggatggtggataagtcatgactttaaacgtatggtgagagaaagaactgattgagacgtaagagatatggcatcaatgtacatgcagggatctttctgagaggatctcgagaaaacaggaccatcgaagtaatatatggatatttatactcaccattcataggaggatgtttggatgtaagtatcgagtttataagatgtgaaataaaatcatgttagtgaaaatttatttggtgcttgttggccgttttggatttgagaatgaaagtattgaataaaaggtgaggttcgggtccatatcagatttcgcttccaagggatgacccgcatcagctaaaagagactggtaccccgaggttttttgtgataaaagaaccgcggagtcctaaaagacgtgtgagcttcagtaattttaaaaattcattatgacaattgcacggggagttgttgagacaggttggtattcagaagttggtgaaagagacacaggtaaattctcagaggacaactttgtggtgaatggagggcctatttgcctgaggggagaggaaaataaatgggggggagacggtaactaaaagagaatcttaaagggggaaagggggataatatagaatcacaaaagtgttttaacgaggttagggtcagatagaagatgtgttgataagtagacaaagtatgcgacagggggtatttaaatggggagcatcttgtacacgc

SEQ ID NO: 688906 - DNA, 131 bp, Homo sapiens
  misc_feature (55)..(56): n is a, c, g, or t
ggcaatacatactggagagaaaccgttacaaatgtcatgaatgcggcaaggtttnntggcacaatgcatacgtagcaactcatcggcgaacttgatactggaggagacaccttacaagtgtaatgagtcgt

SEQ ID NO: 688907 - DNA, 266 bp, Homo sapiens
  misc_feature (5)..(5): n is a, c, g, or t
  misc_feature (117)..(117): n is a, c, g, or t
cctanaggcaggcactgacaccagagaggattgccaagtcagacccattttctagagcagagggaagccacggtggtgacagttacatgggaaaagacgtggtcttgtgggatcttnttagaaacggtgaactttgggccggggtgttggtgggctcaacgcctggtaacccttccaacaaattttggggagtggcaagggcagggaaggggacttggctttggggccccaaaggaagtttccaaaaaacccaaggcccttggggc

SEQ ID NO: 688908 - DNA, 269 bp, Homo sapiens
ctcattcctcatctgctaaagaagtggctccaacagtgaactggtacagagcagccgcagtgaggtgacggagctccggagggtgctccaggtcctggagattgagctgcagtcccagctcagcatgaaatgcatccccgtgagaacagcctggatggagaccaaagtgccgctactgcgatgcatgctgtcccagaatccatgggactgtattggcacgtgtggatggagcatgctggcccacgctactggggtacctgagctctgaa

SEQ ID NO: 688909 - DNA, 596 bp, Homo sapiens
  misc_feature (1)..(1): n is a, c, g, or t
  misc_feature (513)..(513): n is a, c, g, or t
  misc_feature (559)..(559): n is a, c, g, or t
  misc_feature (568)..(568): n is a, c, g, or t
  misc_feature (595)..(595): n is a, c, g, or t
ngaaatgatttttaagacctttttttgcactgaatcaacattttgttgtcacaaacctgattagatttctaaaaagtatcatactgtcccttgctcaagttaagtacaaaattgcctaggaaattttttctaaacccaatgccatgttccattctttaccctgccgtttcccagcccgaggattggagtgagtggaaagtatgttcctgttttttcaaaacggtgctcgggacacatttgtgaccacaccagcttccatctcactgccacttctgctcttccggttctgagcagccgtcttagaggtcaactcttggagcagtctgttgatgaggtgagagccgcctgctcaggggagataaaggtagaggtctccaggctcttctctgggggcaggactctcaccccggcagctgcggctttgattgaaaaggtatgtggccctctggagctgacttcaaccaaatggcattggtctttgaaaaaatgtactttaggcacagcccctgtggnacggtggtttactttaagggattttacccccttgctttaagaaagngaggaaatntgactacaggatgggacttgccccccna

SEQ ID NO: 688910 - DNA, 270 bp, Homo sapiens
attcgcggccgcgtcgacggggttctgcttattacaatgaatgttctcctgggcagcgttgagatctttggcaccttcgcgactttatgcaatgcatcatgctattccatacctaatgagggagtttcaggagattcaaccaggatgtttttacacctgtgggttatgacaaagactactgcccaataatcttcacgaggggggactgcaagtgtatcatggcggagaagaaggacccaaaaaaaaccttccctggcggtgaatggatca

SEQ ID NO: 688911 - DNA, 306 bp, Homo sapiens
cgcgcgtccaggcctgaccagctctgctgtcgggccctgacggtttattcagacaaaccatgtccactgcaattagggaggtaggagtttggcgaccagaccagaacacttctactgaagaattaccttaattaaatgcagaaccaaaaagagtagtgttcaggaaacttctttttccactcttttttttttactttgggcttaatacttacattacgcatgatgcatccacaactaccgaccactactgaccgacacgtgcctaaatactagacacctcaaatcctacgtggacaacgtttacct

SEQ ID NO: 688912 - DNA, 1265 bp, Homo sapiens
ccgatgaggaggcgcggggtggaacccggccccgggcccctaagagcgatctgagtggagcgatcgtgcgtcacgggcccggtggagtcatggtctccactcacccaatcatccagtgcttcgacgttcgctgcatctctgtttcacgatgctcccacatgcatcaggacatgtcataggctcttgcatgccatgatcgccttcctagatacatgctcgctgcatggtttgagggcccatgcgaaaatggtgcgggaccagggctgcttgtaaggagagtctcatgtgcaggatccatggtagcagaggacctagttaagccggtcgtttcattggcaaccaggggctgaagcagggccgctggagggagcttgggctgcacggcatgggctggggcctacgcatatccctaggcaaaggagcgcgccccagccacttacttcgtggagcctgctatcgatctgatctggcgcacacgtctcattggtgggatcgtcggcgtccaacgaacctctcgcttccatgttgagcaaggccaggggatcaacacactgtcgagagaacctttgaatgctccaagtaattcacttcagtccggaagaggtggccccacccttccgttctgaacgaatatacagcacgccagttccaaggatgatggtcatggcgacctttggacttgggtgcctttaagttgggcgtgaacacaatgcgtgaatgaggtccctcatggaatgttgaggccaccttgtggaagcaagggaagacgaacagggattcgcgaccatctccattcccggaaaggcccaaccgatacgcaccctttttgtgccagaacccaccagtatctcaggggcaggatgagggaaaacgagggtttggaaaccgccggtgaatacttaacgggtgttgccccccccgagttaaacatggcgcgataaatccgaacggggcaggccattcttggcattcccgacaacgacactaggacggcaagagcaaacgggccagagaagcaccaacatgacgcatcagccccgaacggtgtgaactagtagtagcgtcacctgtggcaccgagtcagcaccttggcccctgtgacaaccagaggattggccaggggggagcaccccaacagccattcatggggcaaacgcgccgaatggaccgcacacattaacacggggtcggggatacaacagggaacaaccgcacaaccgttaccaggcagagcagacagggcggggcgacagaggaaacagata

SEQ ID NO: 688913 - DNA, 185 bp, Homo sapiens
gagacagagtctcactctgttgcccaggctgaagtgcagtgctgcaatcttggctctctgcaacctctgcctgctgggttcaagcgattcccctgcctcagcctcctgagtagctgggagtacaggtgtgcacctgtagttaaaccacgccctcaggtgatccacccccttctgtcgtcatatac

SEQ ID NO: 688914 - DNA, 690 bp, Homo sapiens
cctcttaaagaatgttctttattagcttactttaggccaaaagattagggagatccagggtggtcagttcccccgtccctcaactctcattcttcttggtaagatcacattctgggccaggcgcggtggctcagtctgtggtccgagcactttgggaggccaaggcgggtggatcacaaggtcgggagattgagaccatcctggctaacacggtgaaaccccgtctctactaattcttttttttttttggtattaaagacggggtttcgccatgttggccaggctggctttgaactcctgacctcaagtgttctgcccactttggcctcccaaagtgctgggattacaggtgtgagccaccatgccttgctctgcttcttctcccttcctttttaggaattataaattatgcgttcttttcgcttgttcgtcttcttttttgagacggagttccactcttgatgcccatgctgtagtgcaatggcttgatctcgggtcactgcaccctccggcttgcaacgatgctatcctccctgcttacgccttcctaagtcgctgcgatttcagctctgtcgcacccatgccgcgggtaattcagcatttttgcaacagacggatcccttccctgcacgccagggtccgcctcgcttccgacttcggggtgatccccctctctggcttccctggtcc

SEQ ID NO: 688915 - DNA, 579 bp, Homo sapiens
gggcgtggtgcggagggcggtattcagcacagcagctgcttggagaccggctaaaggtggcttgaacactccccccgtaggagaagcagcggtcagtcctgggagggcagccacagttgctgtaggaattgtccacacggccagcccctgctgaccagccacttgacctgcaatacagttgcctctgcagaggagcccaggttgtctggcccagcttcaccagcagcttgactggcttcagcagggtctccgctctgggagccctcggcggccacaccctccagtcctttgctctcttcctcagcagggagttgggcatccactccgacttccagcactcggatggtctcatgacctgacatcacgatgacctgctcattgacagtcagagatgtctctgacccggctccaggatccatggtcacttgtcagggtcgggtgggggccggcccacacctagcacatccggagcccgagcccgagccgccttcgccgcgggtgtctggcggccaccgattagagattcatctcacagcccggccagggggccggggccggggccggggccacggcggccgc

SEQ ID NO: 688916 - DNA, 193 bp, Homo sapiens
aatctctactaaggggcatctcgatcgcacaagagtacaaaaacaactcgcatggacggggcgtttccaggagttaatagcatacagtaccatgggtagggtgtggttggcagaagctgtccactttttctaagtgcaggggtgcgatggctgacggatcgtgtgctcctccgtccgcgtcgctcatgccaaa

SEQ ID NO: 688917 - DNA, 146 bp, Homo sapiens
tcggacgatattcccacacacctgcagctaaagacttattgtgatttggttctctctcatactcaggattttaaagccggaaaatcctcaccttcaaactgtttgcgttctctcttgtcttcttacctacctatttcacaatcggg

SEQ ID NO: 688918 - DNA, 1043 bp, Homo sapiens
  misc_feature (255)..(255): n is a, c, g, or t
  misc_feature (270)..(270): n is a, c, g, or t
  misc_feature (274)..(274): n is a, c, g, or t
  misc_feature (276)..(276): n is a, c, g, or t
  misc_feature (280)..(280): n is a, c, g, or t
  misc_feature (302)..(302): n is a, c, g, or t
  misc_feature (310)..(310): n is a, c, g, or t
  misc_feature (334)..(334): n is a, c, g, or t
  misc_feature (358)..(358): n is a, c, g, or t
gggcgtggtgcggagggcggtattcagcacagcagctgcttggagaccggctaaaggtggcttgaacactccccccgtaggagaagcagcggtcagtcctgggagggcagccacagttgctgtaggaattgtccacacggccagcccctgctgaccagccacttgacctgcaatagaagaggttgagtaactgcccctgctggaaccataactcctgtcagaactgtggctaagttttcctgagtcaagacctgnggggcagcttgtacngccngngggntcagggtctgcgatgcctgagnctggcttngggcttggctgaaggtggcaatgncaggggcagggctcggagggatcnccgggggtgacttcacagttgcctctgcagaggagcccaggttgtctggcccagcttcaccagcagcttgactggcttcagcagggtctccgctctgggagccctcggcggccacaccctccagtcctttgctctcttcctcagcagggagttgggcatccactccgacttccagcactcggatggtctcatgacctgacatcacgatgacctgctcattgacagtcagagatgtctctgacccggctccaggatccatggtcacttgtcagggtcgggtgggggccggcccacacctagcacatcctgggtaagatgggattggaaaggcaaagggtgatgtgacacagtaatacaatttctataccatctagaaaagtcagaatagaatcacagaagacagagaagttaggttctcccaagtatctgtagaggttaaaaaaaaaaaaaaggattctttttttttgagacagtttcactctgtcgcccaggctggagtgcagtggcacgatctgtgctcactgcagcctctgcccctcgggttaaaccaattctcctgcctcagccactcgagtagctgggattacaggcatgtgccaccacgccaggctaatttttgtatttttagtagagacagggtttcaccatgttggccaggctggtcttgaattcctgacctcaagtc

SEQ ID NO: 688919 - DNA, 777 bp, Homo sapiens
  misc_feature (255)..(255): n is a, c, g, or t
  misc_feature (270)..(270): n is a, c, g, or t
  misc_feature (274)..(274): n is a, c, g, or t
  misc_feature (276)..(276): n is a, c, g, or t
  misc_feature (280)..(280): n is a, c, g, or t
  misc_feature (302)..(302): n is a, c, g, or t
  misc_feature (310)..(310): n is a, c, g, or t
  misc_feature (334)..(334): n is a, c, g, or t
  misc_feature (358)..(358): n is a, c, g, or t
gggcgtggtgcggagggcggtattcagcacagcagctgcttggagaccggctaaaggtggcttgaacactccccccgtaggagaagcagcggtcagtcctgggagggcagccacagttgctgtaggaattgtccacacggccagcccctgctgaccagccacttgacctgcaatagaagaggttgagtaactgcccctgctggaaccataactcctgtcagaactgtggctaagttttcctgagtcaagacctgnggggcagcttgtacngccngngggntcagggtctgcgatgcctgagnctggcttngggcttggctgaaggtggcaatgncaggggcagggctcggagggatcnccgggggtgacttcacagttgcctctgcagaggagcccaggttgtctggcccagcttcaccagcagcttgactggcttcagcagggtctccgctctgggagccctcggcggccacaccctccagtcctttgctctcttcctcagcagggagttgggcatccactccgacttccagcactcggatggtctcatgacctgacatcacgatgacctgctcattgacagtcagagatgtctctgacccggctccaggatccatggtcacttgtcagggtcgggtgggggccggcccacacctagcacatccggagcccgagcccgagccgccttcgccgcgggtgtctggcggccaccgattagagattcatctcacagcccggccagggggccggggccggggccggggccacggcggccgc

SEQ ID NO: 688920 - DNA, 782 bp, Homo sapiens
ttggatgttgatttttatttaatataaaaacagaaaaggggtcaggcgcggtggctcacacttgtagtcccaacactttgggaggccgaggcaggcggatcacttgacgccagcagtttgagaccagcctggccaacatggtgaaaccccatctctgctaaaaatacaaaaattaaccaggcatggtggtgcctgtaatcccagctactcgggaggctgaggcaggagaatcacttgaacctgggaggcggaggttgcagtgagccgagattgcgccactccagcctggacgacacagtgagaccctgtctcaaaaaaaaaaaaaaaaaacagaaagaaggttaataattgcgggaatgtggaattctttcaaagtggcttaaggtagaattgaccctgtgctacctcttggatcactttgtaagagcaaattggtaaaaaggtagaacttggaagaagatcatctcttgtcccttttcccatttttgggcgttctatctttcggcctttagccttggcctgggtcactggcataaggttatatgagactatatgggcgaactggtccttatacaggattccaaagggtcaagaaatggaatttgggaaacttatttcccattttggagagaaatattcgtggtgaggggctaataaagtggtgcatggtattctcttgtccgtctttcttcccggagactttaagggaaacgtggtctcgcaggaaaggaagcaaggggtggtccataggaacgagccaacgagcgagaattgacaaaaag

SEQ ID NO: 688921 - DNA, 224 bp, Homo sapiens
cttggtcatttgcattggtgcaaaaatacagatttctgtcggtctgaagtacacaaaaagttgtgtcataagcttatccccgtgtgtgtaattctatcatttgaaacctttttagctactgtttgttttcattcaactaacaaacatattccaataataaaagcagtatatacatatttcctttctacagttacctctgattctcaacattttgtggggtagtg

SEQ ID NO: 688922 - DNA, 1504 bp, Homo sapiens
taggaggactttgtctctaatgttaatactcttgtacttatcgtgatctggcggttttttatttcacaaacacgccacaagcattatggacgctcatacagacacccaggctatgcagaagaagaactccaagaacgggctgctctcttcacctctatgtgtaccacacatcagcgtatccccgcgccatcagacggcgttgtagtcagacacacggtgtatctgacgccgaccgatgcggagtgacaaacacacacacaatgtgatgccagacgtgcctgtgtcgcctacgtcaatctgtggacacaacatatatcatttatcctctgtgaggcctcagtcgaatcacatgttctcgtgccaaacttactagcccatattttaagaatgtactctatcgcgggcgggcctacacacaatgtcacaccccacaagatgctggcgtaatgtcacaaagcaatctcgaactacaaagacgcctcccccacaactacctgtggcgcaaagtgtttatcattctagcgcgtgggccagccctgtgtgtcgtcttgcaccacatcgaccaacaccactgtttctggcctgtaatatgattcgatcgcccatcaacatgtgggcgccacacatcataccccccacttgtcaaaagacgagctataaccaagtagaaccgacagtcctcacaaaacgtcctataggtgtggcacacaacaatcatatcgtctcgtgagctccacagttgtgtgtaaacacaacggacggccaccaccgacgtgtagcagatactacacacacacttgtcaaccaggactattctaagaaagtccaaacattgcgcgaccgaacctataccaagacaaacctctgctaggcagaccaccattaatttaggaagacccgacccccacaactatctataccacggtcacctcttacccacaacagacgacacgtacgtggcgccactacaacaccgaacgaaccccaccccgccagcataacaaacccgcaccgacacaatatcaccaaaggatagccacctccctcccaccgctgcggcctgcctacaccaacgacgcacccccaccagcacgcggcgagacgaccaagcaaacacctgcacaacaccgccccctcagcggcgacgcatcaatcaacaacgacgagcccctcgcacacgccactacacaccacccacccaggagaggcggggccactaccaaaacagacacaggagtcacgtggggcgaacaccactctgcacccccaccaggactggaccaaccaatcaccgagacgcacgactgccccaccaacagaacaatatacgaacaagcaacgaacacacatgaacatatgtaaccaaaaaccacaaggcgtcccgacacccacgaacacggtctcacaccacggcggggtggcgccaacacccgcaccggggcgcggacacacctacccagacaacagacaccccactgacgtacaaactgttacacgcacacac

SEQ ID NO: 688923 - DNA, 145 bp, Homo sapiens
  misc_feature (17)..(17): n is a, c, g, or t
tgggctgacgtactctnaatctgtctcagatggaactcttaacttctcgtaaagtcatatatctatataataaaagctactgatttcctttggagcctttttctttaagaaaatagtttacctgtagtagtacttggagatctag

SEQ ID NO: 688924 - DNA, 1386 bp, Homo sapiens
  misc_feature (1)..(1): n is a, c, g, or t
  misc_feature (7)..(7): n is a, c, g, or t
  misc_feature (844)..(844): n is a, c, g, or t
  misc_feature (862)..(862): n is a, c, g, or t
  misc_feature (864)..(864): n is a, c, g, or t
  misc_feature (1032)..(1032): n is a, c, g, or t
  misc_feature (1174)..(1174): n is a, c, g, or t
nccccgnctgtgtgtgaatacccccgctcgtcgtgtattatgtttcacgcgctgtgttatttaatttctctcccccccagggggtatgtattcgttggggcccacaagagagtgggctcttggtgtgcttgtgtaaaagtgtgttgtgttgcgttacgcgtgtgctccccacccatgtgggagtatagctaccatcatcggtgctccctcagactatatttgtgctgtgtgctcctcgcgctcgttgtgtcaatcaatcgttcttcgttgggggggaaccccggtgtttctcgctgttttatgctctcggtagagtctcccacggggctcgacatgctcctctgttccccggcggggtgtccccccctcggcgcctttttctcttttgttgtggtgttatctcgtggtagatccccccgcacgggggtcttgtgtgtccacttctcccgcgcgccgctgtgtttcccccggcggagggcacatcttctttttttaggtgtgtttatacacgcttcatacgcttatgtccccctttttgtgcgcgccgtgtggtgtgaagaaacacaccacagcagattttttgcacctctcttcgtccgcccttataattgtgtggggagaccactttgtgcccacacattcccaacatggtcacgacacacatcaccctcattagtgggagagtcttttcacacatccccacagctggggtttctttgtaatatatgtggcgtgtcgagatattgtacttgggagcttctctggggagataggtgtttctcgtcgccacatgccggtcgcgcgacacgcacactgtgtctctcccgttgatgatacacactcncacactgtggtgatgagngnctcacatcgtcccctgtagagtctctgggaaccgcctgtgtgtacacacagagagagtatctctctgagaagagagagtgtgtgtgataatacagacacagaggccacaggtctcgtctctcctcgagagagaagagacacagtggactctccacagagagaggatantgttctcacaggggtggagacttggagactcggtgtcgcccgctctcctcgagagtgtcacctcgctatactccacaccctcgagaggtgtccacagagactcgggttctgaaaggtgtacacacggtggccctctctgtgncctaattcacgccatttccctatctgaaagacctggaggccgcctccacagccctcgccccggaaagacctggttctgcacgcttccccctgccttacggccccctgaaatgggtaggacaccacccctgacgtggttttaaaccgctttttgcataggctcttaacccagcatgggaaaatggttgatggataaattaacatccgtttctt

SEQ ID NO: 688925 - DNA, 718 bp, Homo sapiens
gctcttcccccttgcagagcgaccagatcgcgtagagctgatgccgctgcctccctgtgcagcctggtgggctgagaacttcaccctgagctgtagggtccccggctgccgggccccgtgctgatgcctcactgctagaccctgcatgctgtgtggctgcccatggagcttgatcctgcctgcaagcttctgcctgtgtgaacacacccctgagctgctggtggctgcggttgctcaacatgccactggtacattggctcggatgggaggaccagtggatgccagatttctcgttgtcgcgcccgagcttggacactgccgggcctgcactggacctgggaccttgttttgaaaacatcgcctctgggaccaccaggagacgctcctgaaccgttcgtccactgtttctccgtgatgcgccccgctgccatcgcacatgccatcccccgagacttctttgggaaggtttgagcctcggaaaagtgcccgttgaggcattgcaacctctgtcgactggaccttgtttcccagcctccagcagtgccacgtggttctaccgtcggcacattgtgaggggacccagaaatctgaggtccctgaattgtcacgcctccgacacgtggaccgccacttcagtgggccacattgcacaaaaggcccacatggctaggctgcacgagccacggacgcggtgcacaggggcacagcttgattctag

SEQ ID NO: 688926 - DNA, 398 bp, Homo sapiens
ctgtgttcatacctgtcccaatcttcccctaaatgcgctcctgcttatcaatacctttcagccggctatttagtatatcaggcttcgaacctccgctgggctactttctgaactcatcaaacaaactagtgactatttctaattaattactagttttatcatagatctgactgggaagtggcggggagagaggactttcccaccaaaaaaagaaaaggtaaatgaaagaatttattcgctgggtgctgtggctcacacctgtaatcccagcactccgggaggctgaggtgggtggattacttgaggtcaggagtttgagaccagcctggcgaacatggcaaaaccctgtctctaccaaaaatacaaaaataagccaggcatggtggtgcgtgcctgta

SEQ ID NO: 688927 - DNA, 240 bp, Homo sapiens
atatataactatctaattcatacaagtgatatattcaccatcccatcgataattcattttaaatatgctatgtaaaacataaacatactatatataactataaacgtatgaatatgataactattaacaaataatccaatcaataatacattttataaattctcattttggaaacttgtgttccaatgtgccacgcgagaaaattctgttcttgtaccataagccgtgtggtttctccct

SEQ ID NO: 688928 - DNA, 289 bp, Homo sapiens
ggctgaggatgcgaaggagatcagcgccctggtatccagcacaatgaagatcgagatcattgctcctcctgagcgcaagtactccgagtggatcggcggatcgatcctggcctcgctgtccagcttcgcagcagatagtggatcagctaagctggagtatgacgagtccggaccctccatcgtccaacgcaaatgcttctatgcggactatgacttagtggcgttacagcctttcttgagaagacctaacttgcgcagaaaacaagatgagattggcagaagcaggaag

SEQ ID NO: 688929 - DNA, 336 bp, Homo sapiens
gggtggggtggctgggagcgaaaacccagattgacaggttaaaaagaaaatcctggctgggcacaaggctcactcctgtaatcccagcactttgggaggcctaggcgggtggatcacctgaggtcaggagttcaagaccagccttgccaacatggtgaaaccttgtctttactaaaaacaaaaaaattagctgggtgtggtggcatgcacctgtaatctcaactacttgggaggctgaggcagaagaatcacttgaaccctggagttggaggttgcagtgagccaagatcacgctactgcactccagcctgggcgacagaatgagactctgtctga

SEQ ID NO: 688930 - DNA, 347 bp, Homo sapiens
tgagagtgccagaaatcctcctatttaaaccattggcccctgaattcgatttcttttccaaatatgctcataaattattgcagagacaatgttaaactcgagagcattattcatctgtataaatcagtctcatctttaaccgtaactcagagcttccatgtaggaatacgcaccgaaacacaggctaccgtctgcgttctcatggagcttacgatttagctgcactgataggatatttacacatgaagaaataacaatgtaagaaaattcatagacactaatttttagggacaaagcaaacgtcttttttttttttttcccaaatggattctctttctaatggccaa

SEQ ID NO: 688931 - DNA, 468 bp, Homo sapiens
gtctctagcgggggctgatgttatagccccactcataacacctcaaaaaaagggaatggaacgacagtacttcagtccaaaatccaactcgcctccgagaagcatccaaaagcagagtccagctattagaaagatgacccaaggtgaatgtctgtagtcagttgtttacaaactccctctccggcacaattcatggagaggcttcaatcatagaatccggcaaagttaatgacaactcagtgctttaatttggtatgtggaatgtacacgcatgctgaagctaagtacctttaaactcaaagaaataagagtggtattaggcaaatcttactatactagggaaagcattacctggccttatttgttaatacttattcaagcctttctccttcagtagtctattttcttagaataacaactcttttatctatcctgcactctattttttttctttttgacgagacaagg

SEQ ID NO: 688932 - DNA, 105 bp, Homo sapiens
ctggttcgacgtccaggcgaggcgccctcacagcgtacctttacggtcacacgaccgatgggctgggcgagagctttccagaagtggctgtcaacttcctatgtc

SEQ ID NO: 688933 - DNA, 1213 bp, Homo sapiens
ccccaatcagagggacaggacgaggctctgctatctccgtgccagatgattgcgagaccggcttctgacatattgtacacaagtcaacgacgttgtaaaatcccagggactacgactaggatgtgagcccttcagcacccgtgggaagatgaatgttaagatgccccattaaggaagatattgctctgaccagcgatgaatgggaggtatcggcgaggcaacggttccaagatctgggtcaatgtaggagaccaagctggtgtacttccagtgacaccaaggacacgccgctggagcaccacctctacgtggtcagctatgaggcggacggcgagatcgtacgccatcaccagcgcccggcgtactcccatagctgctccatgagccagaacttcgacatgttcagtcagccacgtacagcagcgtgagcacagccgacactgcgtgcacggtctacaagctgagcggactcgacgacagacccccgtgcacaagcagacccgcatactggactagcatgactgaaggcacgccagcatgccccccggattatgtaccctccaagaagaatcttccagtatccacaacgcagcatcggaatgtgcgagatcataccgggaatgatctacaaggcccagaacgcctttagcaagcccagggaaagaacgcaacccaacagtccatacttggtacataatcaccaggaccccaaggatgcagactgtatggactacacatccttatcaaaaggcattcacaagaaacttgccagaatcacaactaaatgagacttcactggggacatacgccagaggaaaagcaaaaggacgtgccaaagacaacatcgaaatacgaagacactacccgaacacacaaggaggcccatgaagagacccaagaaggcgcccaacggcgggcgcaaatcagcgacaccaacgtagtgcaagacccacgccataacgccgagccccagcaagataaggaccccacagacaccacactgaacacaagacagcacaacaagagagatgccaccaaagagaagaccaccacaaacacgaaactagcacgaccaaaagacagaacaccgccccagtatcaaatggtcgcacgacagtagcaccagctaacaaccatcgaatgcaacaacacaatcagatcacatacgtcaacacagacgatcacaacacaaaaaatccataatgagaccaca

SEQ ID NO: 688934 - DNA, 1048 bp, Homo sapiens
ggtatccactatgcccccatccaagtgactcttagtacgcagagaggctcattgactgcccatccgagtgcaagccgaatatacgtgatgatggcgacttaaagattgataacagggcgcaatgaaagtatagtatcgacggggaagacgtatgaatcaataactcacatctcaatgcaataatcacttcacatagggactggaaccgggtagtatctctgctgacataaggaaattcgcgctagaaattattgtcgccggggagatgcacgcggtaaaactgccgcaaaggcagatcgcagtctacgctaaataagccagactacatggagacacaaccgcgatcttatgtgaggcgaaaaatcaggtggaagagattcataagtaagaggcgaagacaaccgtaccgatcctgggtgactgcgcatggattgtccgaacgatagaagagtcttaggagaaggttccaagattctggctctgagagacccctcctagagtcaccttgtcaaattctaagtggttagatccagaacgaggatacaaggatccttgggcacagcgtaagtgaagagaatagcgggttgttagagccggaggtataccacattgaacagccaatagtagggtctaaggagcagcaccaagttcatacatggggttcaagctacaacaaccagtacctagaaaatcccaaacagtttaacctgaactacctcagacgcaatcggcaccattaatattcggctagagcagacgtacggtagggaacgtagcgagaggagcctcccctcccgactaaggccgcgcagattaatacgtgatcgccacattagcggcgacatgtaagccaggcgaacgggtgataacacaactgctaccgagaaaggggcaaagaagggacgaagcggaattggaatgccggcgtatagcaaatacctatacagactaacacacccggagtagaaggaccaaaaagaaaccatgacatcaccacactataagagggctgacaacggatatgtacaactgtgagaacaaacacacg

SEQ ID NO: 688935 - DNA, 211 bp, Homo sapiens
ggacagcagaagagagtgacaaaatatcatatgagaagaaatgaagccaccgaacttagaagtcctggaaccgtgcaaaattatccttcaaaaagcaaagagaaataagaactttctcaacaaacaaaaattaaggctgggcacggtggttcatgcctgtagtcctaatgcttcgggaggctgaggcaggagaatgtcgtgaacccaggag

SEQ ID NO: 688936 - DNA, 470 bp, Homo sapiens
cggcggatgcaagcgtcccgtgctagtgagtgcacccgtctaaatcaccacgaatcaaggagggacacgcatcaagcacgcagcaatgcagctcaaaacgcttagcctagcccacacccccacgggaaacagcagagattagcctttagcaataaacgaaagtttaactaagctatactaacgcgccaggataggtcaatttcgggccagccaccgcggtcacgcagattaacccaagtcaatagaagccggcgtgaagagtgtattagatcaccccctcaccaataaagctaaaactcacctgagttgtaaaaaactccagttgacacaaaatagactacgaaagtggctttaacatatctgaacacacaatagctacgacccagactgggattagataccccagtatgcttagccctaaacctcgacagttaaatcaacatgagactgctcgccagaattgaattgag

SEQ ID NO: 688937 - DNA, 101 bp, Homo sapiens
  misc_feature (18)..(18): n is a, c, g, or t
ccattttcacccgatccngggctctcccttccaagctagagggctgggctatgactgtggtctgggctttaggccctttccttccccttgagtaacatgcc

SEQ ID NO: 688938 - DNA, 114 bp, Homo sapiens
gctcggcccccccgacgacgagtccgacgactaccacgccgacgaccatcatgaggccgtaactgcgcacgtagccgttttggactttgcggatgatctgggaacaagccgtgg

SEQ ID NO: 688939 - DNA, 96 bp, Homo sapiens
tgctcagatgctctggaccttgccccagtaccccttcatgtggctgttgttcatctgtatcctttgtagtagccttaaaataaactgttaaacaca

SEQ ID NO: 688940 - DNA, 144 bp, Homo sapiens
ggaagagagaggttgggggagaaatttttttttgttaagattttccacagattgttttataatattgacaaattgggttagagaaggatcttacccttttgtctttggaacgaacaccttcagggtctggatctttttttatcc

SEQ ID NO: 688941 - DNA, 258 bp, Homo sapiens
aaaaatgcccttgcccctctgtggagaggcgcagtttaaagaataaggaggaggagggagaagagaaattgtaagggaggagagatctttcccgggccgcaccatttctgtcactcatattggccccagataaaagattggccaaaccttcacaacccttgattgttgagagatgtcccagtgttgagggacaccaaagcattgtttggtgtgtgcagagaggggtggtctcaaaaaagctaaaattaactttctttt

SEQ ID NO: 688942 - DNA, 550 bp, Homo sapiens
ggtgtatatcgatgccacataagaagaatagagcagggatccgcaacccctgggtcacggactggtaccagaccatggcctgttaggaaccgggccacaaagcaggagatgagtggtgggcgagtgagcattactgcctgagctccaccttgtcagatcagcggtggcattggattctcatagtagtgtgaaccctattatgaactgcgcacgcgagggagctaggctgcacactccttatgagaatctaatgtctgatgatctgtcactatctcccatcaaccccagatgggaccttccagttgcagaaaaacaggctcagggctcccactgattatgcatttggtgagttgtatagttatttcattatttattacaatgttataataatagaaataaagtacacaataaatgtaatgtgcttgaatcatcccaaaaacatcccccactccactgtctgtggaaaaattgtctggcatgaaactgttgcctcatgccaaaaaggtgggggaccactggtttaaagggagcagcatgcccatttggggca

SEQ ID NO: 688943 - DNA, 718 bp, Homo sapiens
  misc_feature (4)..(4): n is a, c, g, or t
  misc_feature (8)..(8): n is a, c, g, or t
  misc_feature (564)..(564): n is a, c, g, or t
tccnccgngctgcaggaattcggcacgagcgttactgtcgccatctcttctgatcacgcgacagctaactgatgctctagtgcgtagcctcttgagtgctatgcctggatgattcatgcccacacctctgtgacgatacaatgtcacagtatcaaggtgccatattacatgctagcagtacagcttgaccagtacaccttccagcatgcgctatgagctagaacaccaagactgcacaactggtgtcaactgcatctgtatgtactggactctacgcgatcttggacgtgccttgcagctagctgcacgtatcgacttgaactgtcacgaatgcggtgtgcatcagactatgcattcgtaggccttaatccagaatgctggaatgctcgcgatattgcatgcacatacatagtcatcgtatgcatgacaggatgcattgtagactacgcaccttgctataacctctagatgcgatgttcatgcgtgctaacagctgatgcagctcagtctgttacatgtgattgtgcatcttatatacgtctgcgaatcagctccatctagctngagagctgtgatcacacactgtgttcgatattcggtctgaatgaactatgactgtgcagactgtgctgtgtcatagcactgtagtcgtgagcatacgtagtgactatgatctagctattactggtgctcagctcgctcaggatgatactcacgt

SEQ ID NO: 688944 - DNA, 847 bp, Homo sapiens
agcggactgggcaggcgttccagctgtatatccatgagcgccgttggcatccggggagctgcaggaaccagactgggggctgagcgtgaccacctggtagtcgattcacacgcagtcttgtgtaggtttgtttgaataagagatcctgacctgaccggccgcagagcgtgatacaactgcttcaaggacaaattcagtatttgctaaggtgggacagaatacatgtaacattgactcagaggatgaatgcgcatgctggagacgtcccgtatacttcgcccaggccggatgatatgtaatgagagttgagagctggcatgcgagtggtctgcatgtgcatgtacagttgactctgctctctggatgctgttgaacctgtggacacgagcctccacagcctccaactgtagcatctacatgtgccaggactcgcgcggcttctcaccgcattattctgctcaagtcctggtgcccttcttactgtacctacatagcacatgactagttcccaacagttggatctgggcgtggcaataacgtaggacgagcagtccgagaccggcgcttgtgcttagtggagaaggattgtggcaaggaggttgaaggtctgaccattatccctatactgggcgatcccggtaagattcattcaacttagtagtgctagaggtggagctcacattcataacgatgtctgatccgtcttcgagctccttgtgctcgagcacatggtcgtaggcacgatcgatatctagcaatgggtcgttcctgacctgagtaaattggcctgatcatcagcgaggaagcattacatccggcattttcgatagatctatgcccagtagaa

SEQ ID NO: 688945 - DNA, 180 bp, Homo sapiens
accctataaaagtactacttctgcacatactgtatttttggatactctcctttgagcttccgggtctccttctgccatattcaccatacacaccattgttgctgtatgggacaagacacaattcccaggtaaaggcaacctgggaccacaacaaaaatgtaattgcaattaggaaacaaa

SEQ ID NO: 688946 - DNA, 128 bp, Homo sapiens
ttgattcgtgttcaggtacgttagggctcagccggaggagggagccagagcggaactgaacccggtgctggtctaccccagacagagctgcaccctcacctgtcccaagccaccctgttcccagacgc

SEQ ID NO: 688947 - DNA, 120 bp, Homo sapiens
ggcgaggcttctctgcaggatatctggatagacgaattcggtagcttcggccgtgacgccactccggttgtagaggcatgctgcgaaccgcggatcgggacgtccgccgtgatccatggt

SEQ ID NO: 688948 - DNA, 475 bp, Homo sapiens
cagcattctaaaacaaaattagacatgtgaagtacagtcatctgctacataacgttttggttaacgagggacttcctatatgatggtggtcctataagattatgatactgtatgtttactgtaccttttctatgtttagatatgttcagatacacaaatatttaccattgtggtacagttgcctacagtattcagtacaataccatgccgtataagtttgtagcccaggtgcaataggccatactatatatagcctaggtatgtagtaggctataccatctaggtttgtggaagtacactctatgatgtttgcatgacaaaatcacctaacaatgcatttctcacaatgtattcccatggttaaaggacatttgactgtattgaggaacttttattttcagatttgttaatgttattgtataaaagagtcatagaatgaatagcttatattgaaatgaataatcttggaaaatca

SEQ ID NO: 688949 - DNA, 156 bp, Homo sapiens
gcgagaattgaagactatttttcagcaatcagacttttcgacattccagaaaatttcgacattactctgtaagggacggacagttatcgtgaagggccccagaggaaccctccggagggacttcaatcacatcaatgtagacctcagccctctttg

SEQ ID NO: 688950 - DNA, 346 bp, Homo sapiens
  misc_feature (23)..(23): n is a, c, g, or t
  misc_feature (63)..(63): n is a, c, g, or t
  misc_feature (82)..(82): n is a, c, g, or t
  misc_feature (102)..(102): n is a, c, g, or t
  misc_feature (150)..(151): n is a, c, g, or t
  misc_feature (153)..(153): n is a, c, g, or t
  misc_feature (170)..(170): n is a, c, g, or t
  misc_feature (174)..(174): n is a, c, g, or t
  misc_feature (181)..(181): n is a, c, g, or t
  misc_feature (195)..(195): n is a, c, g, or t
  misc_feature (207)..(207): n is a, c, g, or t
  misc_feature (222)..(222): n is a, c, g, or t
  misc_feature (224)..(224): n is a, c, g, or t
  misc_feature (227)..(227): n is a, c, g, or t
  misc_feature (230)..(230): n is a, c, g, or t
  misc_feature (234)..(234): n is a, c, g, or t
  misc_feature (236)..(238): n is a, c, g, or t
  misc_feature (240)..(240): n is a, c, g, or t
  misc_feature (245)..(245): n is a, c, g, or t
  misc_feature (269)..(269): n is a, c, g, or t
  misc_feature (341)..(341): n is a, c, g, or t
tgtgtagcattgagctggggatncttgagattgaggttgattttcagatcagttctatccatnatctggatagaatgtgtanatctacctagtatgtaacanctgccattcttattcctcattttaagtatttctgtttctcacaattcnntntttttgtttatttgagntggngtctcantttgttacccaggntggagtgcagtnccgctatctcggctnantgnaanctcntnnncntcctnccgggttcatggaattctcctgcntcaggcattcgagtagctgggatatagtaggcatagcgccatcatgcgctatgactaatttttgtatttttngtaga

SEQ ID NO: 688951 - DNA, 510 bp, Homo sapiens
ctatggctctcacaatagtctaaggtcaggttatcgacttagggtagttactatcattttcttctggatcttttggatactcactgagaacgaccttcccttcatcgtcttctagatccttgaactgtattgttggcttgcaaagttcctcacgggtgtctcttcttgtaacattttcttcagagtttcttctgtgtctccacctccagtagaaatccaagtgtatttaatttcaggcacctgtgatgcttcgttcttctcgtgtctcttttccaggtatttccacaggcactccatcaatgatataggtgtatacttgaatacttggctctccatggatcacttcagttatagtatcaccttctttaatcagtctgaattcaggtgcaccttcaattttgactctggtaacgtgtgggtctatagacagtcaccgggatttctttgaaggtgctaccacgaacgaactctatttggatgtatgtgatgtatttataaagtatatcccgc

SEQ ID NO: 688952 - DNA, 259 bp, Homo sapiens
  misc_feature (12)..(12): n is a, c, g, or t
  misc_feature (43)..(43): n is a, c, g, or t
  misc_feature (75)..(75): n is a, c, g, or t
  misc_feature (95)..(95): n is a, c, g, or t
tacccccaggcnggagtgcggtgatgagtgatcatagctcacngcagcccttaaactctagtgatcctcccgccntggccttcccaaagtgctgngattacagatgtgaaccaccacacccagcccagtcaatttgtttttagaatgttcccaagaatatagttgtgttgctaaataagatactaaaataatcccatactatatttcttgacagaaaaactattaaaatgtatacatgataaaaatttcttttatgaag

SEQ ID NO: 688953 - DNA, 814 bp, Homo sapiens
taaggcacgcgacccacggccgcccgcgggagccgcggggcgaggagcatgggcccgggagagcggggcccagctgcggcggatggcggacgacccaacgcacagacgagcggcggagacaagaggagcagcagcggcaccgcccccacccggagggcctgacaatccatcatggagactcctgcccttacccagtgtgccacagagcccccgagatggagcccaattatggtgcctgcaccctgccctggtggacgtcagtggactcgtgtggtggcattgcccctcccacctcctgacaccctggccagctgctggttgtgactttctctgcaccatgtagcatactggactcccagccctgcctgtcccggtgttgctggtgccggggcagccactccagacccagcccagcctggtgtgtgcactgacgtgagattgcggactcctgggtccctggccaagaagccaggagagggacggctgatggactcagcatcggaaggtggctgtgaccgagggggtggggactgatcctgccgactctgacgaccacacacatctcaggaaaggctgtatagtgcatagttgcaagattaccaatattgcaagagagtgacaaaatgaaaaataagaaaaatagaatacataacatcaatagaagagaacacatacaagatacattaataatatagactcataaagacacaatgtgtatatacccaaaacaatacaatacatagtaatataaaaaacctctaaaaaaaataaaattgagtaaaaatatataaaaaaataacctccgtaaaacaca

SEQ ID NO: 688954 - DNA, 493 bp, Homo sapiens
cgcgcacgctctgcgtccctcagacgcctgcgctcttgtactagtgtttgtgtttgttctgtcagcagcgcgctgctttattctcagcgcctccgtctagttggtttcagttttggttggcgctgagatgtagcatgcgtgttgcttatgtgtgagcgcacggtaaggtgtttatctatcgtgtgctcgtgtcttgcgtctcttttcaaagcacgtggcttggtgtttacattgtggtcacgtgctttgtcgtgtggtcaagtgtggtgtttgttgtcatgaacatgcggttaatgagttctctcattggctgcatgttcttgttctgttaagtgagcgcatggcttgtgttgtctacactccccgtgttcctgctccagtcttgccttgtcttgtcagcccagctaagtttgtgtgttttgttaatgttttccccctcggggtagttttgttttgccttttatttttaataaatacccattgtttctttgca

SEQ ID NO: 688955 - DNA, 391 bp, Homo sapiens
agatttttgaagtttcagggaactggaaaaatctttaacttttgctttaagtgtttggggcaggataaaaccacatagaaaatataaaaccatttttgctttgaaaaaaacagggcaggtggccctttactgcttattctgtaatccctactgtctataattaacttcaggaaccctgaaacttgatgaaaagtttttaaaaattatttctcgtaggggcaaagttatatggaaagtttgttattttttatactatttgaatgccctgccagtgaagactgtaaaaacagaaccccctattttggagggaggaaactaattgtttaaaatttttcatcctttgtgagtgataaaaagtttggatagtttttataataaatcccttttttga

SEQ ID NO: 688956 - DNA, 197 bp, Homo sapiens
ttactatacaattcagcttgtaccggcagtgctggaggaaagttttatagggtcctgctgaaaggtgctatcgtgaaatgaggtcattgtgcccgcaggttgtttgtgattagctgtctctaacaatttgttcatacaataattgttcattattgttctcaacttggggctctccccaacctggggacccttcctta

SEQ ID NO: 688957 - DNA, 289 bp, Homo sapiens
gcgcgtgggttcttgcagatccaggccaagatagcaaggcagcatctcctcaggccgcagggtgctcagtgcattgtccaacattgagctacaagcgaggagcaactcatggctgctcatggcacaagccacccgccctgccagcttcacagtgcccgcctcgtccacgtaacccagggttcggagcacctctactcgctgatggtactcaggaagcagcagcaatgactgatccgacagtaggaagcgcagccgctccatctccttctgtatctgcaaggaacccacg

SEQ ID NO: 688958 - DNA, 350 bp, Homo sapiens
gctaacgatttcccatccataatttatctgcgtatagtaagttaacttacctatattccacttgaacacatcttcagaaggcattccaagacagtgcctttccaccgtgagcctgggagtagggtcaagcacatcctcgtttgcccaggacagtcctcatttatgcttgtcactccagcgtaattattaatagtgcgcccttgcctctcaccagtacctggatgtggatggtcatttatacagtactctttgtgcttttctgggagacacagagagatccagggtagaactgctccccaagagcttggcaaggtggtatggaaccaggagagctgtgataactgtcttca

SEQ ID NO: 688959 - DNA, 984 bp, Homo sapiens
agcggagctccggccggagcatcaggtggtggcccaagacacccgcagactagtgctgccgcggctctcacggatccgacgggtcatcccgacagcgttgtccacacatcatggtttgagtgagtcccacgcacagtcccccttataccgacagcagactacctaagtatatgtaaagtaagagattaacaactactactcatgtctacacaaacagaagcacaccatagcagaaacctatgacacgtactgaccagaggacacagagatgaccaccacgacaatcgcggagggcgaaccgacaacgcggcggcgtcgggcacgaaggaggcagggcgagtgcggcgcagcggcccgcgagcagagggcgcggcggaggcagagggcggggcggaacagggggggggcgaagcgcgcggcgcggggcggcaccgcccatcgctgagctggagggaccaaggaacgtgccacgagagggagagcaggaggagaccgacggcacggaagagcacacgcggggcgccgcacgggcgcggcgcccgcagcgaaagagagaccacgggatcgcacgcgacggcggaagacggacagacgccgcgagagcggagagagagcggccgcagacaggagagcgggcggcgagagcggcgcacacgaagcacacagaaagacggggacggcgcaacagagagcggacgaggcgacagggcggagggagatgcagcgagggtgagccgcgacgccgaggcgcgaccgggcgcagcgcggcggagaggccgaggcgggcacatgcggggccgcacgagcagagcagcagcacccgagagcggggggaggggcgtggatgccgagcaagcaggaagatgagcggacgcccgcgggagcgccacgagagagaaagaggggaggatgcaaacgaagtgcggagcagcgacgtgcgagcacggagggccggaaagacagagagcacgagagagagcgagc

SEQ ID NO: 688960 - DNA, 321 bp, Homo sapiens
tcttgtgcgcaaggtcgtagaagtaggtgtcgttggaccgcatgatggcggtgtccaggtcgacccagccatcaccggaacggttccagttacggtatttgtgatcgtagttgggcaactggtagtagcccgggtcgaacacccggctgcccgcattgaccacaccactgtccaggccagcaatggccaccgccggcttgatggtcgaacccggtgggtacaggccgcgcagcacgcggttgaacagcggccggtctatcgagtcgcgcagttcggcataggccttgaagctgatgccggtaacgaacaggttggagtcgc

SEQ ID NO: 688961 - DNA, 143 bp, Homo sapiens
tcggccttgttgtaaacgcgtgtgtcaaaaataaatgtcggactttccgtccctccttgtcttttgaacggagcataacgggccgtgagcatgactagtgaattaagagaagaccgtaaacaattgatatgtatgttgctgga

SEQ ID NO: 688962 - DNA, 380 bp, Homo sapiens
  misc_feature (214)..(214): n is a, c, g, or t
cggggcggctgtgcagagaggatcacctcccagacggggtggcggtcgggcagagacactcctcagttcccagacctgaagctcaacaccaccttcttcgaccccgcacggagtgaggagaccccatatctataacaacaactattcttgatttttctggtcaccctgtaagtttatattcgttatcctaacaaggcttctggaataatctccncatattgtaactttactactccgtgaaaaaaagaaccatttgtgatacataaggtatggtcttgagctatgatatcaacttggcttcctcagggtttatccgtgtgtagcacacccatattattacagtcaggaattagacgttagacacactgagcattatttca

SEQ ID NO: 688963 - DNA, 292 bp, Homo sapiens
tgcttggtaaaaaatggggccaaaaaagcttttttgtgtgggtcaagtctgtttgtttttccaataaaaaaggaaagccttagccccatggaatggacatgtgaggatgaggagacaaaaaaccagtagccccttccatcaaaaaaaagggttttttgggggtgctggctaattaatgtcactcctgatttttctttcccaggccctggaccccccccccactgagattgggtgggagctttcatggggggtgtatttccctgatgaaaaaaaattttttgcctaatgtgga

SEQ ID NO: 688964 - DNA, 1907 bp, Homo sapiens
  misc_feature (1)..(2): n is a, c, g, or t
  misc_feature (732)..(732): n is a, c, g, or t
nncctcgttggctttcatgtatttggttacagaaagctatgagtacgtattgtacgacgatgttggtgcatgttgctagctagttgcaggctgcgctttgtatgtggtgcgagcgctgttcgtgtcgatcctgctggcgcggtggatgctccctcgatttgttcttgtggtgatggtggtttgttttcttctgtctttcttactgggttttgctgtcgtctcgccgttgtgtcgttccccgctctggttgggattgccggtggcatcacctcgcagtcactatgtggttctcgatcgatgtgtgtcgacggagccactctgtattttcccttgggggtgtcccacattacatggtcactactgggtatgtctcctgatgttggcatcagcctcgcttggtgggctcttgttgcgacattgatgtctgggtgtgtcttcttcgatttgttggcgtgcagcctattggtgtgtgccactctcgtgtcgccgtcattgtaccactgttgttgttgtgtgggtcatcttcaacaccgtggggattgagcccctcacctggtgtggttgtgttttattcgatcgccgggctggtggtaatttgtgggtgacccacagtctgtgtactaaagatggctcactcaattgtggttcttatatgcgcatttgtggggaatcactatcttctgatttggtttagttgcttcacgatcgtgggaacacagtgtgtgttaaganacttgtgtgcacacaccacgtctgtagtgttgtcacaaaagaaggctggtgtgtagacgttgcgacgccggattaaagggtgtgaaaaccaaaggtgcatcgctgtgttggagtacgagtcccgcaacactttgctgtgggccacatgaagcgtttaagtggacaatggttgaagctgtgaaaaggggggtcccctcttttaatgcggtctatatcctttgttgtgtgtgtccaccaggcatttgcactgattttcccctcaatgggggcattatcggcggtgatatatttttggggggaaagagcccccaccctcatatgccgcaaatgtcccccagttgggagggcgtgttttcaaaaggtgggtggtaccaaggccgcaaacccccagacacatttgtgtgtgaaggggaaaggagattctttgtggtagagatccaccctagtggtgagaggggaagttgttaattgaggccgacttgttcgttggagtagtgaaggaggaatgtcttgtgccgcaaaagcaccccacacccagggggggctcagaaaggttgcacacctgttgtcccccagagccttgttgttagggagacacttgctggcccacacacagaaatgtggagtctctggatctatttagcgcacacatgtgaggagacgtggggaatgtatactgttctcccagagaagtatctgtagagtgttggtcgcatcgcatgggtgcaccaatattggaggtgaaacgttaacatgcgtgtggatagaggtatagagggtttctcctttctcaaaagtctcacgcagcgtgttagactggggccaccagatggcgtcaatagcccgtatgaatctcccacccaattgctcagaaagactgagcgccaggagagattacttgtaggcccagactgggccaataattagccaagacccccatctctttgaaaaattaggccatggtggtgccaagccctgtattccccagcttactccaggaggttgaggtgggaggatcacttgagccccgaaagttcatagcgctcccatgagcccatgattacacctacggcgactacaaccttggtggcacaagtgagaacctgactcttaataaaaagaaaaaaaaactgcgagcattaagtcgggcgagaagagtatagctcccttgttgc

SEQ ID NO: 688965 - DNA, 391 bp, Homo sapiens
ccaggccgatgggagaccctgtctcaaaaagcaatggctggtccctgaggaacaagactacaggttgacctctggcttctttgtgcctccacacacacacacacacttagtttagcagtttgaagaccaggagagtcaaaggaagggacagtgggtgggaggcgtcctgcaggatcggaggcctagaagcctgactcctgtgaacacggaacaagggtcaggattccccagcttgtggtaacccgagacactggttctcacctcatagtgcagggactgaccagacaaatttcctttcttgagtctgtcttgcatgttaacctaattgttgtctttgcattgtaggttattggcggagttcccagcaacgggtggcgtggtacgtcgacgc

SEQ ID NO: 688966 - DNA, 422 bp, Homo sapiens
  misc_feature (39)..(39): n is a, c, g, or t
  misc_feature (420)..(420): n is a, c, g, or t
tggacgctcggtcaccccggccgcctcgccctgcgttancccatgctcgtgccgccgcccgccctcagagaaccatggcgtctggcagtatggcaaccagtgaggaagagcggagtctccgggaatgcgagctctatgtgcagaagcacaatatccaggccctgctgaaggactccatcgtgcagctgtgcactacgcggcccgagaggccaatgggattccttcgggaatactttgagaggttggagaaggaggaggcaagacagattcagtgtctacagaaaaccggcatccgtactgactcgagggaggacgagatctctcctccaccccccaattccagttggtgaaggggccgacggggccgaaggtgctatcagtgctgaagtttacactgaaggaaggattgctgcctcctangt

SEQ ID NO: 688967 - DNA, 812 bp, Homo sapiens
atgagccaccaatcacatgcctatcatatgagtaaaacccagcccatgacccctaacaggggccctctcagccctccgagtgacctccgggcctataccgatgtgattgtcagttccactccataagcgctcctcatactaggcctactaaccaatcacactaaccatagtaccaagtgatggcgcgattgtaacagcgagaaagcacataccaatggggcaccacagcagcacctgtccaaaaaggccttcgactacgggatagtcctatttattagcctcagaaggttgtggcctcgttcgcgaggatttattcgtgagcctgtttaccattcgcagcctagcccgtaccccccaatgaggagggcaccgtggcccccaacaggcgtcagcccggtgaaatcccctagaagtgccagctcctaaacacatccgtattactgcgcatcaggagtatcattcacctgagctcaccatagtctattcagatccatcgaccgagatcaagtaattcaagcacgtgttggtgtacaatgttactgggtctctatgtgaccctcctactacgccttcaggagtactctcgagtcccccttcaccgttgcccgacgggttctacgcgggcagcgtgttggtagccacagggcttccacgggccttcacgtcggttatgtggggcaactttccgcggtaggtgctcaccgccgactatagttccttactcccccgtccttggctccgagcgcgcgataggggctgggctggggtgctatcggtgtccaccttgtggggctccccacccctcggggggc

SEQ ID NO: 688968 - DNA, 401 bp, Homo sapiens
  misc_feature (202)..(202): n is a, c, g, or t
gtaccctagaggatcttatagacctaacaggactgcgctcttgtaacgcgcgacatgcggtcagatcaccagcgcaagtggagacggccatgaggcggagcagtggagagcctacctggaggccggtgcgtgagtggctccgagatacctggagaacgggaaggagacgctgcagcgcagggacgcccccaagacgcatatnactcaccacgctgtctctgaccatgaggccaccctgaggtgctaggccctgagcttctaccctgcggagatcacactgacctggcagcgggatggggaggacccagacccaggacacggagctcgtggagaccaggcctgcagggaatgggaccttccaagaagtgggcgtcctgtggtgggtaccttcttgttagggg

SEQ ID NO: 688969 - DNA, 201 bp, Homo sapiens
  misc_feature (73)..(73): n is a, c, g, or t
taggttggggctcggctgtggccctggggtttcctgctcagctcaaaaaaaccttttggaaaggacagtcaantgagcccctcccatcctggtcacacgtccttccccataactatggaaatggccctaatttttgtgaaataaaaactttttgtatttttggggctgagggtcagcaacagcccctcaggcttccagtta

SEQ ID NO: 688970 - DNA, 846 bp, Homo sapiens
  misc_feature (7)..(7): n is a, c, g, or t
  misc_feature (73)..(73): n is a, c, g, or t
  misc_feature (107)..(107): n is a, c, g, or t
  misc_feature (191)..(191): n is a, c, g, or t
  misc_feature (201)..(201): n is a, c, g, or t
  misc_feature (212)..(212): n is a, c, g, or t
  misc_feature (222)..(222): n is a, c, g, or t
  misc_feature (234)..(234): n is a, c, g, or t
  misc_feature (306)..(306): n is a, c, g, or t
  misc_feature (327)..(327): n is a, c, g, or t
  misc_feature (332)..(332): n is a, c, g, or t
  misc_feature (341)..(341): n is a, c, g, or t
  misc_feature (361)..(361): n is a, c, g, or t
  misc_feature (363)..(363): n is a, c, g, or t
  misc_feature (372)..(372): n is a, c, g, or t
  misc_feature (398)..(400): n is a, c, g, or t
  misc_feature (417)..(417): n is a, c, g, or t
  misc_feature (421)..(421): n is a, c, g, or t
  misc_feature (426)..(427): n is a, c, g, or t
  misc_feature (435)..(435): n is a, c, g, or t
  misc_feature (459)..(459): n is a, c, g, or t
  misc_feature (464)..(464): n is a, c, g, or t
  misc_feature (481)..(481): n is a, c, g, or t
  misc_feature (486)..(486): n is a, c, g, or t
  misc_feature (541)..(541): n is a, c, g, or t
  misc_feature (562)..(562): n is a, c, g, or t
  misc_feature (579)..(579): n is a, c, g, or t
  misc_feature (604)..(604): n is a, c, g, or t
  misc_feature (662)..(662): n is a, c, g, or t
  misc_feature (666)..(666): n is a, c, g, or t
  misc_feature (677)..(677): n is a, c, g, or t
  misc_feature (690)..(690): n is a, c, g, or t
  misc_feature (695)..(695): n is a, c, g, or t
  misc_feature (700)..(700): n is a, c, g, or t
  misc_feature (722)..(722): n is a, c, g, or t
  misc_feature (729)..(729): n is a, c, g, or t
  misc_feature (763)..(763): n is a, c, g, or t
  misc_feature (771)..(771): n is a, c, g, or t
  misc_feature (812)..(812): n is a, c, g, or t
gcatganagaccaccattcttaaaatctaaaccctttaaaatcagttacggcaattcacttaaggagcttganggccgtgttaaaaggagccaggttttcacaaganctcatccacctctgcacattggctggcactgtcacactgcagcctccgatctgctggagtacagaccacagcaccacgtctgcnacggtgagtncattcccagcnagccaaggtntcttcccaagancagagttcatggagcggaaaacagcggctttttctttactgcttccctcttttaactgaaaaatcgcaatanctacccagctatctataaggnttgcnttgacagcnttatgcttctggccaaacananagaacaagncacgtgcaatgttcccttcgccttcnnnggggcacaacgtctggntgcngaatnncatctgcnttttcggcacattcttccaaattnaagtnaattccagccgatagtnttggnggggctgttttttattctgttctccaaagcacttaataaggttttaaggcacgcncttgaacgaggagtgcgtgtncacagtggacaggaccntgaagttctcaaagagcagcctgtncagcacaagcagggagaggggaggggaggacgggtttgcgttgatcacgatgtttttnagcnccccgtaatcnttcccaagcactnaattnaagtncagcgcattggtggttaaagtngtgggcncatccgcttggattatgttggttacatccaagtntgcatctngtgtttgaattaacttggagaggccatcaactgcagctttnaactcatacagacgttttaaaatatcatcttggc

SEQ ID NO: 688971 - DNA, 136 bp, Homo sapiens
gccctgggcgtatccgagctgagggcttccacggctgctatctacttgctccagtcaaacgtggcatgactgtgttggagagcagcttagtggcttccagtaaccttctctagtgtagactcctgagctcatagtt

SEQ ID NO: 688972 - DNA, 402 bp, Homo sapiens
  misc_feature (73)..(73): n is a, c, g, or t
  misc_feature (112)..(113): n is a, c, g, or t
  misc_feature (132)..(133): n is a, c, g, or t
  misc_feature (352)..(352): n is a, c, g, or t
gggatgatgcagaggggcagattgccggattgaggcgacgatcgactccggcggcggaccccagggggcaggnacggcctacgttcgactgggatggctagggcccatcaanngaactattcattaataagnnagggcctcgggccctggactcttattaaatctggctggcgcttccggtatggtggcgtccgctaatgtatctgcggctgccaggcctgcgcattgctcgctgataatgaggctggttcttgagcgatgaggcggcctctgcatatgggcggacgaggccgagtgctccgggaggactttggattaaggaaaggatgagctttccgcagctgctcttttnaaagcaagcgatcttaacatttgcttccagccctttgctcggaagcgaca

SEQ ID NO: 688973 - DNA, 699 bp, Homo sapiens
  misc_feature (11)..(12): n is a, c, g, or t
  misc_feature (331)..(331): n is a, c, g, or t
  misc_feature (511)..(511): n is a, c, g, or t
  misc_feature (605)..(605): n is a, c, g, or t
gcgacactctnngttgacatggtgaaacccggtctctactaaaaatacaaaaattagccgggtgtggtggcaggcgctgtaatcccagctagttgggaggctgaggcaggagaatcacttgaacccgggaagcagaggttgcagtgagctgagatcttgtcccccagactgggggacaagagtgagacttcgctcaaaagaaaaagagaaaagaaaactccatgaaaccccctaaataatagggtatggaaagcttcatagttggtgaaaaaatgggtgttaggagggtgccacccaggagaaggcatggaaactctatatcttcctccancttctacccccacccagggcatactttgctcggtgcatctcttccacttagctgttcctgagttgtatcctttacgatgcattgctaaaatgtaagtaaagtgttttcctatattctgtgaattattctaacgaattattaaacctgagggagattggagggtattctcgaatttacaantgttcggtggcaaacctggcacttaaaatgggagcattttagggaactgagccaagagaattgattaattgtttgacacccaattcctgttagnaaattggagaattggtgtttggtgtcagaaaaaaaccttacagaatagttatgtatggtatagtacaaccttgacataattaacttcatcttag

SEQ ID NO: 688974 - DNA, 247 bp, Homo sapiens
caccagttccgggaggcaaggtggacaggactgctatgagcacaggagtaagagagcagcctgggtaacacagcaagagcccatctctacaaaacataataaaaattagttggtcatggtggtatgtgcctatagtcctggctactcaagaatctgaggcaggaggatcactggagcccaggagttcgaagttgcagtgaacctatacatcatgccacggctactatagcccgtggacgcacaacag

SEQ ID NO: 688975 - DNA, 392 bp, Homo sapiens
  misc_feature (25)..(25): n is a, c, g, or t
atacagctacagccacgtgaccaantgcagaaacaggattgtaattgtcacgactatttcctccttattttgttaaaaatgtttgtgcatgttacacttgtactaagaaaacatcttcattaatttcctttctttttccattatcatgtgacataagatttattgattttatatcagcatttaaatgttgttaactttatgtaatagcatttaggttaaggattagtgtgcttctggttgtatgaaggatagctgtattacgttaggtgtaattatgaccttattatttcctttatttggagattaaatatgatttcaggagatgtgtatgggttcaagttgacaaggggttcaagttgacaaggacttgtgatgttaatatatcaacctga

SEQ ID NO: 688976 - DNA, 146 bp, Homo sapiens
acttgaccttctggcatacctggacccttctggcagactggccttctgcatatgaattacctagaaatagctttggctctccttgcaaagttatttctagttaattcattatgcagaaggtccaggtatgccagagggcccatgtg

SEQ ID NO: 688977 - DNA, 141 bp, Homo sapiens
tgaggacagacactcctgcttccgagcccaaatgttgcattttccaagaccaccctggtctgccatgtccccatcctgggcctataaaaacctgagactagcgggtacacacactatctgctggacatcatgagaaacaca

SEQ ID NO: 688978 - DNA, 260 bp, Homo sapiens
caggaaggaaagcctttttaaaaaataaaaccagggttttccggcttttgtttttcaaaaaagaaaacccaaaacccaaaaccgggggcccataaattccctaacatccccagggttttcatttacttgggtggtttttatggtgggggaacctttttaaaagccagtgatgcccgcccgccttcataaagcaaagggggtctccccccccgcccaatgatatgaaaaaccctcgttgtttttccactcccagaccccca

SEQ ID NO: 688979 - DNA, 203 bp, Homo sapiens
tctcctccttttcctgcttgggcctggtgttgacacagaatggtgcccatcatcaaagtccccgctgacactgctgaacggggaggtagctcttcttctcttggaacccatacgaatccaacttcttccagccgtccgccgcctgcagccccgtgccggtcaccgaccgccgcgcctcgccccgtggtcgccacggctgctgc

SEQ ID NO: 688980 - DNA, 802 bp, Homo sapiens
ctccctttcacggccacagctgaagaagtggtggccttctttggacagcatagccctattgactagggggaagaggaaggcatcgctcgttgtcaccgtacccgagatggtacggccatacaggaggacggctttggtacctcgtttgcccgtgtgacggaatgatgcgactagaattgcggttggaggacagcgatcaaagacgttgtcgggctacaaagaatagcattgacacgtcccttcagtgagtcgacgagcgagcgtggaacgttcgagcgagtgtgcgtgaactcagacttgctccgtctggccccatctacagttgccagcttctcagacgcctctcccgatttattgccagttacttacgctcacgcacagttggtgccccgctacgaaatgtttagaagagctgtattacgccgttctgcaggtctatcctctatagcagccagacaattggagggacattcctggatttcctgggggagttcgcgcacagattattctgtactccatggaggttcacagtgcgttttggaattcacctagggccgccccatcagggagactgccatttaatcgcagatgacagtgctgcgcgacgagagccatttatgcgcttgcacaggaacgtgtcattaaagacaaaaccattgaagcgaccagcatcatgtggacagtcatttcaagtgcttcagactgcaggagactgacacttgtgtggttaactggggggagcagcttgtaacactcgcaaaaggtttaattccacaccgaccatgttaagttctccatggct

SEQ ID NO: 688981 - DNA, 519 bp, Homo sapiens
gagcgggctggaggagggagggggggacaccgagctgcggagagcgcggagagcgcgtgagggaggcgcgcgcgggagcgaacaccctcccggatccagagcccggcggcggcgaagcagcagctgcgggactgcgcccttgcccagagccgagtgcagtccgagcatagccccagattcgcctgaggcctgacagaggctcccgaggatggaagatttccccaagagacatcagacgatcatcctaagagcttcactcggagggaagctcaagctcttgatcctagaccattgtaccaaagggtgcaattggtcgacagccgtttaccgaacggaaaattaactgcagcgaagcagccagagacaaagagaatggaatgcagtggggaaacattgagttccctgtggagcagaaaattgtcaacacaggcataaattctggccaggaaggggctgtacctccagatgggagcacagaacgtgaacccgaagcatatcgccactacccagttgaaggca

SEQ ID NO: 688982 - DNA, 472 bp, Homo sapiens
  misc_feature (140)..(140): n is a, c, g, or t
  misc_feature (261)..(261): n is a, c, g, or t
  misc_feature (289)..(289): n is a, c, g, or t
  misc_feature (292)..(292): n is a, c, g, or t
  misc_feature (349)..(349): n is a, c, g, or t
  misc_feature (354)..(354): n is a, c, g, or t
  misc_feature (360)..(360): n is a, c, g, or t
  misc_feature (395)..(395): n is a, c, g, or t
  misc_feature (454)..(454): n is a, c, g, or t
  misc_feature (467)..(467): n is a, c, g, or t
  misc_feature (472)..(472): n is a, c, g, or t
caagaagcatcagccatgaaggatcccatatagatgatcaggaaaaacaacgagatcatagttagagtgagaattccacgtatccaccaagtttttccaccttgaaagataaaccagatagagcttttttgagaatctcnaggggttctatctgaggatggtggaatttccggaatatcagaatctgttctggaatccaaatctccatatctgtcatcaatatctgtttctttgatgctggtgctctcggtttcgtggtcncgccggcgcctctccctcgcggtgtggnggngacaccgcttccctggggcggggcagcttccccggtgcctcagctccaacatcgttnctccngcgctncgtggcggcctcctcaagcaccccgaaacctgagngcaagcagggttcttgcgaggggcgccccgccacgctgcagccgcgccctggagtcccnggtagcctgtctngactn

SEQ ID NO: 688983 - DNA, 199 bp, Homo sapiens
  misc_feature (76)..(76): n is a, c, g, or t
ttttttttccccgggggggggggggccccccctcccccccccccgggcccccaaaaacccttttttgggggggggnagagggggccccgttttctccccccctttttgttttttttttttttgcccccccccaaaaggggccccccccccctggggcgggggcgggggggggcccttaagggcccttttttttttttta

SEQ ID NO: 688984 - DNA, 990 bp, Homo sapiens
gcttcccgtctgcgcgagtccacagcagctccccagcatcaagaagctgaggccccaggttacacacataaagtaaatggcagaggcagaaagtaacaccgtatggtccatccatgaccccaaggcatgttcttaaagttctggaaacctcctggaggcttccttgctgctcctctggtgactgccacacctgggcagggctgataacatgatcggcccgctcactcatcgtggcttatgaaccacaggcccattcaccagacacagcagcagcaggcatggcagcaagcgtggagcagcgcgagggcaccatccaggtgcagggaccaggacccatcattcttccgagaggcccatgaccggcaagatgggacaggcatcgcattctcatgatactgcatgctagcaatggaatatacagcattcatcacatccgaagacctggcagatacactggagatacacaacagcacaggactggcccagtgctggactaccagggactgatggcacatagacctgccaagagattcatggaggcacataccaaggcaacgcagacagcaccactggcaaccctactaggccgagagcgacatgcacgcaccatggaagcattcgctcggacaggcctggggatgagatgcccataggacgcatgaggtaccaccacggaattgctgaaccaacaccctccacatgaagttggcaatagctaccttccccttgacacatttcacttaacgggccccctgttatgcacaaaatatcaccgaagaccacagatgcccaaacggaaccaccccagtcatcgcaccggaccaacacaacccacggcccgagccacaccgaaactcccccagaaggacgcaaaacaacatcacaaacaccatcacacacgccacaactagccaagaaccacacacaaacccccgaggagacacccaaacaccgacatagcacacccaacacgaagaccacacggcccca

SEQ ID NO: 688985 - DNA, 179 bp, Homo sapiens
agacatattttttaggtaataaattcttatgctaaaacattatttctgcattggaaatcttataaaacccttgaacataaacagtctcttttttacaaagcctgtgtcagcgcacagatttacctagccttgacgattcggaagaaataatatgtaagaatggcctcaaggcagaccac

SEQ ID NO: 688986 - DNA, 426 bp, Homo sapiens
ttatatacgaagtttactttatacgttgatgactggggagcatttttcgtgaaggaccagatagcaacatattttaggtttggcaggccacatcagtctctgtcatatatccttcgttgtctaaaaccttttaaaaatctaaaaatcattccgagcttgccaggcgccgtggctcacgcctgtaattccagcactttgggaggctgacacgggtggattacttgaagtcaggagttagaggccagcctggccaacatggcgaaacctcatctctactaaaaacacaaaaattagccaggcatggtggtgcacacctgtaatcccagctacttgggaggctgaggcaggagaatctcttgaacccaggaggcagaggttgcagcgaaccgagatcgcaccactgcactctagcctgggtgacagtgc

SEQ ID NO: 688987 - DNA, 251 bp, Homo sapiens
aggtccctctaccagtactagcattagtctgcaggtagtcagccagtcagtaggtagcagtcagcctgccaggtagctcagccagtagttcattggtcagtcagctagttgtcagccagacagacgctcagcctgtcaaaattcagccaccagactgttgctcagctaagcatctcattgcgggttctgccagcaggctgcttcatcttttgtctcctctattgatacccagttcctcgtgggtaggaggt

SEQ ID NO: 688988 - DNA, 143 bp, Homo sapiens
tcgcatcttgctcccatcagttggaattacaagtgcaaacactatttttatttcttaaagcaggttagagttttttttttttgagatggggttctcatcttgaattttaactccgacaactatccacttttcctgagaggagc

SEQ ID NO: 688989 - DNA, 174 bp, Homo sapiens
tgcgggggcgcgcggcgcgcgtagcgtcggctgcgcgctgaggcatggtggtgaccgtggtgttcccccgtcttgactagtaatccaaacatgagctgggcctggtgtgctgtgtgcctgtagtcccagctactcaggaggctgcagcagtgaacatcgcttgaacccgtgagg

SEQ ID NO: 688990 - DNA, 5619 bp, Homo sapiens
tccgcgccactgatatcatgcaacaccagatggtgtcatttgatcaaagaattttgctaacagaaatctcagatttctctctaagcgaaatgccttgactttgtgactgattgtgcaagaatctcaggaattgagaaaacagcgtctgtgttgctacaagactgcagctttggataatacccccctgcttttactttcttctctgtctttaacttcaaaatgtattttacaccccaaataattgtttactatttgtttcctagaacctcaaaagtcattaatttttaagaaaagtcactgtgctttgttggaaaacaacctcaaacttgaatggcttcacgccagtagttgaaaatattttacaataggccactttctggaaagtctaataaaaatcatactgagcatttttattcctgtttacacttgtagagcattatcacaatttaaattatcttcagcccatatatagcttcatattttgcagccagcaatgaagttctgcccacagtttacgtttacgactttcttctgaactgccgtatttatgttactgttttcatcactactctttttttgtacattttaccacttaaacagtaaatctatgtgttttgacaaatgtgtacagttgactaaccaccaccaatggtcaagatatggagtatttctattgccatagaaatattcctccatagaaatatttcaatttctctcaagcccatttctgctcaatcccctctccccatccccagggctagcaactgctgatctgttttgtccttatggttttgccttttcctgaatatcatataaatggaatcagatttgtagcctttcaattctggcttcttgcacttagcataatgcctttgagattcttctgcttgtatcaagaattcattcctttgattgttacccagtattcagtcatatggatgtatcacaatttatttaccagttgagggacactttgattccagtttggggcaattatgaatataactttgatgaatagctattcactactgggtcatctagtaagtgtgttttaactttaagagttgccaagctgttttccaaaataactatactattttttttctttttccttagcgtgtctactttttcatgtttttgtggtaaaatacacataagatttagcatcttaaaaatttttaagttcacaattcagtggtattaaatatattaataacactgtgcaatcatcaccaccttccatcatcataactcttttcatcttgtaaaactaaagctctattcccattaaacaacaactctccattctcttatcccctcaagccctgaaaacagccattctactttctgtgtctaattttgactaagtatctcgtataagtggagttatacagtatttgtcgttatgtgattggcttagttaacttagcagaaagtccaccgtggacatgttgttcatccattttgtagcatgtgtcataatccccctcctctttaaggctaaataataatccatcatatgcatatactacattttgcttattcattcatccataattggacacttgggttgcttccatgtttcagttattgtgaataatgctgctatgaacatgggtgtacaaatacctcttaaataccctgctttcaattcttttgggtgtatccccagaagtggaattgctaaaccatatggtaattatatttttaatttttaaggaactgtctcactcttttccacagcagctgtatcatttcacattcccatcaacaatgcacaagggttccagtttctccacatccttgttgacacttgttattttttgttgttgttgttgttgttttaatggtagccatcctaatgggtgtgaggtggtaacctattgtagttttgatttccatttcccttataatttgtgatattgaacatctttctatgtgcttactgctgatatgtctacttaagccctttgctcattttaaaatctatttgtttctttattggtgagttttacgagttctctatatattctgggtaataatcccttatcagatatatttgcaattattttcttccactctgttggttgcgtttttactctgttgatattgtcttttgatgcacaaacttctaactttcatgaagttcaatttgtttcttttacttttgctgcctgtgcctttggtgtcatatccaagaaatcattacagaattcaatattataaagatttcctgatgttttattctaagatttttgtagttttggtcttacatttaggtctttgatccattctgagctaatttttgtatatggtgttaggtgagggtctaactttattctttttcatgtggatacccagtttcacagcaacatttgttgaaaagactgtcctttccccattgaatcatcttggtacccttgtcaaaaatcatttgaccatacatacagggtttatttcagggctgtctattcaattccattggtttttatgccagtaccacactgttttgagtattatagctttgtagcaagttttgaaaccaggaactgtgagtcttccagctttcttctgctttttcaagattgctttggctattaaaggtccctgagatttcatacaacttttaggatggttttttctacttcctcagaaacgtcattgagattttgatagggaatacattgactgtgtagatcacttcgggtagtatggacatcttaacaacattattgacatcttaagaacattaagtcttttaatccatgaatatacttaagtatatcccatggatatacttatgtcttctttcattttttaaattaaagctttgtagttttaagattataatatagtaaatgatggaaaaaaaggcatatagaaaataaatctcaaaatgacagaagtccccacttaacagtaattactttaaacgtaaatggattaaactgtccaatcaaaagacagattggcaaaattaggggaaaaaaacatgattcaactatacatgatctacaagagactcacttcagatccgcagacacaaattgtttgaaagtggaggatggaaaaagacattgtatgttaacagtaatcaaaagagagcagggtggtattctacaaatttatcttagcactagtttcactacattgcataagttttgttatgttgtatttttgtttctatttgtctctaagtattttcttctttaaaagtttatttttaattaacaaatgataatagacaggagaaatacattctggtgatctactgcacaggatggtagccatactttaataataatgtatcatataattcaaaattttgaaaatagtggattttaaatgtcaccacaaagaaataagtatgagaggtgatggatatatttattagcttaaatatatcctttggtgatttcttttgtgatttctttggtgatttcttttttatctatttgttgtttaagagtgtggtgtttaattttcacaaatttgtgaattttccaatttacttctgttactgatttctaacttcatccttttgccatcggagaatatattttgcatgatatctcaaataaatctcaaagtgacagaagtcctcacttaacagtaattactttaaatgtaagtggatcaaactgtccaatttttaaatttatttatacttaatctgtggcctaacatatggcatatcccagaaaatgttccgtgtgcacttgggaagaatgtgtatgctgttgctgttgaatagatgattctgtgtatatctgttacagctagttgactgtgttattcaagtcttctatttccttctttatcttttttgtcattctatccattattgagagtgtgcttttgaagtttccaactattactgtagaactgtctatttcttccttcaattctgtcagtttttgcttcatatgctttagtggtctaccattaagtatgtaaatgtatatcacaggtatatcttcttggccaagcttggtatgagagtcttagggagacagacttttcattctagttaagattcatttcacaaaatttagagtttatgtacagttcatatggcattgttggattgacatagttcttgctgacatgttttatcttggttggttggttgatttgtaatatttctttaccaaaacacagagtcagtgttaaataacaaaaacaaaaacaaacctcagttctgaaagagctacagaatgctaatctatgggattttggctacgtcaaaaagttggtagaaagtagcctcaaattctgttccacatggcactatctgaaagagagggcataattttttgttctggaaggatctagggggcatagtatccaaaaccaacctcttgatggtatatttcttccctctgagtttgattgtgaacaactgacctccaagggaggctcaaatcaagattctttttattctttcatttcacttctatcctgtttcttctaataatcataggtctctgctagtattcatatctggcaaaacaataaaggactatcatttcttgggagaaatggtgttgctgcacagtacaaatttagttataaatcatgagggtttagtatttgtcccatggtttcacattttgaaatattcagtgttcatactgaattttaatatttgtagtaatgaaatagtgaacatttatagtattgttttcatatttgttattttggactctttgaaacctaggaaaagcaaacacataataatgtctcatcatcctgtttcctgcaaaaacctttcactgatattcttcttatcgtttacatataaactatttacttatgggtagaattcacaacaacttcagaaatgggttacttgtggagagggagggaatgcagaggaaagaatgagtatcctctggctatatctgttatattgtatttttctacctaaaggaaatatgaagtaactacagcagaatgttggattaattcaactctggcgttgttaacaaaatcatatccatcctactggatgatggtttagaataaacttgctaaagaagaaattcacacttttccctaagtgagtcttctatgcaacaacagggaaaagagaatttcagacatttctttgctttttaatttataaagtgaagaatattttatttggattttgtttcccagaagagaatagtaagagaaggttcatattactcaaatttgaaacactctttattgtattatgattatttgacatcactatacatcttaacctgagtccctctcagaaaacagagctaagacaaggcttgtatgcaaatagttagatcagagatgtgatcccaggtagcaataatagataacagagtagagtgaaccagagaaagagggaaaaccaatacaggtgagattactaagttgctcaccattatgggtaattagaatttgatctaactagattcttctgagaagccattagaatgggcctcaggattgtctgctgaatagatggatagcggtattatgcatcagctctcattccctatgggtcaagatttcctcctggggatgttaactcatctgcacttccaggttgaagcaaagctgaatgccaggcacccacaccttagccctgtggca

SEQ ID NO: 688991 - DNA, 131 bp, Homo sapiens
ctaagatccccagctccacaagagaggtctcggtatactgtgctcctgacatcttccttattgttttgggaactggtctaagatgcatacctatatatagactttaatccctttaacaagaagattaattt

SEQ ID NO: 688992 - DNA, 350 bp, Homo sapiens
cccacgcgtccggtgttggaatggattccagagtctcccagcattgactatttatttataataaggaaggggaggctgggcacggtggctcacgcctgtaatcccagcacttgggaggccgaggcaggcggatcacgaggtcaggagttcgagactagcctaacaaacacggtgaaaccccgtctctactaaaaatacaaaaaattagccaggcgtggtggtgggtacctgtaatcccagctactcgggaggctgaagccggagaattgcttgaacccgggagatggaagttgcagtgatctgagatcactgcactccagccttggtgacagagcgagagacttcctctc

SEQ ID NO: 688993 - DNA, 791 bp, Homo sapiens
  misc_feature (7)..(7): n is a, c, g, or t
  misc_feature (40)..(40): n is a, c, g, or t
gggaaantcccaaaagggaaaaggaattgagggtttcccntccggggccaaaaattccgggttaaaaaatgggaatttttttcccccccctaaaagggaaaattattgaaggtaacctcccagccagaatgttggattaattcaactctggcgttgttaacaaaatcatatccatcctactggatgatggtttagaataaacttgctaaagaagaaattcacacttttccctaagtgagtcttctatgcaacaacagggaaaagagaatttcagacatttctttgctttttaatttataaagtgaagaatattttatttggattttgtttcccagaagagaatagtaagagaaggttcatattactcaaatttgaaacactctttattgtattatgattatttgacatcactatacatcttaacctgagtccctctcagaaaacagagctaagacaaggcttgtatgcaaatagttagatcagagatgtgatcccaggtagcaataatagataacagagtagagtgaaccagagaaagagggaaaaccaatacaggtgagattactaagttgctcaccattatgggtaattagaatttgatctaactagattcttctgagaagccattagaatgggcctcaggattgtctgctgaatagatggatagcggtattatgcatcagctctcattccctatgggtcaagatttcctcctggggatgttaactcatctgcacttccaggttgaagcaaagctgaatgccaggcacccacaccttagccctgtggca

SEQ ID NO: 688994 - DNA, 368 bp, Homo sapiens
cttcggcatgaggatagctgcaaatgccaacatttaaaaagatgcgacatcttggctgggtgtggtggctcacgcctgtaatcgcggcactttgggaggccgaggcaggcagatcacctgaggtcagaagttcgagaccaacctggccaaagtggtgaaacctgtctctactaaaaacacaaaaattagccaggcgtggtggctcacacctgtaatcccagctattcacgaggctgaggcaggaaaatcacttgaacccgggacgccggaggttgcagtgggctgagatcatgccattgcactccaagcttggggtgacagagtgagactctgtctcaaaacaaccaaccaaaaaattccctagaaag

SEQ ID NO: 688995 - DNA, 269 bp, Homo sapiens
tcatcgaacgggtctggaggatcatctaagtcgatcaggtgtccgatttacacgatattgagagggcagcacgatactcacgtgtcgacggaacttgtacaggcaggcatgcaccgcagtggtgaatacacgtcgaccaggctccatgtttacgatatttggaggtgagcacggagctcatgtattgaaggaacttgtatagggaggtatgcatcgcagtggtgaatacacgtcgagctggaggcatgcatgcatgctcgggtactgga

SEQ ID NO: 688996 - DNA, 213 bp, Homo sapiens
ggttatatgctgtctcaggtatgctggtctcaaattgatgttgggggtacaggttcagcaacttcctcacagcactggcaggaacaacccatccccaagtttcatggatggttgggcctggtgggacaggcagtgaccctggcccctgccccgttctggggtgggcaatagtcaaagggcgaactctggcaattccgcgtgagacttgggctc

SEQ ID NO: 688997 - DNA, 496 bp, Homo sapiens
agcctgcgtcacgtgccgtctgcctctgcacgtggccatctcccaaccagctcactgcgttctgaatgaactcagaaattgcctgcctcaattctgagattttcagctcataagcactgggagagaacgttcagacccgaggtgctgtatcaaccttccgctaagcactcctggcaacatattcaatgtcgacattgttcaccgtgtctccagatcaccagagggacgtgggcaccttgccgcagcgcctcaccaatcacgaccaaaacataaaggggctgacttaggggccagggctcgttccacatgcaaactcaaattacaccccggaaagaggcagcacagtcattctccctgtgcctgggaacacacagtacagagggccgggcttccagcgctgctccctgcagtggggcctcaagacgaatggccagcgctcctgtgcacggctcccataaataccccagtgtgatgttcccatttctccttcccagag

SEQ ID NO: 688998 - DNA, 119 bp, Homo sapiens
ccggtacttaagctcctatgccactgcctgctggtgaactcggtggaggaggtcggcggccaggctcaccagcaggcagtggcttaggagcttgaagttgaccgggtcacccgaagctt

SEQ ID NO: 688999 - DNA, 348 bp, Homo sapiens
ccccgtacgccaatgtagcggcttgtaaaaccgagaaagggaaaacagaaaatcaattaacacattaaccttccatcttgatgcaatccatagtaacactctgataagttattactagatagtttaacacccataataatgtatcacgtagagttgttcaccacgtatgatgtactcccttgattgtttttcactaatgtacccctattacactctataaaacttgcaaacatcatactataaaattgcataacttaatgcttagcattatttggtaagcatgtggatgtttgatacccttgatatgcatgtcatacggtgatgatgtggatagagcgtacgcggagt

SEQ ID NO: 689000 - DNA, 607 bp, Homo sapiens
gctctgtaagtgctcccaggagaaagccatgttcagtgtgagcgccaagatcgcgaaacccactgtcgagaagccggaccagatcgagtccgcgatctcccaggctcttatggagctggagatgaactcggacctcaaggctcaactcagggagctgaatattaccgcagctaaagaaaatggaggtgcaggtggacggaaagctatcataaactttggttccggtgctcaactggaagctttccagaaaatacaaggtcgggtaggacgcgaattggacaaaaaggtcagtggcaagcatggcggctatatcgctcagaggagaattctggctaagacaactttaaacagccgtacgataagcgcaagcgtcccaggagccgtactctgacaggtgtgcgcgatgccatacttgaggactctggcttcccaagcgaaattgtgagcccgagaattcgcgtgcaactagatggcagccgtgtcataaaggctcatattgacacaggacagcagaacacagtggatcacacagtttgaaactctctctggggtctataagctcaccggcaacgacgttgatttctgaatatcagagcctcaatagtgc

SEQ ID NO: 689001 - DNA, 286 bp, Homo sapiens
agagacggggttttgcgatattggccaggttggtctcaaactcctgacctcaggtgatccacctgcctcggcctcccaaggtgctgggattacaggtgtgagccaccgcgcccacccgctcctgggtgtctttgcataagagaatggaacacacagcgcacggaagacctgggaacattcacagccgcatctgtaacagccaaacagtggaaaaggctggaatgtgccccaaggaatggatgggtcagcaccgtgcagccacccacacacgaacacgactcaggag

SEQ ID NO: 689002 - DNA, 365 bp, Homo sapiens
atccccgcattctgattgcggcgcatgcccaatgcgttgtgactaggaaaaccgtgccgattggaatgccaggtgtcgcgtgtcctctctgacttcaagccctgactcgtctcccacagaccacccctccacgtgtgctggccctgcttgcacgaggattgctggttccccaaatccacggaccattctttcgtggataagctgtgcacggagcagggcatccaccccaggttccagaagcccatgcagctcaaggacaagactgcgttctccatcatccattatgctgggaaggtaccagccacagggcccaggggactctgtctcaggggacccccagtggctgctcagcgccgagatcagat

SEQ ID NO: 689003 - DNA, 430 bp, Homo sapiens
  misc_feature (19)..(19): n is a, c, g, or t
  misc_feature (63)..(63): n is a, c, g, or t
atccagcctaacacttttnatcctttgtgtccccatgtaaaaactgttaaataattaagtttncacccatgcccagcttgatccaaaaagtccagtccccagcacagtggcctcacaccctgtaatccctagcactttgggaggctgaggtgggaggactggttgaggcccagaagtttaagacccagcccgggcaacatagtgagacccccatctttacccaaaacaatattttaaactagttgggcatggtagtgagctcctatagtccaagctactcgagaggctgaggcaggaagactgcttgagtgcagaagtttgaggctgcagtgaactatcattgtgccactacactccagactgagtaacaaagtgagaccttgtctctaaaaaaatcataataaaaagtcagtgaaagtattaaaaaaaa

SEQ ID NO: 689004 - DNA, 1068 bp, Homo sapiens
agcagtgactcacgccggtaatcccagcactttgggaggccaaggtaggcagataacctcagtcaggagttcaagaccagcctggccaatatggtgaaaccccgtctctactaaaaattcaaaaattagccagtcttagtgacacgcgcctgtagtcccagctactcgggaggctgcggcaggagaattgttcgaacccaggaagcagaggttgcagtgagctgagatcacaccactgcactccagcctgagcgacagagcaagactgtctcaaaaaaaaaaaaaaggggggtacaatttttgctttcttccagctaaggtaatggcttttctagaaaaaaagcaattcaggggaaacattttagagcaagagtgattagtcgggtgactcgtaatggtgtaataattaaaagctttccttagacaattaccacaaaaaaaaaaaagagaaagaaaaaaaaaaatttggggggcgaaaggaccccgaaaaagccttcaaaccaccattgtgtgggggacggacgggaccccagagacatcacgacacacgtggcacagcaggggtccccgagagaaaactcggcggaacgacacaaagcgcgggggactcccacccaaatataaaaaacgcccggggagaacacgcggtgtttcgagaccaacatcacaaaaaagggggcatcagcagaggcacaacaacgggaggaccaacaaacacaggaggtgcacaaaggagcggcgccagattaaataattatccgccggcgcgcctgcggcgaggacaaagcacgacacgagacgaagaaacgagagagcaaaagagaggagagagcaacaaacagcagacacgcagagcagaacaaagagaaggaaaagaacaaaaaaagaccaagacaggagcgacaagacgaaagaagagaagaagaaacaaaagagaaaacgaaaaaaaaaagagagcaacagggagaaaaaaaaatagaagaaaaggacaacaaagagcaccacgggacaaacagaaacagagaaagacaagaacacagagcaaacggaaaaagagagaagagaaaa

SEQ ID NO: 689005 - DNA, 150 bp, Homo sapiens
gaggaaaccgtgtactattagccatggtcaaccccaccgtgttctcgacattgccgtcgacggcgagcccttggccgggtcttctttgagctagtttgcaagcaaggtccaagcaagcgaaattttcgggttccagcactgagaaaaagg

SEQ ID NO: 689006 - DNA, 386 bp, Homo sapiens
ggagagagagttttgctcttgtcgcccatgctagagtgcagtggcacaattttggcttactgcaacctccaccttctgggttcaagcaattctcctgcctcagtcttccaagtagctgagattacagacatgcgccactacgcccagctaatttttgttatttttagtagagacagggtttcaccatgttggccaggctgatcttgaactcctgacttgaggtgatccgcctgcttcagcctcccaaagggctgggattatagccatgagccatcgcacctggctaaacacatttttttactgtagaaattaagatcaaatgctgctctgattttctaaaaataataatgatgatggtcgacgcggccgcgaatttagtagtagta

SEQ ID NO: 689007 - DNA, 89 bp, Homo sapiens
  misc_feature (16)..(16): n is a, c, g, or t
gaattcgagctcggtncccctatcaatgaggcgattccgctatcaactgaggcgattccgctatcaactgaggcagatccgctatccgt

SEQ ID NO: 689008 - DNA, 404 bp, Homo sapiens
tctatggcgcctctctccacaatcacttggagatatttattcatctgctattgcattctctactctattatcattaacctagtgtatatcccccagactggtactattttgtcgtggtcactatcagcgtgtaataagctttgaaatccgctgcaccgatgatggccccttcagttatctttttcacaatagtttctggttattctagtaccttcgtctgttcagataacttttagcatacacttttctgtatctcgacatacaaatcttgctgtgatatataacaggacttgcatcaaatctttggcagaatcgacatcttcactgtgtagagtcttccaatctattaacatggtatgtctcaccatttgttgaccacagatagtcagcagcagggtaccgag

SEQ ID NO: 689009 - DNA, 503 bp, Homo sapiens
tacttctcgcaggctgtggtgtcactgctggctttccgagcctcaggaggaagagtgtgctattgtagtgaaagctccagcctgcttgttagtctagtcttaactctataaattatggactctgagacttagtctaattacaattgaaacgattctgaagcattgtaatgcagtgaagtattcaaagtaatatgaacattgcattgacatttttctaaatgtcaaattgacatcattctgggctcctaccatggcacaagttggaccaaataatagctaatctgacaacaagtggtacactccagtattttgttttccattctatttcattccatcccactccattccattccagtctgttaaaaaagaattatttcacaaaccatttgaggaagccttaacgtgagataactcacagtttgagaaacacgggttcacttaataaccacctacctgtatacagcactcttccaaagaagcagtctttgtcctttataaccgta

SEQ ID NO: 689010 - DNA, 346 bp, Homo sapiens
agtagtcgagaccaccttgggcaacatggtgaaaccccgtctctactaaaatacaaaataattagccagcgtggtggcatgcgcctgtaatcccagctacttgggaggctgaggtgggagaatcgcttgaacccaggaggtggggggttgcagtgagtcaagattgtgtcattgtactccagcccaggcaatagagcaagactcaaaaagtgcaaaagggagtaaccagcgaaaaaaaaaagtttctcattccttcaagccacggtcaacccacaagccacggtcaacccacaggccacggtacacccacaagccacggtcaacccacaagccacggtcaacccgc

SEQ ID NO: 689011 - DNA, 266 bp, Homo sapiens
taccccccagtctatctccccgtcaacccgaggctggcttcagtgagggcgcggagcagccattctaccagtgccccgtggttgcccctggcacgtgtgcgtctgctgctccgggatggagctggggtgtgggatgcacggcctcgtgggggccgagccgacctccagaacccgcatgctcccatggccagcccccttgtcagactgacgtgacccgtctaaccatgactgccttcacctgtggagtgtaacgtgggtgcctcact

SEQ ID NO: 689012 - DNA, 147 bp, Homo sapiens
acagcagctttagtgtgattcagatgttgatgtctagtggccttgggcttagtgtggtatccaataacagttgggtcttagctattgtgtgttcagatatgttaaagccactttcgtagtctattttgtgtccccgtcacgacttga

SEQ ID NO: 689013 - DNA, 161 bp, Homo sapiens
tgggaggctgcagtgcattccagcctgggaaacagagcaagaccccatctcaaaaaataaaataattaaccaattcattaattaaaataaaatgggaggccctgtgagggagcaaggtgggagttcatgcttcagccctggattgaggacagctgtgaggg

SEQ ID NO: 689014 - DNA, 92 bp, Homo sapiens
aagcaggctggtacggcggaattggatggcggaaggtgtggctagttctctagcatccaggcatcctcgtcgctgcagcgacacacgctctc

SEQ ID NO: 689015 - DNA, 502 bp, Homo sapiens
  misc_feature (251)..(251): n is a, c, g, or t
catgcgaaatggacgttattggtttaacataaaacttatggtatcctaccaagaatacatgtcggatcaaagacattgatcgagccacctaacacatgggtattttaatctgtccatggaggtggaaatgatcgaaagatgttgtttcttttataccagctaaggccgagtgaacgtggctgacacgcggtgggggaaatagaaccgtcagaagttgaagcaccaaatctacctgctgacacagtgtcggncacattcaccatatgaccaggcttaacactctgcactgacacagagagagcataatgcgtcttcagaacactacctgtgtatgcgagctattgagggaagcccatattgacttgggcgatgtattgacaaagttctttgaagcttatggcgttctcaatgccagagcgctggatgaggaccaccaacgtcctttggtacaattcagccagacactctgggaccacccttgacttgaagcttataactacgt

SEQ ID NO: 689016 - DNA, 206 bp, Homo sapiens
gttgcacaggctggtctttgaactcctggcctcaaatgatctgcctgcttcggcctcccaaagttctgggattacagacatgagccaccatacccagccaaaggtcagttttcttaatggagaaatcccaagagaaagaggcaatcccatctttcatgttgtactatcaagttcagacatgctttgtctgtatcttccttcaggca

SEQ ID NO: 689017 - DNA, 843 bp, Homo sapiens
  misc_feature (282)..(282): n is a, c, g, or t
gctcaggagggttccgtgctgctgccggtgtctatgggaccctcgccctcgcttctcggttctatctgccccaggagccgcggcgggtccggtgatctctccgtctcgttgtccggctgtcggcgcgccgtgccactgtggcttgtgcgacgagacccacgtggcgtgcctccttggtgcacctcttctcctttcctgcatgtatacgctgctgcatgcttggtgacgtcggacgctccggtcgactagctctgcactccttcaccgtgcagcctcttcgtntctactggcgccgttcttgcagcttttgacgcctggtgcccctcttgtccatgggcctctgcactagtgctcagatgctccctgggaccagcatttcttgccattcgcccatccgtgaccggacagcccacctgacgctgcccgagacacagcgctgagcggccacttctcgcagcctacacgacatggacgcacacacgcgcgtggacgttggaccatcgacgctttaccttactgacgtgggattcctggatcttcaatgccacgaagtaacgaccagtcagcaataggcacgcactgcatgggcgactggagccgcaatagcagctgcactttggcacccatgcggcgaacctacactcttacggaaaggctgtaagggcgttggccccggtagacgccccagggacgaatttccacgccgcacctcgatcctgtccggttgcattcgcagcttaggaatccctcctaaccccttaaccggcaacagcctcgcccggcgcgacggggccttgaagcccactagaccctccacacatcttccctcccgacagtcagccg

SEQ ID NO: 689018 - DNA, 348 bp, Homo sapiens
ttagcgatcccttggcagacactagtgtcgcctgcgtgagcgctaggacctgcttcatctcagccgattggtcgaacgcctgacccatgtagtttctggtcccggccgagaagggaattaaagtcagaggtgaccgtctgcttgattttctcttggttgaaacggaaggggtcgtgaatcttagaagcctagcgggccgtctgggagcacaaagtcctgcgtgcaacatcgctagatgaccgggactgggggatgcaaccgcaggctctccttaatgcacatggtcaggaagggcagctgggccaggtcgtcccattcaatctctataggttcacggtccctcagaag

SEQ ID NO: 689019 - DNA, 564 bp, Homo sapiens
actatggtcatagctgattcttgaggataaaccacagtaccgacagttggataggctttgcgtagatgattttgcccaacagaagtctaatgtaagtgttctgagcatgttgaaggtaggctaggctaagctatgatgtttggtaggctagatgtatgaaatgcattttcaactcgtgatattttcaatttaaaatggattcattgggatgtaacctaataaaaacttgagcagcaactgtatttgaataaattacagtatacagaaaaggcaatactcaaaactcatcacgtcataataactgtactatgttttaccattatctatgctttggcagctatttacatgtattgtgtctgtatgatgacaactatataatgaggtgctactgcacatctctttccaaacctgcattctataatgtgatgttggtggcttgaaattggctttccgctacagtaaccaaaacagcatggtactagtacaagaacagaaacatagaccaatggcacagaatagagaactcagaactgagtctgcacacctacaaccatctgatctttg

SEQ ID NO: 689020 - DNA, 556 bp, Homo sapiens
cctcaccggtcagtgtgtacttaggcgtggggtctggagctccagcatcatggagtgggagtcacaagatgtcatagaacagagttgtccagcatgacggaagcaaccacgtgtataaatgctcaggaaagagcagcacagagagcagtgaaattggtggcaagctgctgaagaccagctcctgaatacctttgttacctgtgtcacggcgaaggttccagtcctgatgcatcatgcgcacgcttggtgggtgcactcactcgcagaggtggtatgctctagtttttctcctctggaatgttaacttatcggggagcattttcatcaataattgtggtgagaccataagcacaaagactggcccgccgttgcccaattctcgcaacagaggaagtggaggtttcagttgagatccaagtagcaattgtgttgctttgtaattacgtacgcagaacatggaattctagagatcagtcaactcctagttgtgatatacaactggatttaggaccttgaaaggatttttcaaagcctctgagcctcattttctcaccag

SEQ ID NO: 689021 - DNA, 663 bp, Homo sapiens
aaacaagaattaaacggtattttaacggagacatgaagccttccattctgcaatcaacaattcagctggagaaatggttggacaatgcatgcgtttgaggccttttgaatataacgccatctgtcaaaagggggattcagctaagtcaattaagtggggtaacgcaacagtttcgcacgcatagctgatgtaaatattcgggcaatgtgatttgtaatatgactcgttataggcatcatggggactgtgtcccccccctgagttcttgattgttcttgttcgggaatcacataatacctgtatttcattgtggataacgtccgcatgagcagcctcagaacgtctgtaactgcttgttgatgctgcaagctttgcttaccttgagcacgttgaagcacactgtcttgcgcacaggccggcactcgtccactgtaatgatgtcaagactctggacgtccctcaagcatgtgcacagatgtacaaacatgttcatgtggcgcttctttaagcggttgtgcttgcgaatgtagtggatatagtcccgcagtatgacaatggtccgctgaatcttcatcttggtaaccacgcaatagagaaccgccctcgaatgaacacattaccagtcaagggacatctctagtcaatgtaggtgccctcaatagc

SEQ ID NO: 689022 - DNA, 148 bp, Homo sapiens
gactctagaggatttctgtgcgcgggattctcatagcctctcggtctcaccatagcctcacctcggctcctccttaggcctgcctgagcttctatcaccttcctggtctgcctctccaggcccggtgcacatggcttcggaggtggtc

SEQ ID NO: 689023 - DNA, 1100 bp, Homo sapiens
  misc_feature (172)..(172): n is a, c, g, or t
  misc_feature (608)..(608): n is a, c, g, or t
  misc_feature (610)..(610): n is a, c, g, or t
gctttccggcggggctcgcgagcgaggcagacatgtcttatccctgctgatgattatgagtctgaggcggcgttatgacctccttaggcttatcccagtcgtactatgatattgcacaacatggagatccataagacaggaccttagcttatgaaacgtcagtatgaacagncaatagctatcaaggtgatccgctgagagtgagtcagaaagacttgcatcgcagatcattgtcacacgaagagacgttgtcgtcagcactttgatgtgactcgatgcaaatgctgtactgaggcatacggaggccatgtcctgtgttctccatgttgagtgtcgatttagacctagagagagtagtagtcgagagtcgcgatggagctctctagtgatgacactggagctggtagccagacgcctgatctctgcaatgatatcgatatcatagatagtaccaccgattgggccccggagcggctgtgacatgtccacatatgcttcgctaactaagtgattagtcgctaggagtgtagtggcagtggtccattgcgcatgaagattcctacttgcaccattagatgagaggtttactaagcggtaaacgaaggggncngcgagtgattgagtagacgcaacagaatggtgcgaggttgggggagcggaccctgtccgcttatggtgcagacgcagatgaggttcccgaaatgccttgagttcaccaagcgtgagctccgtcgaatcgtgcttgccaatcttggcacagttccttttaactggcagcgggatggttccctgggctccccctgtgaaacttgagctctaatcacatgttgtgtcgtcttgtgtgcatatttgattcggattgaaggtttcagtcttaacaccaagattgttcaaggtcaatcgcacggtccacgtaacccgctgtagaagaacttgccacaggaaggtcaggagcgacggagcctttggacgtttcacttcggttccgaagttcccgcagaaatgctgggaactgttccatcagtggtccctccaagtgtgcctgtcagttcccgtggttagacagaatccaaacttcaagcgaccagttgggcagggta

SEQ ID NO: 689024 - DNA, 275 bp, Homo sapiens
ggagagcgcgtgctccaccagcaggacggacaggttggcagcgtcaatgtgcagccagccgataaagttgcggccttgtccatgctctccaactccacctccacctcacgctgaagcgccagtaccttggttgaaaaagtgtaagctacatcgctgaaaggctctccttcctgcaacaagcctgggagggtacgagctcctctggggcattcactgcctgcaagcaagaaggtgatcaggcaagttcccattggcaaatagagtatgagacgaga

SEQ ID NO: 689025 - DNA, 1293 bp, Homo sapiens
gcaaagaagctttctggacatccgttgcccggtccgctgtaacatcaaagcaaagaggtgttatatacgtgcgagtctgatctccagagtgccagcgcatgcctgtggcaaacacatctgcgctcatgaaacatggctgatcgtgatcggccgagaggcacctgaccagtaacactggtagacttacatttgccaagaccatgtgccgatgaaaggcaaccatcaccaatccacgtgtatactgtgtatcagtgcgtatgatcacagtgacagagactgagtgtccaagcactggtggactgcatttgctcacgagtcggtgggtcagaaggcacttcctggcatgtctcttgcaagagaccaggactgtagggcccagtcagtcaaggatcgtatctggccacgtttgggcacgtcgggttatgctgacctcaagctttccatcgtgttggcttgtacagatgtcggacggtctgattcacccgctcagggacgcccctcggggagcgctggaggtatgacccaatgatggcgctttgtcaagtaattggcttcctaggcacgctgtcttcgagaattcagcacgtacagcttttcggggccgcttcgggagaaccggtgagcaaacaagatcactctagtccagccctgaataagtccgaactggcgaacatggaggtttatcccagccgtagggcccctgcggattgcagattgagtgtcgggtaaacgagagatacagcaaaacttccgtcaggctttaccccgcttgttactttcgaattcgggaagcgctggatttaactatctttgtcaggccccgtcctggaactctattgggaaccgccaaagggattgtccccgtagaagtgggcaaacattgaaagcagttcttaagcggctacgttcagcgccagggctcaccggaacaaggccccggataaagcccctgaactataaagacgggacgccagccggttcaaattcgggagcattcttctaaagatgccccgacgtttgaaaccggtccatggttttgatttaagcccggggaagctgggctcccaacgttgatgtaaaggccgcagaaagagtgtcaatcccagaccacagggcacggacgaacccttcgccaaggggtgggctaatcccaaggatgggggcaacggaggaaatcccgggaaaacaaccagagacaggatgaaggaaccgccacagaaacccgcgcgtatacacacgtgataactttcaccacagaaaaaacataacacaagtctgacaaagacacaacag

SEQ ID NO: 689026 - DNA, 358 bp, Homo sapiens
  misc_feature (314)..(314): n is a, c, g, or t
cagctgccttatccaatcagagctatgctgtctaactgcattggtcatccttaaactggtttagttgactaatgcattaaaccacacattatcatgaagttcggtcactagctccagacggacctattttcttcatcctctggctccttttgttcgctcccctggtttaaatttttttcccaaaaatgccgctgttgttcttcctccagcactggctggcctttgctctgctccatctggaaatccccactcactttcaaagaccagtttccatataacacaactcttaattcctcagttaattgctccctatnttgtgtccctaaggcactttgtacatggtgatattttagtactt

SEQ ID NO: 689027 - DNA, 125 bp, Homo sapiens
taaactcaggagcgagctgcaggaagaaggtgaagatatagatatgtccatggtaaatgttgagggctccaaaaatatactcctcaggacacagcgagttggcgtcgttaacccattcagcaact

SEQ ID NO: 689028 - DNA, 161 bp, Homo sapiens
tagaacacagaggaggtggacatgcatgaggagggggcagagaggcggctcagtgttgccctggctctgtggcctcaggactctctgcctcaccctgcttcagcccagtgacccctgtgagactagatccccgtctgtgctagtccacctacctctgtagc

SEQ ID NO: 689029 - DNA, 496 bp, Homo sapiens
  misc_feature (56)..(56): n is a, c, g, or t
  misc_feature (73)..(73): n is a, c, g, or t
  misc_feature (127)..(127): n is a, c, g, or t
  misc_feature (133)..(133): n is a, c, g, or t
  misc_feature (146)..(146): n is a, c, g, or t
  misc_feature (162)..(162): n is a, c, g, or t
  misc_feature (169)..(170): n is a, c, g, or t
  misc_feature (180)..(180): n is a, c, g, or t
  misc_feature (188)..(188): n is a, c, g, or t
  misc_feature (201)..(201): n is a, c, g, or t
  misc_feature (289)..(289): n is a, c, g, or t
taagatggtacagtagtagggaagcggccccagacaaggaagctggcaaccagccncagagcagcgatgggancacctcgtcttgaatctgaccttgtccaagaaggctggacgagagaccttctgncccctnccagagggggaancctggcactggcccancagcctnntctctgagcnccatgtcnccagataaacagnccagactgagaaggctctccagaggcctctgtggcctccacttcgggaaagccctctgcccaacccacaggcttcacattcccaccancttcgcaccgtgcccaggtacactttcaagacactgtaaccacaagatggtatttattgagctggcgccgggacttgaggcggggcctgccattcagtgatcagctcacagcaagaacgctcctatcgtgatcgcacgggtagggttacagtccacccctttatatcctgcgccagcgctatcatttggcttcagatctataatcac

SEQ ID NO: 689030 - DNA, 420 bp, Homo sapiens
  misc_feature (56)..(56): n is a, c, g, or t
  misc_feature (73)..(73): n is a, c, g, or t
  misc_feature (213)..(213): n is a, c, g, or t
taagatggtacagtagtagggaagcggccccagacaaggaagctggcaaccagccncagagcagcgatgggancacctcgtcttgaatctgaccttgtccaagaaggctggacgagagacttcgcgcgcctcttctctgagctccagaggcctctgtggcctccacttcgggaaagccctctgcccaacccacaggcttcacattcccaccancttcgcaccgtgcccaggtacactttcaagacactgtaaccacaagatggtatttattgagctggcgccgggacttgaggcggggcctgccattcagtgatcagctcacagcaagaacgctcctatcgtgatcgcacgggtagggttacagtccacccctttatatcctgcgccagcgctatcatttggcttcagatctataatcac

SEQ ID NO: 689031 - DNA, 101 bp, Homo sapiens
acggacggacgagtcggggggaaaatccgaagggctcccttcggcaacccaaagaggtacgggtgttggatttgggtagtgaagtttacgtatggcagggg

SEQ ID NO: 689032 - DNA, 465 bp, Homo sapiens
  misc_feature (412)..(412): n is a, c, g, or t
ttttatggacagaagttcaaaccagccacattccctaagccaaagactaatccagagcaaggccctaagtctctgcaattctatgaaggccgagagaggtgaggaagttttagaagaaaagttgaaagctagcagagggtggttcatgagtttatggaaagacgttgtctccatagcggaaaagcacaaggtgaagcagcaaatgttgatggagaagctgcaacaagttatccaaaagatctaacttagataacggctgaaagtagctacactacacaacagattttcagtacgtacagccttccattgggaattaatattccatatccagattttcacttgcttaggggagaagttaaatgcctagcttccaaagggcaggctggattattctttgtttaggaggattgcnggcttggttgacatggaagttgccagcccattgcttcacttaaccctttcttg

SEQ ID NO: 689033 - DNA, 350 bp, Homo sapiens
acatgccaacctatctccattaaaatacattagccaggcatgttggcacgtgcctgtaatcccaggcactcaggaggttgaggcaggagaatcgctctgggagacggaggttgcagtaagctgagatcatgccactgcacctccagcctgggtgacagagcgagactgtttctcagaaaaaaaaaaaaaaagaaggtgaggggtgagtctgtgagtgctgatgtgaaggccgctgaagaatattgggaaatggaacataagcggatggtgcaggaacattatgggccagagaaaatctccaatagggttgaaactcccctattctgaaactggatgcctaagaacacttc

SEQ ID NO: 689034 - DNA, 108 bp, Homo sapiens
ctggatcctgacttccgccactgttctatggtctcaccatgataaatcaaaatctggaagaatgtgtccatgagaagaatacgatctgcaaggaacccaatccccgag

SEQ ID NO: 689035 - DNA, 107 bp, Homo sapiens
ctagaggatcccgcggatggacgagagaacgcagaatatgtggagcaatgctattagagaaatatttgctacctataacactgtgtactcttgtaagtccacaacaa

SEQ ID NO: 689036 - DNA, 687 bp, Homo sapiens
  misc_feature (35)..(35): n is a, c, g, or t
  misc_feature (275)..(275): n is a, c, g, or t
aataggagttacaccgtcgtccttcgttaagaacntagttccgaaggtctgttcctgttacgatatgcatacgtcgcatccgaaaagtgttgctagaaattctcataagccctcctagaagtctctggcatgtggtccctataaaccaaacggtttggcaataattttttcaccgtttaggaagcctcacacgcatttcaggccgaattatgtatcctggcaagatgaagcatttctctcataccgctactgtacagggcacaagctggttcctnacatttggagttaaggatgttagaggctgctcacggtggccccctcctgctatcccagcacaatgtgagcctttggaggttggatgctctctggtcacgtgaggtataacagtatggccgacatggcgatacagtgtctccactcaacatacaagagttagctgcgccgttttgggcgctcatgggacactagctgctgtggagtctgaggctgtagaaggtcctcgtccctcgatccacaggttcactttgctgatatattgacatttgcattccacctcgggttatagagcatgcctctctcctctccataataaagcacaaacgtgtgtagttttgtcttgaaccagaccaagcgttgatttttggggccgattatttcaagcttagtcaatacaatcggatgttgatc

SEQ ID NO: 689037 - DNA, 157 bp, Homo sapiens
gtacccggctgcaggagaagaatgcacccacagctccaagtagcaggaggaacaagacaacctaggcagcatgactgaggagcgctgtgtgatcgatgctggattcaaaaagcaaggatgtcagcgttgcgatgccgaagagtggaaagagaggatg

SEQ ID NO: 689038 - DNA, 221 bp, Homo sapiens
caaaaagttggctaggatgaattcttctgtccattgtgaacaaaaagcaaggggacgcaaagttagatattctatctacagtgaaaatctagaatgtgttagtaaggtgtaggtttccacgggcagtgccgtgggcaacaaaaacccagagtgattatgcaggagccagccatagttgtacatgggcaataagccatacacaaatgaatattttcttcctg

SEQ ID NO: 689039 - DNA, 84 bp, Homo sapiens
acatctgtgtacttctgtgccagcaatttaggaggacagacttatggctacaccttcggttcggggaccaggttaaccgttgta

SEQ ID NO: 689040 - DNA, 177 bp, Homo sapiens
cctccccctttggggtcttttgtggggtgggggggggggggggggagcgctttgggggatttcccttatgttaggtggcgggtttgggggggccgcgcccccgcggggcccgtgtttacatgtgtttctcccctgccccttgggggcgtggcccctaaaatttagggttttattata

SEQ ID NO: 689041 - DNA, 802 bp, Homo sapiens
  misc_feature (8)..(8): n is a, c, g, or t
  misc_feature (70)..(70): n is a, c, g, or t
  misc_feature (72)..(72): n is a, c, g, or t
  misc_feature (76)..(76): n is a, c, g, or t
  misc_feature (106)..(106): n is a, c, g, or t
  misc_feature (117)..(118): n is a, c, g, or t
  misc_feature (121)..(121): n is a, c, g, or t
  misc_feature (128)..(128): n is a, c, g, or t
  misc_feature (132)..(133): n is a, c, g, or t
  misc_feature (140)..(143): n is a, c, g, or t
  misc_feature (162)..(163): n is a, c, g, or t
  misc_feature (174)..(175): n is a, c, g, or t
  misc_feature (178)..(178): n is a, c, g, or t
  misc_feature (182)..(182): n is a, c, g, or t
  misc_feature (187)..(187): n is a, c, g, or t
  misc_feature (201)..(201): n is a, c, g, or t
  misc_feature (209)..(209): n is a, c, g, or t
  misc_feature (211)..(211): n is a, c, g, or t
  misc_feature (217)..(217): n is a, c, g, or t
  misc_feature (220)..(221): n is a, c, g, or t
  misc_feature (232)..(233): n is a, c, g, or t
  misc_feature (240)..(240): n is a, c, g, or t
  misc_feature (269)..(269): n is a, c, g, or t
  misc_feature (273)..(273): n is a, c, g, or t
  misc_feature (275)..(275): n is a, c, g, or t
  misc_feature (280)..(281): n is a, c, g, or t
  misc_feature (283)..(283): n is a, c, g, or t
  misc_feature (296)..(296): n is a, c, g, or t
  misc_feature (303)..(303): n is a, c, g, or t
  misc_feature (330)..(331): n is a, c, g, or t
  misc_feature (781)..(781): n is a, c, g, or t
tcccacanggaagggatttaagggctgcccccatgaatttcttcaggccacgacacctacttcctcctcntntatntggattttgttttaaagtttcctcctcgtntctggtggggnntgncttactntttnnttttttnnnnggtaggggcatgctcgatnntgttttagggnnttnttgnttgtnttggtgtgttcttnattaaatncngatttnttnncctgcttttgnntcttggngggggctctctgtgggtcctcctcggggnttgntnggggnngnttgggtctgcggntgctgtngggtagcggttcagcaaacatctgcgnngtggggatttcaaactgagacctttcctctgctgtcatctcccccttttttttggcatccttcataaacttcttccttttcttctttcctctttaggccaagtcaaattcctgcagagctttggcaattttctccttcttcctctcttctttggtctggaaccagctcctctcgggctcttggaccactgcctccttccccttctccaggagccgctttgctgtattgatctgggcttctgactgctgcatctctttttcctccgcctctagctgcagaactgcatacacatctttctccattttctcaatcttgtcccggaatttgaggatgacatcttgggggaagtatcctggccttcacaggggccttggcagcttttacaatctccttcagcatcttccgctcatcttctcccaccagagagactgagcgcccagccctgccagnacgtgctgttcgcccacccgg

SEQ ID NO: 689042 - DNA, 349 bp, Homo sapiens
agcctacattcagttacctaatgaatgggcagacagttgtgttattggcactattaagccatcctttttcttattaccgataaaaactactggtactatctgtaaattccagacattgtatgagaaagcactgtaaaactttttgttctgttagctgatatatgtagcctccagtcacattcctcatgcttacttgatctatcatgaccctttcacgtggaccccttagagttgtaagcccttaaaagggctaggaatttctttttgggggagcttggcatcttaagacatgagtctgacaatgctaccggccaaataaaaacatataacttctttaaaaaaaaaacaa

SEQ ID NO: 689043 - DNA, 1258 bp, Homo sapiens
gaatatgtctcaagatggcggccaaatgtgggatcgatgtttcaatattcggaagcgctttgatttacagcagctgcagagcagaactcgatgccaccgcaacggtactggcgaaccggcaggatgaaacgtgagcagtcccagacacgcggacttatcgaacagagccgggagcttcaagaagaacactccagaggcattgccgccagcaaggctagcgccagctgcctgcaagcagctcttccacaggcagcagcatcgcactgcactgagctcaacacagcaagccacaggcacacgcgtgcacagacaagccttcctcgcacatgctcctaccaacccagcatcgcactcgcacgctccccacgcatcccgctaccagcctcctggcatcctcgcgaccagcaccactccagcctcaaagctgccacgcgccttgcaccgactacccgccacaccagcagcaacccacgacacccttagcggcaaacctctgcgacacgacataccaacccacggaactctcgcctgcacgcgtgccacacactccaagcagcgtccccgactcccacagccaccttacacagacagaacacatcccgcccacatactgcacccagacccctcgcccgcaacccccaaggcccgcacaacacccactaagcctcctcggccgcacaccggccacccaccacccgctccccacaccctgaccccctcgccccgcacacccaccgcagcaccccccagcctcgcaccgccccccgccccgcactcactccacccgacccctccaccgcccgccacccgcacgacccggcgccactcaacaggcaccagaagcccctacccaccaccgcgccccctgagacgacaacacccgacacaaacaaatcacacggaccccgcccaccccacaaccacagcaccgcagcacaaaccacacgcccaacggcccgcccaaccaccggacacctcccccctccaccggaccctgacaagggacaaaccagaagccaagcgatgcctaaaacccacagcgcaccaccccccggcacacccctcacccacaacaactccccaaacgagaacacaaatccaaggccaaacgggccaggcacaaagcgacgcccacaaacatacaacacgatgcgcccggacagcaacaacagcacagcgacacacccgcccccaccggaacagcccgatcacccactacgcaacaaaacacaaacaccagaacacccccccccccaca

SEQ ID NO: 689044 - DNA, 196 bp, Homo sapiens
atcgcgcgttccgctcatcaaatgaaatacagctttcgcatctattcacagaggcgcgccctatgcttcttagcgtcgcttgtcaaactatggagctcatctattctctagctgaggtactctggcagtccgttcatgtcattgtggtaataccgtacatactgctgtttccccgtaccgtccactccatctaccg

SEQ ID NO: 689045 - DNA, 1277 bp, Homo sapiens
  misc_feature (1277)..(1277): n is a, c, g, or t
tgtgctggccggcagttagggtgctgggcgcctggatgtggcgagatgccagctgatgctgagctgagcgagcctgagccgagcctccctgccgtcgccatggtgccagaactgacctgatgggcactgtgctgaggacattcgatcgaccagattcctccgtgtcacaaatgcatgtacctgccccactgtggctgctgcctctgtctgatcagcaccttcctggaggactggcatccgtatgtggttccagtggagcgagcagcgcgactacatcgacaccacctggaactgcggctacctgctggcctcgtccttcgtcttcctcaacttgctgtggacagctgactggctgcagtcctggttgtccgagcaggaacttcgttgcagtcactgcctgcttctgggcatcttatggcaatcatagctctgcatgactgatttgcctacatgcatttccatgggacttgacagtctccgatgacggaacctggccctgggaggaggcctgtctgctgctcctagcagaatcccgttctgcagggaagagcatgtttgcgggcgtccccaccatgcgtgagcagctcccccaaacatgtacatgcagactcggaggcagggtcttgctggctctgatgttcatgaccctccttcacttctgactgccagcttctttgctattgtccagaacatcgttgcgcacagctctgcatgatttagtggccattggcttttaccacccaagctggctggtttgactcttggtgctgtggctctttggccatcaccgtatatctcaacgccttcctggaccatccagctctcaaggccatgcttgactcctgacactagacttcttacagcacatgtcgggaatgggggcatgtcactggtgatggcctgtggcatggcgtgcaccagggcgtcacacagactagtgtcgtgtacgggctccgcgtctcctagacgtcggttgtggttaaagcagcaagaggcacgatactaggactcgtttggagtggaccgacatacccgaccagcgccaggtcacatcggctcccaacactcagccatccgttagcatcaggcacagattttcgacagacaatagtcagaaccaccagacacgcagactagcagctatcagacgcatgctaggtcgcccgtagccaccgacacgccagcacctccagcgagcagtctagcgctagagcccaacttgtagtaccgtcgcacagacacaatcagtagctagatcacgttacagttctagtgan

SEQ ID NO: 689046 - DNA, 184 bp, Homo sapiens
cggccattccctggcctccctggaggatcaagggaaaaggaggcactgatccagaacagagggagcctaaatcacccagatctgtatccctagctgggccctgaaccagagacgggagaggctacaaaagaatgtcaaaggagaaacgcaagcaacagatgatagcatcaaaggttggtgcagt

SEQ ID NO: 689047 - DNA, 351 bp, Homo sapiens
  misc_feature (120)..(120): n is a, c, g, or t
  misc_feature (281)..(281): n is a, c, g, or t
  misc_feature (328)..(328): n is a, c, g, or t
  misc_feature (334)..(334): n is a, c, g, or t
ttcggagtgtagtgttccctagtgttccctacctgatacctaacctctgcttggtccagggaagtgtctttcacactgcagttaattttgccctgatggcctggagtctggtggggcctnatgtggctcccactccagagcactcaatgacccagggaactctggatcgtggcttctgaggaggcccttgggtctggctcctgtcctttctccaacaccagctctccctctacgggcgggtggtgtgtcgagccctgtctgggtattggataggcacactnacatccctgtgttccccacaccttttggctctgcaattccctccctnttcttnttcctttttcatccttc

SEQ ID NO: 689048 - DNA, 293 bp, Homo sapiens
  misc_feature (59)..(59): n is a, c, g, or t
  misc_feature (218)..(218): n is a, c, g, or t
atcacgcaatattgtgattcgttcaccatttgcctgtcgaaaggtcttgggacgccagnggtgtcattactcgtcggtaatcgtgattacattaaacgtgccattcgctggcggaaaatgacaggtggcgggatgcgcagtccggcattctggctgccgccgggatatatgccctgaaaaataacgttgcgcgcttgcaggaagaccacgacaacgcntgcctggatggcggacagcctgcgtgaaacaggccgcggaatgtgatgcgtcaggacaccaatatgcttgtttgt

SEQ ID NO: 689049 - DNA, 257 bp, Homo sapiens
  misc_feature (146)..(146): n is a, c, g, or t
tcggataatctagaggatcccgaacgggtgatgcggttgaagaagccgggttgcgccagtgctgtcatagtccttctcgtggaacactggcggcgcggtcacccagtgctgagctgtggtgagcactgtccatgtccacgtctgcntgcccaaggccagcacggtgggtaccatgttctgcttgcgcatggagtgcgccgagtcgtgcagactgtcgttgcccgtgacgccgtccgtgcagaacacgaagggacagc

SEQ ID NO: 689050 - DNA, 130 bp, Homo sapiens
tgtttcccatttattactttggcattcactccaaaactgggtgaattattttacttcccactatggtcagcacccctccttgcattgaccatcatccaaattagagaggagcctgatttgaattttctca

SEQ ID NO: 689051 - DNA, 158 bp, Homo sapiens
ccccaacctttttcccaaaaagaaggttttttaggggcgaacctgttgaaaaagccaaatcccccccaaaccccttggaaagcaattttggggtttgccctggcttggcaattttaaattttccccaaaagaaaaaaagtaaaagggggccgagggga

SEQ ID NO: 689052 - DNA, 429 bp, Homo sapiens
agggccggtttttcccccagccccaggttcccggccccgccctggaaacaaacgggttttttcatggagggccaccccccccttaaaccgggcgaggagatttttggcccccctggccttgggccccacccccaaaaccacccgggcctgggtttccccctcgacctgggcttccagggccccctgtgcgaactttcctgcccccccccccaccggatgcgcttaggccccgctcccccccccccccccagccccgggggttagcgttcctaggcggttttgggggtcccccttcccctccccccccccccccaaaaggggttttttgggcccgggcttgggggatggggagggccccccctgcccgtgtttttcctaacctttttttttttttgggtgcctttcccccccttaacccccccctgggga

SEQ ID NO: 689053 - DNA, 1170 bp, Homo sapiens
gacaacaaatgaggcaccccatgagcgcatacttcctgcagtttgaccatctggactcagcagtggctggggatgccactcgcctgcctctcgccccgttgcctctttgcgcctgcggagcacgctctcaactccatctacgctgcctcgcgctgcgcacgaccccactcacctgcgcaccggcgagccgccgccctgcgcacctcgggcccctgcctgctatcgacagcgcctgtctctccccccctgcgcgcgctgccctcgtcgcccctgctgccctctacgtctgcctgctcttggccctccccacctgccttctccccacactggcaccctgtgtcctaccgctccctcgccgcgttgcccctcgctcgctgcccccgtccacgtgcccctgcactcccgtactgcgcgctctactaaaccacccaaccaacgcctccgcaaccgccacacgaaagctgacacaccccagtgccaaaaccgacccggccccaaaccaacgcgacacccaccctgaccccacacaccgccccgccaatacaccgccgaacacccacgaacagaacaaccgcaccacaacagcacccgacaccacgatcacatgccgaacagcccgtacgcagccactacacacacaacccaaatacaccctgcgcgacaccgcctacacgaagagcccctaacacccacagagcagaaagcaagccataaccacaacgccccggacaaaacccccgtgacagaccaacacccctccaactgccccactacgatcggaccttgcccccacacctgtcaacaccaccccccagcgcaccaccagtgaccaccaaacacaaagagcaacatcccctcctgcacgactcataacgaagcgcccaaaacaaaaaatgcaaaggctcccccacccataacacaccgcacacccaccgccaagttaccacctctctacccccttcacctaatttcgctccaccatacctaaaataacacccccctacatatttactaccactcctcatactcatccacctaattccacatcactccatccaaactacactcccacccctccgcacccccatccaacaaattaatctaaaaaaaatataaaaatccaataacccataacacaccccatcacacacctatcctccccacccacct

SEQ ID NO: 689054 - DNA, 926 bp, Homo sapiens
caccactccctaatctcaagtaccgagggacacaaacacgtgcggaagcccacagggacctctgcctaggaaagccaggtattgtccaaggtttctccccatgtgatagtctgaaatatggcctcgtgggaagggaaagacctgaccgtcccccagcgtgacacccgtaaagggtctgtgctgagaaggattagtgaaagaagaaggaacgcctctttgccgttgaaacaagaggaaggcatctgtctcctgcccgtccctgggcaatggtgtaaaacccgattgtatgttccatctactgagttaggggaaaaccgccttagggctggaggtgggacatgggggcagcaatactgctctgtaaggcattgagatgtttatgtgtatgcatatctaaagcacagcacttagttctttaccttgtctatgacacagagacctttgttcacgtgtttatctgctgaccttctctccactattatcttatgaccctgacacatccccctctccgagaaacacccaagaatgatgaataaatactaagggaactcagaggccggcgggatcctcgtctgctgaatgccggccccctgggctccctttttttctttctcaaaaaaaaaaaaaaaaaaaaaaaaaaaaaataaacgacacaaagaagagaaagaaacaaaaacaacacaaaaaaaagagaaaacaaagggaccagaggacagagcggagaacagggaggacaaagaatgaaaagaaaaaaagaggagaagacagccggcacgagaaggcgagggaaagagggagcgacacgagcaagggaggagcgaggaggagagaggaaacgacaagaaacgagagagagaaacagcaagaaaaagacggaaaaaacaggaagaagaaacaaaacgcgagacaaacagaaataacagaga

SEQ ID NO: 689055 - DNA, 215 bp, Homo sapiens
ggatatagtaccgcaagggaaagatgaaaaattataaccaagcataatatagcaaggactaacccctataccttctgcataatggattaactagagataactttgcaaggagaaccaaagctaaggaccccgggaaccagacggagctacctaggacagctaaagggcacacccgttattggcaaatagtgggaggtttataggtggggggccaa

SEQ ID NO: 689056 - DNA, 442 bp, Homo sapiens
gatccccatccttacccttactgtcaatcttcctacctttagttcatggtaggcttgacaactattagatctctaggcatcgtccttagttatgtaacatatctatattgatccaggctaaggtggaaatatgagttgttaagacagccccatgttgcttctgggttttttcttttttctttttttcttttttttggagatgagtttcactcttgttgcccagtctgcattgcaacggcatgatctcggctcactgcaacccctgcctcccgggttcaagtgattctcagggctcagactctcaagtagctgagattacaggtgcatgccaccacgcctggctaatttttgtgtttttagtagagacagggtttagtcatattggtcagtctggtctcgaactcctgaccccaggtgacgtgcctgtctcagcctcccaaag

SEQ ID NO: 689057 - DNA, 216 bp, Homo sapiens
  misc_feature (1)..(2): n is a, c, g, or t
  misc_feature (25)..(25): n is a, c, g, or t
  misc_feature (33)..(33): n is a, c, g, or t
  misc_feature (35)..(35): n is a, c, g, or t
  misc_feature (51)..(51): n is a, c, g, or t
  misc_feature (54)..(55): n is a, c, g, or t
  misc_feature (83)..(83): n is a, c, g, or t
  misc_feature (102)..(102): n is a, c, g, or t
  misc_feature (106)..(106): n is a, c, g, or t
  misc_feature (108)..(108): n is a, c, g, or t
  misc_feature (120)..(120): n is a, c, g, or t
  misc_feature (136)..(136): n is a, c, g, or t
  misc_feature (138)..(138): n is a, c, g, or t
  misc_feature (179)..(179): n is a, c, g, or t
  misc_feature (193)..(193): n is a, c, g, or t
  misc_feature (196)..(196): n is a, c, g, or t
  misc_feature (201)..(203): n is a, c, g, or t
  misc_feature (208)..(208): n is a, c, g, or t
nnaaaaaaaaaaaaaaggcaacatnaaagtttnanaaaatcatgctttgtnagnnaaagaattacagctttgcaatataaccnattgtttcgcataattctnaatncnatagatatgaanaatcagcctgtgtttncnatgaacttatttgtattttcccaatcattttctctagtgcnatgtttgctggganaanaaaannnattcnaatctttc

SEQ ID NO: 689058 - DNA, 210 bp, Homo sapiens
ctcaggctggagtgcagtattcacaggcacgaccgcagctagcactcctataacctccaacttctgggctcaaaccatcttcctgcctcagattcctgagtagctcgagatgggactacaggcatgtgccaccacgccctgctaattttgtatttttagtagagacggggtttcaccatgttggtcaggctggtctgggtaccgagctcg

SEQ ID NO: 689059 - DNA, 116 bp, Homo sapiens
cgagagaatggagcatctagtagagaaagtccattactttagacttagactgactccaagcagtaagatcagatttcttcacccaagtacttatctgcaatcacgcaggcacatgc

SEQ ID NO: 689060 - DNA, 494 bp, Homo sapiens
caactgcgccgacactggtgatactaacctatgtggaaaggggctaaaaaacactgtgtagttatttgacaatagaaaggagcagagtgctgattaaattcaaagctcacgcttttaattatcacttagagttggtttgtatagtaaggggaaaaaagaaaaaaaggaattctctagcttttggaacagcaaactgggcaaactgcaattcatccaagcacactggtgatactaacctatgtggaaaggggttgtaaaacactgtgtcgttatttgacaatagaaaggcatgaagcactgtcacaggctaccacctggatgagccttgaaaacatgacgctcagggaagaagtcagatgaagaaaacacacacgatatgataccatgtggatgagctgaccagaacaggtgcatccacagagtgatcacagatgccttggttgccagtttttgtcaacagagggatgcagagtgacttgcttaaggggcacagg

SEQ ID NO: 689061 - DNA, 126 bp, Homo sapiens
gttctaattgtggctgaggactttgattgcgcattgttgtttatctaatagtcattccaactatgagatgcattgttacaggaagtcccttgccatcctaaaagccaccccagccccaccagatcg

SEQ ID NO: 689062 - DNA, 511 bp, Homo sapiens
atggggtttcaccatgttggccaggctggtcttgagctatttttctaaattgatccgcccgcctcggcctcccaaaatgctgggcttacaggcatgagccaccatgcctggtcaacaccaccctttaggtacttgctgaatacacaggattgatggggttgagaaaggatcaaggttgacttccaggttgctagatcggtggtcccagatgttgagagagagaatgcaggacgaagagccgttgtagggggagcagggggagtgtcttcgcatgatgggtagggggtacccgtgagtcacatacaggtggatgtgccctgaggggagagggacgcgagtctgcagattaggcaagaggctacagttgcatctattgtgtcaataacctacaggcggactagggcagtcatgtgcctaaagctcgggcaacatttttgccgagagagggggatcttctattgtccagcatgctatgaagctctatctagacgccatcttatacctggaggtt

SEQ ID NO: 689063 - DNA, 108 bp, Homo sapiens
acgtatgtgcagtaggatggatctgtaagcgacacacacgtgtaacactaaatcggatgcggggcgtggaggcaccgctgtaataaaggaagtggcagtgtgctggga

SEQ ID NO: 689064 - DNA, 84 bp, Homo sapiens
  misc_feature (21)..(21): n is a, c, g, or t
tttccggccgggggccatttnccgcccccttgccctttgcagagcttgttttgcccccgcagcaataaaggtcctttgccccga

SEQ ID NO: 689065 - DNA, 81 bp, Homo sapiens
  misc_feature (48)..(48): n is a, c, g, or t
gttgacgacacggccctatattactgtgcgaaagacccccacggttantacgtgggagccttcgactgctggggcccggga

SEQ ID NO: 689066 - DNA, 237 bp, Homo sapiens
ttcagggggatgggagttatccctgagcccttccattcccctctaagagaggcagcaacggagagtggggaagtggagcggcagttcccttgtggggcttagcccaggtgcttcgtaactgcaatcggaagtgcagtgacgctggtcagacgccaagtgagaatggaaacctacatctattgcatatgcccattgcctacatggagatggtgacatcataccattcacatagcttct

SEQ ID NO: 689067 - DNA, 609 bp, Homo sapiens
  misc_feature (211)..(211): n is a, c, g, or t
gcatggggtctggacgcgacggcggcggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaatatcacactcctaaagaccgcaagtgctatttgctggtanaaagtcccccagccccgttggagcacaaagatcatcgatccgagtgcagactcgacgcctggtacgtacagctcgcctcagggataggcctttgaccaaagccatcaccgacctcatcagtgagctgtccctgctggaggatcgctttcgggtggtcataataagacaagcaggaatggaacttgacgtaggggccacgagggaggctctgttcgagcctgtgagccccgttcctatctgtgcctgaccctccgctccagtgtacctacatgcgaggagagctggtacgcgtccacaggccatggcccagccgttgtggtcatccgcctcaccctgacaccgacgtgttctgtacatagatgaggttttatattcctaatgaaatgtataggcggaag

SEQ ID NO: 689068 - DNA, 1354 bp, Homo sapiens
  misc_feature (435)..(435): n is a, c, g, or t
  misc_feature (864)..(864): n is a, c, g, or t
gcctggagcgggtggcggtgtcctggatgtgacgtcttgtgacatcgcggtggtctgcaacaactcaccagcgcggatcacacatggagtgtttagcaagttaactgtcagtaacgtgtgaagtcataagatgcaggactggatgactgggcctacccatcaaaaaggccataggagtcattcctgcgtagttggcacttatgtatagtggggacagggtctgaacagtctgccgcatggtgaagcacttcaaggtgggatgagtgaggtctccgtcccaacgagaaaccccgagtcctcagagacgacctggagataccttaagcgcccgcgggttgcccttcaaaatgtacacgcttggggcgcagggcaagagtgggcaacgacaggcacaaagcccagggagacagcgaggagggccaatagctggtggcnggggccgggacgtagggggaggcaaggtgggtaaatcgcctttatggtggcacgggatatgttacgtccacggattgggtgctgtggatcttacacagagggtaggggggttcacaggcttcaagcttttaacagaggagaaacaggaagagtttctatgaagattgggtaggctttgggagtaaagagggggaatggggtcaaatttcctccggttatattgcctcacaattatttcctttgtgaaaacggtgttcccccaagtgtgcggcgggaaacttcttgcccctttgggaacatcacagccattaacaccaccgctcgtttcccccagaggagtaaaaggaacaccttgggtggtggcgccttaatcatccggccgcattgggaaggacaccggatgggagggcattcaaaggccccacggcnacagggtggtgtcaaacagcccggccaaagacggatgagggcggcgcttacctcagaccgtgtgtggcctcgcttggcgcccaattttcttaccgcctaaagagcatcttggggctgctggtgttagtgccgcattgaggaaagcttggttacgtcccccaaaacttagattttgagcctgtgctcgtgggcgatcagacccatagaagacgacatcctagccggacgatgcccgccaccacccattgaggccatacagaggaggggccgggcacaggtggggaaaccaccaaccagtaaaggcgttccgagcgggcatcccactgaggagttatcccattccacaaggggggaaaaggcgtctttgcgcacgtacccgattatggggcgcccacaccgtatgatagatatgggcacacatcgcgcaaacaccgaggggtatcccgccacgggccgggggaaaacatagggcggacaacaagcctagcag

SEQ ID NO: 689069 - DNA, 258 bp, Homo sapiens
gagtgaccgggattacaggtgtgagccatctagacccgggacttttttttacattttattgagacgacgtttcactcctgttgcccacgctggagtgcaatggcacgatctcagctcactgccacctcggtcctcccaggttcaagcgattatcctgcctcagcctctcgagtagctgggattacaggtgtgagccactgcaccctgcctcagtacctccattcttcccactacccaggtctcctcaggctcatgggc

SEQ ID NO: 689070 - DNA, 113 bp, Homo sapiens
tgcttgggattacaggtgttgagccaccacactaggcactgtgtcaagcagtaggggattggcggtggagtaagaatgtgtcctgtcctcaaggagttcatggtctagtggag

SEQ ID NO: 689071 - DNA, 274 bp, Homo sapiens
  misc_feature (211)..(211): n is a, c, g, or t
gcatggggtctggacgcgacggcggcggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaatatcacactcctaaagaccgcaagtgctatttgctggtanaaagtcccacccttgagcaagtcatcatccggtcagccacgcggctcaatccaggagcttaca

SEQ ID NO: 689072 - DNA, 190 bp, Homo sapiens
tgactgggagatcccatcaattcgctgacattgagattgtgttggcgctcagtgaagtgccattcgagctaaggacacagagacagatttgtgggatttgatgctttttctagcagtgcctgaactgtaggtctctgccagaagtagcgctcgcccatgtgcataagcctggatactacacatcgtctgc

SEQ ID NO: 689073 - DNA, 606 bp, Homo sapiens
ctgtggtaaatgatttaaaacactagtatagtgttgtgtagcttaatccttctgaagtctttttgtcatgtagctattaatctgtggctatgaaatgatcagaaatgctaagtgagatcaatatttgtttggaaaaaaaatcttgggaaacaacccaagggttttcgctgttgttgtttttctttttctatttttgtttacttagtcctttagctagtggatttaattttgttgtgcctgcttcattttgcaataacaatgcagtagaatttaaaacttggatgcttaagaggcctgcatatagataagaatttcaggcaaaactacatttattgttaataacagcttgttcataggctcctgtattttatggacctgtaataataacctaactaagttccctgaggatattgtcagtcggccagatgttaggcacagtattttcaaaggttcgctcatactgttctgatgtaagctgtgtaagcctaggacacggtctcaattagggggagctgtcttgtcctctcttagagtaaggtattctatcaacatatgcaaacaccccccagttcatccgcagtcggatgaataaggaaacccagttcg

SEQ ID NO: 689074 - DNA, 116 bp, Homo sapiens
  misc_feature (29)..(29): n is a, c, g, or t
  misc_feature (54)..(54): n is a, c, g, or t
  misc_feature (91)..(91): n is a, c, g, or t
gatccaattaacatgtggggttcttggtntgggtctggggagctgaaggatttnatggagctggtgctttggaggaatcttaagggaaagnagtagaagctcaggcctttaaagga

SEQ ID NO: 689075 - DNA, 691 bp, Homo sapiens
gacccttttatttctttctctcttgagaagggatctcactctgtcacccaggctgagtgcagtggcctgtcatggctcactgcagtctcaaatttctgggttcaagtgatcctcagcttcctgagtagctgggactacaggagtgcaccaccacacctagctatattaaaattattttggtagagaggagggcttgctctatggaccagtctgactcaaactcctgaactcaagtgatccttctgccttggctcccaaagtgctgggattacagatgtgagccattcgcccagccaccgttttatttttcagagaccacacagaggctgcttggatcacgtccaggaagtgcttcccccaattccagaacctataagttacttccacagtgcatcagtgagatcaatatacacgaatatcccggggcaagtgggaccgagcctttggaagaatacctcagaagtttatttggtgaatgagtagacgtggaaaatgtggtgtccagctgaggatgcacagtttggaaagcaggaggaatgttgactggttgatgaaaacttagttaagagcatcattcggtcaatgagatcaaggggaacaagagtgtttggcagaagcattatgagtcatggaaaaaaagttgatgaaacccatggaaaaagggaagagaattccaatcttctcttctaaa

SEQ ID NO: 689076 - DNA, 157 bp, Homo sapiens
tctagaggatccggaatgtgtggtgttatggtggacaggtttcctatggagttaggcagcatgcgcccagtttatgttgtccagttgtgggagatttaagatggtacaattggttaaagcggggatgaacttccaatcggtggggtgcttagcttcc

SEQ ID NO: 689077 - DNA, 1178 bp, Homo sapiens
atagtgaaatcctgaaccatcacccagggagtcatcttcatcaagtacccggaggaaggtggactgattcaccgaaagatatgcttgctcaaaatttcattgtatccgacatgcatggtcgatatgcgaccatcataggcatcgagatggtgattataaggcgagtatacgtactgcgttctaacaaagtctctatgatttacctagtgcacctgcttgtctccatagtgcgattgcactcgtgccacgcaagtatcctattagtccatcagactatcgacctatcctcaccgaaaaagaggaacagctatatctgcacaggaaactcgagatcgtaggatgcggactcgctattgggcctgggttaggactgatggtctagtttcaccactgtgatgtatcaggaaacgaatgaccaatgaaggaactgttttcgacggacatttgcagaaacccttcgtaccaaagaccattccagtctgcatgggacaattgccccgtcaaatgattgcttgaggcgtcgctcatggaggtaagctgggtccctggagcgaggccgagacccgccaaggaccgagaggtctccaacatcttccttgggggcgcttgagtggacgccatgcacgtgacgcgcgggggacagggccgcaaagggtcaagcccacacacgtgaattgggaacaatcctctggtacattattataagcctcttggaattaaacattgttccacttttatttcaacgtgcaccacactagcaggcacactagagacttagacgaattttcataaagcgcacttctatttgcctagaagttggggtaaagtcacaaagcacggccatattgcaacgtggcgcacctatgaggtcaataaacgtagatacattgtggacccaagagttttctttgtggccacaaaagtttgcgacgactctctgcccgtcgttttctcatatatgactcgagcccggactcaaatacgggaaaaaaggcccaggtttacccctggccttatggcgtgcggcacacaaccactcagcaacgaccaccgggccacccacaccaccagacaccacaactcgggagacacgacactgcatgtcatcagcaagcaagtgagcgcgcagacaccaccccatgatcacaacggagcgagcctcacaatcacacgctccg

SEQ ID NO: 689078 - DNA, 215 bp, Homo sapiens
gttggtgttgtcttgtccagcacgaacagcggcttccaggtgtcatgaaggcccccttcttgtacatgagtgccctcgtaggacctgtactcactctctgctgtcgggacatggctgtacaggttgctggtgctgcggtgggcagcctgaggggagccgaatgtggttgagccaatactctggtcgctgtccaggctgaggctcagggtggagcc

SEQ ID NO: 689079 - DNA, 262 bp, Homo sapiens
agtcgggtatcgatgcacgtctcacttataagtgaaaaggtggtaatttggttttctgtttctgtgttaatttacttaggattatggcctccagctccatccatgttgctgcaaaggggcatgatctcattcttttttatgactgccattgtaacattctaataggtgtgtagtggcatctcataatagctttattttgcatttccctgaaaaagaaaggcctactgttttccttttgtgtgtgtgtatgtggcatcgataa

SEQ ID NO: 689080 - DNA, 149 bp, Homo sapiens
  misc_feature (22)..(22): n is a, c, g, or t
agtgactctgaggatccccctnaatgctgttacaaaactgctgtgagacagagtctgagagatacagagattgcagagacagatgggagagacagatacagagagatacagagacagccagagaccaattgggagagagaccaattggg

SEQ ID NO: 689081 - DNA, 592 bp, Homo sapiens
  misc_feature (40)..(40): n is a, c, g, or t
  misc_feature (72)..(73): n is a, c, g, or t
  misc_feature (75)..(75): n is a, c, g, or t
  misc_feature (84)..(84): n is a, c, g, or t
  misc_feature (93)..(93): n is a, c, g, or t
  misc_feature (119)..(119): n is a, c, g, or t
  misc_feature (134)..(134): n is a, c, g, or t
  misc_feature (142)..(142): n is a, c, g, or t
  misc_feature (157)..(157): n is a, c, g, or t
  misc_feature (165)..(165): n is a, c, g, or t
  misc_feature (171)..(171): n is a, c, g, or t
  misc_feature (175)..(175): n is a, c, g, or t
  misc_feature (191)..(191): n is a, c, g, or t
  misc_feature (198)..(198): n is a, c, g, or t
  misc_feature (234)..(234): n is a, c, g, or t
  misc_feature (315)..(315): n is a, c, g, or t
  misc_feature (360)..(360): n is a, c, g, or t
  misc_feature (367)..(367): n is a, c, g, or t
  misc_feature (421)..(421): n is a, c, g, or t
  misc_feature (475)..(475): n is a, c, g, or t
  misc_feature (483)..(483): n is a, c, g, or t
  misc_feature (576)..(576): n is a, c, g, or t
cccaacgtaccagttaacaaagggacgtttgggatacatnaggtcaaacttgtggtccaggcgagcccaggnntnagcaatggntgtggtgtngctcagcatgcacacagctctttgtnccttggccaggtctncaccaggnaccacagtggggggntggtagtngaggcnaacnttgaagccagtggggnaccaatncacaaactggatggtacgcttgggcttgatggtggnaatggcagctttgacatctttgggaaccacgttaccacggtacaacaggcggcaagccatgtttttaccatggcgagggtnacatttcaccatctggttggctggctcaaagcaagcattggtganctctgcnacagaaagctgttcatggtaggctttctcagcagaaatgaaaggggcatatgtngccagagggaagtggatgcggggatagggcaccaggttggtctggaattctgtnaggtcaanattcagggctccatcaaatctcagggaagcagttatggaggacacaatttgacctattaacctattcaggttagtataggttggacgctcaanatcgaggtttctacga

SEQ ID NO: 689082 - DNA, 168 bp, Homo sapiens
gttgggtacagcccggttttaagcctctgttctagggaccacgttgagtgacagagtgggaaacacgatgcatcaattaggaaatgtggcagtgttgaagagggacccagcgtgtggacagtgcaggagggacagggtgctgaacacgcctgagagaattcttccagg

SEQ ID NO: 689083 - DNA, 118 bp, Homo sapiens
gaaatcgcggcataggctgggtttctatatgcataggcatgtgattggtgggtccattatgtgttgtcgtgcaggtcgcggggtactagaagtgtgacaccgtggcttggattcaggc

SEQ ID NO: 689084 - DNA, 305 bp, Homo sapiens
gtatgctaagatttcgcgtagcttggtttggtttcatccacctcatctgcctgctatgatggttaccattgatgagagtgaggagaaggcttactgtcccgtgggggccagctttggtctatcatgcagatgggggcttgtttttgtcatgtgagaagaacgcagcgccgtatcgtcataggggtgccttgggtcacctccgggcaccacaatctgcatcgggggctttccctagattttagtcgctataggccgttttgaatctcttatccgatcaagtctttgattcggtactattggctcct

SEQ ID NO: 689085 - DNA, 329 bp, Homo sapiens
cccgggaaaacccttattttttgggggcccggggggggaaaggggtgcggggattcccccaaaaacccccgggggggttttttttgggtttttttttttcccccccgggggggttttgggcccccccccccccaaattgggttccgcccccccaaggggggttttggggttccccggttacccgggccccccccccggggcccccaatcccccccccccttcccccctttggggtctggccttttacccccggtttttttgtttttggggggaaccaaattgttcccggcggccccttttttctttaaacttttttttggggtttttta

SEQ ID NO: 689086 - DNA, 142 bp, Homo sapiens
aatgggcctgcactcgtcctggcctacatcgtgttcggctggttgccgtcgctcctgactcggccgtggcctgacgtgccccacgacggcgggacttggcgacctcacggtgtgtgtgaggggactccatctacgacgtcga

SEQ ID NO: 689087 - DNA, 435 bp, Homo sapiens
  misc_feature (67)..(67): n is a, c, g, or t
  misc_feature (266)..(266): n is a, c, g, or t
  misc_feature (279)..(279): n is a, c, g, or t
  misc_feature (418)..(418): n is a, c, g, or t
  misc_feature (434)..(434): n is a, c, g, or t
gagttcgagaccagtcaggccaacatggtgaaacctcatctctactaaaaatacaaaaattacctgnggcgtggtggtgcacacctgtagtcccagctactcaggaggctgaggtatgagaatcgcttgaacctgggaggcagaggttgcagtgagcaaagatcatgccactgcaccccagcctgggtgacagagcaagactccattttgaaaaaaaaaaaaagtgacttaattataaaaaaagagactgagacttgaatataganggacaggataganataatctaattaggctgggcaaggtggcccacgcctgttaatcccagcacttgggggaggccaggcaggcagatcactgggaggctggtcttcaaactcctgactttcgggtgatccacccacctcagttttccttttnaaaaagaatttttttnt

SEQ ID NO: 689088 - DNA, 978 bp, Homo sapiens
  misc_feature (704)..(704): n is a, c, g, or t
  misc_feature (951)..(951): n is a, c, g, or t
cgggattcaacctggccatgtggacatgagacggccagcacaccattggtttttgctggaaacactggcgaattgattttcctggtgcctgggccccccgtatggccgcaacgtttggttcaagggcgccttgtgatgcctgtatccaagctgtgggaacgtgcgggattccaatggtgccgacaggcccttcatcggacatggaatccgacagtcaatgcagtgggctttcttcccctacggctacgccttcaccaccggctctgacgacgccaacgtgcagcctctttcgacctgcgggccgatcaggagctcctcatgtactcgccatgacaacatcatctgtggcaatcacctctggtgccttctcgcgcagcaggacggttgctgctcgctggctacgacggacgttcaactggcaacatcatgggatgccatgaagggcgaccgtgcaggaggtcctcgctggccacggacaacccgccgtgagctgcctcgggggtcacggacgatcggcaatggctgatggccacagggctctctgggacatcactgtccgtcaacgatcatggaagctaactggcccgcagcccccagctgggccaaggccaggaggggccgctgcccatgcaccacgactacaggccagggctgcggggctggcgcaatcgccagcccccttcccaccgggcacacaggggcanttgggtgcacgtgccctccgacaccaggtcctggttcctgaccgggggccgcaccagctgtggagataagaaggggatggaatgggggaagtaggaggagcaggaggccctcatccttctgcatgcactggtggttgaggcctcacccctcttggagggccggaggcaggaggtggaaccccagggctggcttttctaaaactgttttatttaattcttctacgttattataaatctagcaggggtntccaataagaggagccaagtcccactt

SEQ ID NO: 689089 - DNA, 166 bp, Homo sapiens
ccgacgatcccactcgatccgctgatccagcaaaaagcttatgactcactagaaggctcagatatcactagcatttttagcaataaaaacttttaaattaaggtatgtacattgctttttttttttttttttttttggaaaaaaattctcgctttgtcccccgggt

SEQ ID NO: 689090 - DNA, 456 bp, Homo sapiens
tcatggaaccccagtggagagctcattctcatgttcagaggaagatactcttacagccaaagaacagatttgtaaaagaaggcagaggagtcctttttggaggtagcagagcctagtggctgagaacatgacatctggaccaagactgctcagaatcctgattttatttggtgtgttattatgtccagttaacaaacacaagcaaaatctgacttctcagacagctatgggtggtcatgggagcttcccatcccatgtggaagacaatgcctggagcagagaaggcatcttgctctttgctttctccttatctcttttcttcctgcttgatcatatgtcatgcttggagatgcagcagtcatcttaccatcagtaagaagaaagctgcatgttaagaattgtggagctgtaagatggaagaagcttgaatcctagggccttccttgatttgctgca

SEQ ID NO: 689091 - DNA, 132 bp, Homo sapiens
tgaattaaaagattgcttatccaagtataaacaatattaagaaaaagaaaagcagtaactattaccgatggaaaaatatgagactagtgtggaggatagcaatgctttccggaccagggaccccaatagtag

SEQ ID NO: 689092 - DNA, 469 bp, Homo sapiens
gatggtgagaaggacgtgctcttggtactggtgagaaggaccgtgtctggagtggtgagaaggactgtgctctgatagatggtgagaacgattgagttcggactgtgtgagaaagaccgtctttggagtggtgaggacatgtgttttcagagaaatctggcaagagggatagaaaagaggtcacaggatatatgactatgattataaagagaaagtgaagacacggcagagagaaatacctgatgaacataggtcccaaagaggcctgagaagccaagaataaagaagttatttggagcagggcatttcctaacatatctgagctggaagcaaaagtgaacaaggggagtgaaaaatatggagatttttcaggtagagaacgggcaagcagaggcaagttatgtcagagattttacttactttgtaaagtgtgagccaactttgagttaattccaaggcctgggaatca

SEQ ID NO: 689093 - DNA, 131 bp, Homo sapiens
gatgcatgtgcctgggtgcatcatgtgtactgagatgcaagaatttctggacttcatagcccaggaagtgaaggtgtctcgaagaagctctgtctcattgccaatgcaatcgattatcaggcagattccta

SEQ ID NO: 689094 - DNA, 460 bp, Homo sapiens
  misc_feature (306)..(306): n is a, c, g, or t
  misc_feature (379)..(379): n is a, c, g, or t
  misc_feature (392)..(392): n is a, c, g, or t
  misc_feature (420)..(420): n is a, c, g, or t
  misc_feature (446)..(446): n is a, c, g, or t
  misc_feature (458)..(458): n is a, c, g, or t
tatttatttatttatttatttatttatttattttgagacactctcactctgtctcccaggctggagtccaatggcgcaatcttggctcactgcagcctccgcctcccgggtttaagcgattctcatgcctcagcctcctgtgtagctgggattacagacgtgcgccaccatgcccagctgatttttgtatttttactagagacagggtttcaccatgtcagccaggctgatctcgaacttctggcctcatgtgatccatccaccttggcctcccaaagtgctgcgattataggtgtgagccaccgnacccagcctggaatttttatttattaggccactctttttttagtggacataagggaactggaatgtaggcttnttcacctcgtttncagtaaatggggctcaaatgtttaactnaggaagattcctcccacaatattatncaatttcagganca

SEQ ID NO: 689095 - DNA, 390 bp, Homo sapiens
cacatagtcagtcctatgcaggtctcagattccattcgcagagcgcggtcagccgctcatcgcatacatgcatgtgcacgcgccctcatggtcagctgtgagtgctcatgctccatagcactgggtaatgttgtgagagatgacatagaccattgctattcagggttaggctgacggctctagcgtctaataaggaacttcctggaacgaccaagacaaggtaagcaaaggtccaaagtaggttaagctctacatatgagagtcacaaacacataatggctcatttctctgatatgtaataaggatgtttatcaggcagtgcacatgtgtgcatgtgtgtgtgtgcatgcatgcatgtgtgcgtgtgtgtgtgcatgcgtgtaaatgtgt

SEQ ID NO: 689096 - DNA, 429 bp, Homo sapiens
ggcccatcccctttatgacccgggccgcaagtggatttatataggcttttccgcttttaagatttaaaaataggcctcttagcgcccacttcttgttacccaccaagagccaccacacttaccacccctttatcccccattactaatttatttatcgaaacccatccagcctacatcattccaacccaatagccctggcccgtacacgcctaacccgctacaccatttctcgccaggcccacactactccatagcacctaattggaagccgccaccctagccaatatccaacccattaaccttccctctacacttatcatcttccagaattctaattctactgactatcctagaaatccgctgtccgccttaatcccagcctacgttttcacacttttagtaagcctctacctgcccgaccaacacata

SEQ ID NO: 689097 - DNA, 151 bp, Homo sapiens
gattccggagcttatctatacacccgtatcccacgctgatgttaccacacagcctttcagcatgacgaaagtcattgggtcacttcaccatagtgggacaaagccacccagagggttgatgctcttgtccagataggtcatagtcacgtgg

SEQ ID NO: 689098 - DNA, 542 bp, Homo sapiens
  misc_feature (1)..(1): n is a, c, g, or t
  misc_feature (12)..(12): n is a, c, g, or t
  misc_feature (54)..(54): n is a, c, g, or t
  misc_feature (96)..(96): n is a, c, g, or t
  misc_feature (538)..(538): n is a, c, g, or t
naacccccccangtatcccaggaagaaaccaactgcctttgaattttaaccagnccccaaaagccagaggtacctgcccctgtccctcagttgaanacctgggacctgtggaccttttgaagttaaatgcctgaaaatgaagttaaagacctttggggaggacctgttggggaaggccataaattgggttttgaaaatatgagggaccataaagatttggggagaggcccaacagtggaatgatatgggtttggctgtttccccccaccccaaatcctcatcctcgaattcccacatgttgtgggagggactgggtggtgggagttaattgaatcatgggagtaggtctttcccattctgttcttgtgatagtgaataagtctcatgagatctgatgggttttaaaaaatgggagtttccctgaacaagctctcttctcttgtctgccaacatgtgagatgtgcctttcaccttctgccatgattgtgaggcctccccagccatgtggaactgtaagtccattaaacctctttctagnaaac

SEQ ID NO: 689099 - DNA, 952 bp, Homo sapiens
  misc_feature (689)..(689): n is a, c, g, or t
tgcccctcatttacataaatattatactaccatgtatcatctgacttctaggaatactaggtatatcgctcatagctcatatcgtccctactatgcctagaaggaataggtagctatcgctgtggcattgatagctactctcataaccctcaaaccggaatccctcgtagccaatattgtgcctatagcgatactagtctttgccgcctgcgaagtcgcggtggggctagacgtactagtctcaatctgccaatcacatatggcctaaactacgtaaataaactaaacctaatcaatggtgaaactaagccgtcccaacaattatattactacctctgacatgatttgcacaaataagcgcataattggaatcaccgaggaagcacccaacaggcctaattatgagcatcatccctctactattggccaacgcaagatcagcatagtatcctatgtaggttgtacctcaacccttattctgcagagcacacttaaaaatcccctctaataataaggtagctggattctaccccctgcagaatcatggcaagacacacggcagcttatccagtgacccacgtatgacggaaaaaaactctactcttctataactaagtttcctgtgaaatcctcttggttgttacattcacaggcaaaagaactaggcggtgtactctgtgtcgtcgganacaaacgtatccgacatgggattaataagccgaagtaggagcaggccgacgctggagcaggcaatcccgtgtgattggacctgtgtaggtctctacattcatgggatattgtatacacctgggtcttgattatattcggcgaataaactgggctatgtgtgttccaagagtagaatgagatgacacgtgcccgggattatgagaaagggtgatgcccagctccgtaacgcccccacccccttctcttggatcgtggacagaag

SEQ ID NO: 689100 - DNA, 201 bp, Homo sapiens
  misc_feature (34)..(34): n is a, c, g, or t
agcaggtccaggtggagctgctgttcctaaagcnaagcttgcaactcacggatctcctcttcatgaacagcaggtccaggtgggagaatggacatgtctaaagcaagacctcactgccgcgctcaggatatccgggctcagtatgagaccatcgcggctaagaacatttctaaagctgaggagtggtacaagtcgaaggtg

SEQ ID NO: 689101 - DNA, 373 bp, Homo sapiens
gtacagagtgaatgtatcaacctgatgggcgttgtcaaaggctgcaaggcgttcctgccgctgctggaaaagagccagggccgcatctatcaacatcgcgtcaatggcagcgctgatgcagggccccgccatgagtaactacaacgtggccaaggcgggcgtggtggcgttgtccgagagcctgttggtggagctcaagcaacaggaagtgggcgtgcatgtggtgtgcccgtcgtttttccagaccaacctgctcgactcgttccgtgggccaaccccagccatgaaggctcaagtgggcaagttgcttgagagttcgcccatctcggcggcggatattgccgactacatttaccagcgcgtggccgaaggc

SEQ ID NO: 689102 - DNA, 177 bp, Homo sapiens
ttttgcgtacttcgtcaacgatacgacgttcttcacgcacgctaccttcgctatccggcagtaacggcagcatgttgaacgccagctgacgcccgaagaaatcttcttcgtcaatcggaatgccgttgagcaatttcgcactctgccccgctaacgcatcgaccgcttttttgccct

SEQ ID NO: 689103 - DNA, 172 bp, Homo sapiens
aactttatttttaaagaataaatcaagtaagacacagctttcgtttactaaacatggcataaccaaactggaatataaactggactaaattggtgaattacaccatgaaataccaagggaatgccattttaccttatgtaaaatggattggtaagctaatagccaatttaac

SEQ ID NO: 689104 - DNA, 123 bp, Homo sapiens
aaaatgaacaaataactgtgtatatctgcacagtgataacttagattgtgtaggttgagtctgaaaagcaaagggatcttggatgatggaacgtctaaatcagatgatgtggtgcgcggtacg

SEQ ID NO: 689105 - DNA, 273 bp, Homo sapiens
gtaccgggtgatactactcacgctgaaactccagcaccacgatcgctactactatctcgcacctgaaacaagctaacatgactaacaccctcatgttccatccaccctcctctccctaggagggctgcaccccgcgtaaccggacttttggcccaaagtgggccattatcgaagaattcacaaaaaacaatagcctcatcagtccccaccatcatagtccaccggtcaccgctccttaacctctacttctacctacgcctaatctactccacc

SEQ ID NO: 689106 - DNA, 663 bp, Homo sapiens
aagagaaatgaagctaagaaaaatttaaaaaaaaaaaaaaaaaaaaaaaaaaaaaaaaaaaaaaaaaaaaaaaaaaaaaaaaaaaaaaaaaattaaaaaattaaaaaaaaaaaaaaaaaaaaaaaaaaaccttttggcccccttggcccaagtcatttttaaattggacaaggtttttccttgcgccccaatttgggcctaattggccaaattccccttatggggggcggttttcaaattaatggcccgggttttaaaaccgttggacttggaaaacccttgggtttcccaaattaaaccccttggaagaaaatccccttttccccagttggctaaatagcaaaaggccccgacccattggcctttccaaaaatttgcccaccctaaagggcaatggaaaattgaaggcttaaattttttgtaaaaattcgggtaaaattttggtaaaaccacttaatttttaacccaaagggccaaattgggaaaaaccctttataattaaaaggattcccccgaaatgggtttaagttttgtcccatttggaaccaggggccccttttaaagaaccggggtttcaacgttaaagggcgaaaaacccctttttaggggcaatgcccaaattcgggaaccttacccttcttttttgggctcgggccccgcctt

SEQ ID NO: 689107 - DNA, 272 bp, Homo sapiens
  misc_feature (75)..(75): n is a, c, g, or t
  misc_feature (81)..(81): n is a, c, g, or t
  misc_feature (87)..(87): n is a, c, g, or t
  misc_feature (91)..(91): n is a, c, g, or t
  misc_feature (106)..(106): n is a, c, g, or t
  misc_feature (115)..(115): n is a, c, g, or t
gtgcagagagaatgccagcaggaaggcggggaccggggcaaggtgcagccaccaagcaggcccaacgtggttctncaacgntctttncatntttaacagcccaganacaggagtnaaagaagccttagctgtttgaccagaatgtgatggcatatttgcaaggcagacctagggagacctctccagctgggaggtagttccagagaggagctgacgcatctgcaagaggcaaggcccataacttacgtttctacgttttggagagctaatgg

SEQ ID NO: 689108 - DNA, 278 bp, Homo sapiens
gagttatacggaaggaaaatgttacacgctggaacacggtatcaggagctagtgctgtatagcagcgacgcccagcctctcccctccacacattgcacctggagacaggcggtgacgcggcagaccggtgctcgtgtgagcgcacacactgcacgtgcacaccccggcgccatgcgtgcggcgacacacacccgagggccccagggcggctgcgtcctcagcagatgagcgtccaaggaggttcctgcagccaagtgaacatggagccccagcgccag

SEQ ID NO: 689109 - DNA, 895 bp, Homo sapiens
gcgtccctgccggccgtcccgccgagcgcatgagctccatcgcatgttcaagcaatgggccccatcgtacgggctgtcggccgaggtcaatgaaccggctcctgtccataatatgacgcccacagataggaggcagagctccgcacctggatcgagggactcaccggtctctccatcggccccgacttccagaagggccgtgaaggatggaactatcttatgcaacactcagtgagcgagcttatagccgggcatccagtccccaagatcaagcgttccatgcagaacgtggctagccatgctagaaatagctgtccgaacttccattctacgggccatggtcaggctactgggcattgaaccctggtggacctgttcgaggccaaggacctgtttgagaagtgggaacatgacgcaggtgcaggtgtctcttctcgccctggctgggaaggccaagacttaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtctgggcatgactgcgtacggcacgaggaggcatctctatgaccccaagaaccatatcctgacccccatggaccactcgaccatcaggctccagatgggcacgaaacaagtgcgccagacaggtgggcatgaccgggtcccggggaaccggaggacacatctatgcatacgcaagcttgggaaccggacaagtgttgaccaactcctcccatgttccctgcagatgtggttacacgcaagggcggcaaaccaggagcggccaggtcttcaggcctgtggcggcagattatattgaacac

SEQ ID NO: 689110 - DNA, 199 bp, Homo sapiens
ctcctgggttcacgccattctcccgcctcaggctctcagagtagctgggattacaggcttgcaccagcgcgcctggctaagtttttgtatttttagtagagacggggtctcgctatgttgctcaggctggagtgcagtggctattcacaggcgcgatcctactactgatcagcacgggagttttgacctgctccgtttc

SEQ ID NO: 689111 - DNA, 204 bp, Homo sapiens
ggcgctgggcggtgacgcctatgctacaaagctggagtgagccttctgcggggccaggagggctggttctcctctcagtggtcggagctccgtgctgtctttccggaggggccctgggaagagccgctgggagtaccgaaactgctggagctttacatcccgtgggtgaccgtgagaaccaggtggtggtgcttgtggagcgaa

SEQ ID NO: 689112 - DNA, 447 bp, Homo sapiens
cctcgtctttttataactatgaggtctgattgacaaaacaagaagcattaccattgtggataagcgcctcattttaaaattcaccttaatcaaaaactgcctaaatccaaagggcatcagcctaatggctaaggtcagcatgatcacaaaccacaaataacatctccaaccaaaaacattccagacacctcccacagagaaatgctagcctcgggataacccctctcctgccggaaagatgtcacccccaagataaccacccctccgcccagaacattccaaccctgccacaaacttctcccccacacagaaacattccaagcttgtaataagctccctcaccctaaaaccaacgtacattcttagtctgcaaggaaaagtgctcctgactgaccagccagaatcctctctcaggtcttttctataataaacctgtctttgactgtc

SEQ ID NO: 689113 - DNA, 277 bp, Homo sapiens
cggcaggcagcagcagtgtgctcagaacttcagacgggatttggtaggccaagtctgctaagtgtacaatatatttgttaattttacaccttaaacaaagaaatgtggtcactaaacataaaagtatatatataggaattaatgtactcttgctttgtcaagctgtttgctatagttaccaaggtattatgttactctaactcttaaaagtgatgtaatctggtagcaatgtagtacttcaaataaaggcatttacataataaatttagggttgatg

SEQ ID NO: 689114 - DNA, 450 bp, Homo sapiens
ggcacatctgacccagaggggagataaacggcacaatcatatgggaaaaccatggggcacaatctactagagctgaagatacgtacattctctggacgtaattctactcctcagtttctactcaacgtgaaatacctaaaaatctttattaagaaacgtatgaaagtgcttcactcagaaacctagaaggttcatggaacacattaactctaatgttcccaaactgaaaattactgaaaccaacagcaagagtagataaactaaattcaacacttatataatggaatacctattgggcattaaacacgaacaaactgcacccacatgacggtacagaatgactctacaaacataactgttgccaacgacgcccccacatgtacatatatgattctatttctataaagttcaaaattacggcaaaaccactccggttcgcgtcatgggcag

SEQ ID NO: 689115 - DNA, 151 bp, Homo sapiens
atggtagagtggggaaagggaagtgttctaggccagaatgttcctatttagaagacactcaaattacagtctgtgttatgtatgtataccatttattcaatgccactgcgacaggcctgtttacactttttaacacctagatagactagat

SEQ ID NO: 689116 - DNA, 113 bp, Homo sapiens
tgtgtgagtgtgtgtgtgtgtgagagtatgtggggtgtaactgtgtttgatggggttttctttgggcagctggatgtgagagatcaatgcctcccctgtttggaagaggagag

SEQ ID NO: 689117 - DNA, 508 bp, Homo sapiens
agcggaagggggcgcgccgcctctgccccgcggcgagggtgtctatggagaggcggcggcgcggctgctgaggcggaggctgaggcagtggcgatggcgccctttcctgaagaagtggacgtcttcaccgccccacactggcggatgaagcagctggtggggctctactgcgacaagctttctaaaaccaatttttccacacaacatacgagcagcgcctctcctgcgctcattcgtgtgctactctctcaccggcagctcccaccactgccctgcacgcacgcacccgccaaccgtgacattacacctctcctcgcgtctcgcgcttccacccaacgccagccacgacccactctcatacatcgtccattccttgaccactccacacttctcccgcgcatccgtaccccctctatctgtaacagcggcactcgaacgccatgcttcacaccctgacatctggacactgcctcccatcactgccccaaccacacgcaccccaccagcc

SEQ ID NO: 689118 - DNA, 89 bp, Homo sapiens
gaacgttgggcttataccggaactttgcttagagccacccggaggacacattatatgcccttggataccactgtaacaggttacctacg

SEQ ID NO: 689119 - DNA, 375 bp, Homo sapiens
agcggaagggggcgcgccgcctctgccccgcggcgagggtgtctatggagaggcggcggcgcggctgctgaggcggaggctgaggcagtggcgatggcgccctttcctgaagaagtggacgtcttcaccgccccacactggcggatgaagcagctggtggggctctactgcgacaaggtaacggagcgctgagcctcccgctgtgggcggtgcgggcggcgatggggagcgggctgggttcttggggcggcctggcctgcgccgcgcccgcagccccgtgccgtcgccgcgcgagtagccgcctgcgcagctgtcagtggcccgcccgcttcccgagcctgcccgccccctgcgaggccttcgcagagccggcct

SEQ ID NO: 689120 - DNA, 126 bp, Homo sapiens
tttgaacattaatgtaatagttggttagcctcacgaagcctcagttcccatatctgttgaaaaaacaaacacgggcggggcgtggtggctcatgcctgtaatcctagtacttggggaggctgaaag

SEQ ID NO: 689121 - DNA, 1285 bp, Homo sapiens
ggacatttgaacgtttacttgtgtccatgtgccaggcaatcgtgatgagaaccagagatataaaccaccaaatggctcaggcacagcatgctcagcgtcatctatccaagctggtgcaggggagcactcagggcaccgcatgaatcattgctttcaaccatgatccttgccacaagcaagctttcctccagctgagagctcacccatggcaggcttattctaggcatggctaatcgcagacttgtcccaagccagtgtgcagcccgtgcagtctttccaggcatcatgtcagccaagatggtttgcaagcaccatacttgccagtgtgccactgcaaaccgcgccatgccattcatttagctcgcagcaggctctcactcatgctcatgcaacaggtgcctggccaccagcatgcactaccaccctggctccaggctcgtcgcgctccactccgcacgctgagacttgaccattgttaccaactcacaaccagcatgtttcgcctccacactgctctcagcacagacatctgggacaacaaatgactagccaggctgacacacagcagtgcgcagattcaccagaaagacattctactggactattgtgcagaccagaacggacgggacacttcacacaaacaactcaaacatgaaccacgaaaacagaccatcaaaacatcagcaacacaacagacccaaaccccacgacccaagagagacgaccacacaacacacaccacccacacacaacaaccaccgacaacgaccgaccaacgagccacaacgacacccaaccaaaagaaaaacacagaagaccaggacaagacggccaaacatacaggagccagaggagacacaacacgcaccacaaggaccgaagcaagaggcacatccacaagagacacagaccacaggcaaacagcaaataatccgcaatgcataaaagacaacaagagaccgatcagatcagaagaccgaccacaacagcaaaacgaaataacacaagcacacacaacgcaggatcacgaacggcacaccaccacacccaacgccacaacccggaaaagacaagaggagactgcaaagacgcacagaaaagatgaagccaaggaacaaggagacaaacacgaggcacggggcaagcccgaaacaagatcgaatagaacaaaaggagaaaacagagtgaccaggcggaacagaacaagagatcagtaaaaagcacgacacataggtagcaaacacagaaaaaatagtagcgagactacaacgaagacacaagaaga

SEQ ID NO: 689122 - DNA, 220 bp, Homo sapiens
agcaatataagaaaagaagttaaaaggatggggaggcagggcacagtgtgtgaatgtaagaaactgtgtaagcaggccaggctccctaagaatcagcttccttagtgatttttaatttgggtggtggagtcacagatcctttggagaatatgttgaaggctacgcactccctccctggccacacacgacccttttgcttattattttatggaattaatgg

SEQ ID NO: 689123 - DNA, 178 bp, Homo sapiens
gcctgatcactctggcagcaactttgtttacaatgttgaattgcagtggtgaaaagtgggcatccttgttttgttcctgatcttagggggaaggcttcagtcttttaccattaatatgatgttagctgtgggttttcagatgctctttatccattaagttcccttctgtcgtcttctc

SEQ ID NO: 689124 - DNA, 1233 bp, Homo sapiens
agtgttagcacactcacgcgtgcgtcacgatgtgtagccgcctttctgctcctgactgttgtggtcgtagtgtgttgcgcggggtggtaggtcacctgtttcagttgcctctgtctatcactgtctaggccccccgttgattgcggccttccccatgccccgtaggtagtgagttgtccgcaccacgctgtggggtggccgcgcttttgtgtttagcgcacgggggctgttcattactaacttggggctccggggttgcctcccagggtgccgtgaacgcgtccacagtgtttgtgcgttggcgtgctggcttcttttgtgttcaaccgcacagtgtgccttttggtgtggacggaggttctttcttccccccccttgggggggtcgtggggggatcatccgggggggttccatatgggggggcctcttcctctgggaaattttgtgggttttttttgtgtgagaggcgtcctggccgtggatccgcaccacacatgcgcccccctcccttgtttctgtgaccccttcacgggtatatgtcccgggcccccctctcgcgttgttttctgagcggctgattttctcggggcgaacacactcttcgcaggggttttcgcctcggttttgcttgagacgcccactgggccccccctcggtaacccacgagaacactccccgcggtgtttccccagagtctatggccccctttctgtgggagtgtaccttcgtctcctcatgaggcttcttgagagaccacgcgtttcacacgccctcggccctcgccaccactatctctctcgttttccttctcacgccgcgggaacacaatggggacgcctcgtgttcgagaggggaggtggaaggacgagcacttctcccctctctcttgttcacgagttaacacatccctggagggtcccgagatgcacgcgctgtggtcacccacatcgtgcacattttcttccgctgtggttgtggaagcgctgaggggcccttctctattcgccctccacccccccgttttccctgcacgtgcaccgcctggcacgccccccacgctatggaagtggccacggagtttgcccggcttgctttgtgaaggggagaaaattctttttttcacgagttatgccacactaaccacgttaactatctgctttgagactgccccaaagttttcctatcgagtggtctgcttacagttttttaaaaataaaacttttaattaaggga

SEQ ID NO: 689125 - DNA, 334 bp, Homo sapiens
cacaagtgggagctacacattgggtacacatggacacaaacatgggaaacacaaacatgagactatgagagggggcagagagggggtggggtgattgttgaaaaaacctatttactatgttcactacctgggtgatgagaccaatcgtcccccaaacctcagcgtcacacagtatacccatgtaacaaacttgcacatgtaccccccgaatgtaaaataaaagttgaaattatatattcaaaacaagtggccaggtgcagtggttcatgcctgtaatcctagcaccttgggaggctgaggggggcacggatcacttaggccaggagttcaagaa

SEQ ID NO: 689126 - DNA, 1178 bp, Homo sapiens
  misc_feature (342)..(342): n is a, c, g, or t
tggccttttaaaaaaagtaacccttttatttctccttggtttgtggcaaattaaaacgtggcataagagtggggtggctttgtggggtgattatagctcaaagaaacaccaaattcccatattccttcgactccgatctccctcgcgacctacttccttgggttttcacacctatagcgagtggggcgcgtgcaccgacacgacacgcagagagagcgcagcgctgtgtgtgggtgcgcacacgcgagcgcacaccaggggggagccaagcagcgcacaacaaaaaagtgcgcagagaggtgagactatcaacgcacaagagagagcgcgcgcttgagagcnctattatacagacgcacaggtgtgcgagaaaggagtgagacaactcgcgggtctctcccacacaagcacacagacgggggcccacgaggacctctcgaatatgtgtagtccccccagtgtaggaagtagatatcaagtacatggtggggagaatcacagtgtaaggtgacaaacacaaggtgtggggagtataccaacacaagaaagtgcgtgacaaaaaaccagagacatttgtgggggccaaaccaatgtgtggagggagcaacacacaccacactcccacgaggaggaaaaaagtgcagcaacataaatggtggaccaggcgaagattgttaaccctctagctgttgagtgagcaaataatcaacaagccacagcatctaagaggggagcagcagcgaagaacagaatgatgagggtgaacccacaagtggtgtgcttcgagaacaacaacacgccgctggcgcgatggggacggtagaaaacaccaaagaaccccacaaaaacgaggaggaaaaaccaagcagttgggggcgagcaacaaaagtaagtatagagagaagcacgacaaggatgggtatcgacagcgagacaaagcgaagcggtgtagaaggtaatagatcagcgagcaggtgagagcactaacccaaacacaaatagatgatgtggcggtgaaccgacaagcaagaagacgcatgtagatagagacatccacgacagatcgtgtgagcgcaacacaagaacgaacaaagcaagcagcccgaaggaggacagttaatagcaccgagaggagtgatgacgctacaccacctctattgtgaggacagaaaacatac

SEQ ID NO: 689127 - DNA, 1023 bp, Homo sapiens
ggagtctagtataactgttcaccgcgtgctgatccatgggtgatctaccatactttcttgccaccatcattgcccagcagcaatggccacaagtatgtccacgtgttccctggcttagccgtttaaggcccgtagttaatagatagacccagcctctccaagggataagttgtattccctcggagttttctcccatactccctcggcctgcaacctcttaggtcagtccacactaagctaattgtcgtagatactcgctcaatctgctctaccctctgccttctcgttacgacggtctcctgagctcgtacaccacattaattacacggcatagtatagtccaagtcgcactcgggaactatgtctatcagtgaagtaaccaaggtcaggaattaggaatgtgtcctgtggacaattagcgcacgacaacatattgtggctctgtgcccacaaagtctgctggtcttccttaaacctagtccagcgggtcatctaccaccatccatatagcactcccagtaacataaagggacgctcactgatgaccagccatggaacattcacccttattactttgacccattctaggagtctggggcaagcttaaggagagcacacacacagacaagtaggtagcacggcacatttccaagcgtacggtgtccctggctttctcgtggccaaagctacgtgttattggtcaagagacagggccagggtgctgtgcgggcatctgaccctgtgaatacgtcggcaaaactcggaaggtcttcacatggactagtgcgggagcaggacggcattgcgttcatatgaacaatcgtgcagtgttcctttaaaaaaagaaagaaaggaaaagatttcataagacaggtgtcagtggacagtttaagtacattaaccatttctctgttcgttcttagtggatgtgaacctgtgctgtggataaatcatttgtatttctggaatgttcttctatgagctaagcagttattaagtcggaatgtgtataggtgtaagcta

SEQ ID NO: 689128 - DNA, 127 bp, Homo sapiens
aattttaagggtttgtcagaatcaagcactaagttgatttttttttctggctatgcatatggttttaatgaagagtgtcatgccagacccctattgacttcaatagggaacgtgccaggttcaagag

SEQ ID NO: 689129 - DNA, 246 bp, Homo sapiens
aattcctggaagagctttcaacctgaggggatgttatccatcctggacctttgtgaagcttatcatccacgtggaatggaccggaaagcacccgtatcgagagactcaggggcatcactctggccaaggagagtccgagaccagcgtagcgtgaagggcgcacctatgtaggcgtggtgaacggagcagaatgaattggcatccccgcgagttaaaagaaattagagctgatcctctacagtcgag

SEQ ID NO: 689130 - DNA, 172 bp, Homo sapiens
agaacaaaaacatctaattctgattatcacttatactgtttattattcgatcataacttggcttttatgcagttgtatttatttcccttaggaatacagttgagtattgttctgatgtacggggcaaggctctagaaattcccctttatcccggtccctgccatcagattgt

SEQ ID NO: 689131 - DNA, 371 bp, Homo sapiens
tatccccggcctcgtcagcctgacaacagtgggaccccgatagcctgttccagtgagcgcatcgcctgactcatggcggactgactgacgtgcagctccttcgcggccgcactgaagctcagtagccgggccactgcggcaaatgacggcagggttttgagaggcaaatcgcgtgacgacacggtcgatcctcaatctgcttccgttcatgcggtgacttaagtgtttcttatgtgtcgcatcatgaatgaccgtttgtcaaggctggcgggtgcgctcaaggtatccacgccccgaaactcgctaccgaccaatgaatttcaagctctggccgatcacagccgacatcaacgacctgcggcacctcaggg

SEQ ID NO: 689132 - DNA, 308 bp, Homo sapiens
acctggttctccacttagcaggtatgtcgttttaaatatctttgccttcactttgggaggctgagtcaggcggatcacaaggtcaggagcttgagaccagcctgaccaacatggtgaaactccgtctctactgaaaatacaaaacttagccgggcgtagtgcccctcacctgtaatcccaatcccagctactcaggaagccgaggcaggagaatcgcttgaacccgggaggtggaggttgcagtgggctgaaatcgtgccactgcactccagcctgggcgacacagcaagactccgtctcaaaaaaaa

SEQ ID NO: 689133 - DNA, 321 bp, Homo sapiens
ggactttgagatagggaagaggtttaaagtcagttgttctagcaaatatggtttggaatttatttgtgatgcttaaaaatattgctgaagagaagtgaagtctaccctagagttggatggtgagattatttagcggaactaccagatccatgttgtgattctttccagtatcattcagctgcccttgggcagttgcgaggcaagtcatcagtggggtatggagattttccaggtgggtgtggttgaaggaagggaagaatgagttcaggagcacattacaaaaagaaggtgactgtaaggtctaggctgaacaggaaggta

SEQ ID NO: 689134 - DNA, 853 bp, Homo sapiens
ggacgcgtgggtcgaggaaaaggttgtaacaataatacccaaaatctgattggtcatattgttccacagagtaatgcagtctggatataaatgtatattctagacttccttataaggggattctcccagctgctaaatttaaacagtaaatatcacatttagtcattaacacagctataacttgccgtggttctcagattatttggactatttagatgccaagtgaatataagagcttgtactgaaaccatttatttctttctatattgctattagcaacatgctatgtgatcttccctacatgaagtggcagtaaccattgtcacatttaacagacctacccttctacctatattgaagtgattatgcagtgtacatacatctgagacagcatcagggattatgacctaaatcatagagttcacacacgctgacatagtcttgtacttatagtaggcactgaaatcctaagctcttgaggccatatcactgccaaccgtgaccatactgatgttcaaacagtctttatctcatcaagtcaacgaactctatttaaggtccaaccaactcaggtcaagtgcaaacgcatgtaacaccatacaaggagaagaaatgttaaccgtaaggacaacaccacgatcccgatgtacaacggtacaccatattaacgtcagagtgaatccaagcgacaaggatccatccagcaaacagaaggctacacgagatgagctcggtactagaaaagaccgtgacgagcccagaggcatcgagcacatgataccaaaagtatgagcaggtgaagccagcaaacaacacgaaaccaagaatggaaccagactgaaccaaggagaaa

SEQ ID NO: 689135 - DNA, 402 bp, Homo sapiens
  misc_feature (107)..(107): n is a, c, g, or t
gttccctatcagctaccccttatctgaatgaaaggattttgtccttggcttaatcaaaaggctgaggcgaattggtaccccatgcagatgaaggcatggtctgtgcnttgccacggccactccaaggcactgtccttttctatcagagaactggtacaagggggagggttgtagtgacagtcgccttcgatcctttgctactcgggtgtagatgaggtttttccttttggtttagttgtaggaagttcacgttaactggctttaggttccctgctcccagaccttggtgttttttcttgtaggaagtcagcacgaattggccttaagttccctgtctccagaccctattctcctgcctcacttctgtataagtcaataccatcttaaaacaaatctaacttt

SEQ ID NO: 689136 - DNA, 690 bp, Homo sapiens
  misc_feature (50)..(50): n is a, c, g, or t
aagaaaaaattagctgggcgggtgcggcgcctgtggtcccagctcttcgnagggttaggcaaaagaatggcgtgacccaggaagcgaagcttgcagtgagccgagatcatgccattgcactcaagcctgggcgacagagcaagactccgtctccaaaaaaataaaaaaaaaaaaaaaaaatccatccactccatccacttagtagcagagcgaatagacattcagtatagagctttcacgtcagaaagcactacagaagtagtggcatatccccggaggctgaggtgggagcattgctgagaggtggcacgtgaccacatccatgtcattcaacaacagaaaaacaagtcatcgagggtgtgaggggccggtgagaaacccagtatggaagaaaacacaactgggctgagcgtggtggctcacgcctgtaatcccagcactttgggaggccaaggcaggaggatcacctgaggtcaggagttcgagaccagcctggtcaacatagtgaaacctcatctctactgaaaatacaaaaaaattaactgggtgtggtggcgcgtgcctgtagtcccagctactccgtaggctgaggcgggagagttgcatgaacccaggagccgagaccacaccactgcactccagcctggggcggcacagtgagactccgtctcaaagaaacaaaaataaaaa

SEQ ID NO: 689137 - DNA, 128 bp, Homo sapiens
ctgtgtgccatcctggaatgatactagctgattaattgttcctgataacatctcatgaaaaggagaaggacagtgtactggagaatgtactttcacatcactgagaatctgcaagtcacagaagtgac

SEQ ID NO: 689138 - DNA, 380 bp, Homo sapiens
gcgtcgacgaccaactgcacggcgtagtagcggtagaattcgatcctgggcagggtcaacaccaagggctcggcccaagaatcgagacagacaaaggagttgggagtgtccgggttgggggtggggatagctgtatctttaggggttatcgcttggcagtgttgccgaaatggttgaacggcgccttgaagttcggcccggctttgtcgacggcctgggtgtagagagtcttgtacatctccaccaccgggaagccatagaggtaggcttctttggcgatgacccgtgcttcactcggcgtggcggtgaaatcggcccaggcgccggtactcatgagaatcgagaggctcgcaacagcaggcgcgtcggtgttcgaatca

SEQ ID NO: 689139 - DNA, 1344 bp, Homo sapiens
  misc_feature (430)..(430): n is a, c, g, or t
  misc_feature (642)..(642): n is a, c, g, or t
  misc_feature (844)..(844): n is a, c, g, or t
ccacccccccgcctctccgctgcgctgtgagtgatgtgttagtgtcgcggctcccccaattgtgttaagagacgacagtgtgcgacccccctttgttaagtaggggtgagttcctaaagtagaccacacccacagttaaccgcggaaagattttttttaaggaggtgtgcgacccacaacacctaagtattagggagaaaccttccttcgtagtaaggggaagctcctcccacacacagaagagtgttgtttggtgcaacgaccagaaaaaattacgcccacaaaaggggcgcctttttggggtgatataaaacaccccgtgagtcctccggcgccccccacacaggtgtatgatacccgcttagtattagtcaccaccggcggctcctcctctaataaaaagggttaatacccaccgaaagggcggccnatcttgtcgtgttttgtgcccgaaaaaaattttcttcggcgccccccacgaagagcgccgcccaaatcctcatctcccgtagaatagtctcggggggagactcccgtgccccccaaacatatggtagaagagttttttataagtctccccctgttttgtgtgaagacccttgtctcttcgacgctcctggagaatcgccacacatgatgatnttcttcgccccgacacatagcggcagacaatgtttctacaacaatgtcgacgcgcgctgtctcgcacaccacacttgtctcgagaagaggggagagaagatattaaatagtgttcctctttctcccccgctctcttgtgttccccccacacaagaggagactttgtggagacacccagagagagatcacacacaacacggtngcgcggattctcacactagcgccccctactactccgcgataaggagagatagagtaaagtgacagatctctcagagttttgttctacacgtgggcacacacacttatataaaggagtgccacgcccacacatatggcgccacacagattagatctcccacgagtgttctacacagaggaaagagaaattatatatttttatatccacccactatggacacacgggtgtccacgaccgggggaataagagcgttaataggcgccccaacctgtgcccaccgtaaggccattctacaccccacgcacaaggtggttaatccactaaggcgttaaactggcaccaaagacccgcccaaaaagatcccctcgaaccggagaaaccccaatctctcgcccaattaaggaaaaggaaaagggccaaaacacaggaagaaacccttgagaaaatcccggaataaaataatcttatataccagcctttgatttaaaccttggaaccca

SEQ ID NO: 689140 - DNA, 470 bp, Homo sapiens
  misc_feature (39)..(39): n is a, c, g, or t
  misc_feature (279)..(280): n is a, c, g, or t
agattaaggttttgttctggacaatgatataaagaaccncaggagggttgtgttcactggcaaagggtaataaatgctggcagcagcttcctgaaggcacttacctccacctttggcccactgctggaaacagctgtcccctggcttgcctccttggctcggagacttgctggcaagtcgaagttggctgttcccagagcttttgctgcgttggcttttgctatttctagtagctccattcgatctttctcactcaggcgaaatggggttctactcctnntgcgcgacctggttctggatctttccctccacctggggcgatcctcggggtacaccgtccggccgaagccgtagtagcgccgccctctagtgatcgcgtagtacgaccaccggtgctgcgacctcccgcgggagcgcgacctgctccgggagcggtagggcgacggcgacttgtagtacctccgcggccg

SEQ ID NO: 689141 - DNA, 118 bp, Homo sapiens
aggatcgtgaggtggagcaggaaacaagatacccccgggaactgggcatcgtgtcgggcccacgctgcttcggccacggccacgaggcaccgtgtcctctcctccctggtggattatc

SEQ ID NO: 689142 - DNA, 162 bp, Homo sapiens
tctggccgtcgtttaacactggccgtcgtttaacactggccgtcgtttaacactggccgtcgtttaacactggccgtcgtttaacactggccgtcgtttaacactggccgtcgtattaacactggccgtcgtttacactgccgtaagttaactgccgcgtac

SEQ ID NO: 689143 - DNA, 251 bp, Homo sapiens
agtctgacagtgcaagatatactttgggatgaacatcagaagtgcacttatagttggataccgtggactaccggcctcagtattatgtgcatccggactatgatagacgtaacatgaaccaatgtgaatttgtagactgtgctatcctgagttaattatatacgtgcagacaatgttgcctattgcattgagatacgttatatcctagttaatgctaactagtctcagaacctgttgtcagccatgtgtta

SEQ ID NO: 689144 - DNA, 212 bp, Homo sapiens
  misc_feature (33)..(33): n is a, c, g, or t
  misc_feature (35)..(35): n is a, c, g, or t
  misc_feature (70)..(71): n is a, c, g, or t
  misc_feature (113)..(113): n is a, c, g, or t
  misc_feature (152)..(152): n is a, c, g, or t
gcacaggtctgtcatgcggcatgctgataatcnancaaaaggcctctccttctttgcgtttgagcacagnngaggagtaccagcaggctcagcacaagttcctggtggccgtngagtctatagagccgaacaacatcgtggttctgctccanacgagcccttaccaggtttgattcgctcctgtcagcttatctagtgtccgtccgctactt

SEQ ID NO: 689145 - DNA, 336 bp, Homo sapiens
  misc_feature (11)..(11): n is a, c, g, or t
cgctaccgggntttcgagtgaagagagggcagatcggagtcgaacctgccccattcaggcgcccccggcagtggggcgcagcgcaggcagaatggcccggaaccccgcgcggtgtcggggaacccggaaacgaaaacgcccaaccggcgagggttgggcgtggaaggatggtggtgcagacgcgaccggaatccaacccactctctcaacgattgagcaatcccgggccctcagtgccgtggtcgagagcattccaggcctcgatagggatcaggtgtccaacgtcgggtggcaaccgatacgacagacttcactcgaaacccggtacgagctcga

SEQ ID NO: 689146 - DNA, 106 bp, Homo sapiens
gcggctggtgcttgggaccatctggtcagagtccatctgggaataattccattgttcctgggatcccacatggactctgaccagatttctgccaagccccagctcg

SEQ ID NO: 689147 - DNA, 192 bp, Homo sapiens
gcaggcgatctagaggatcccagtccggtcccccactcttagggtagtatgatgctaatctgtccctaagtaagtttcttcctgctcctttgtatcttcctttcttgtctttcctcctacctttgtctcttgggttttgggacttttttttttttttttttttttttttttttttttttttttttttttttt

SEQ ID NO: 689148 - DNA, 344 bp, Homo sapiens
agctccaccattatctcccccgcggattgtgcgagcatccttccgatgtcatcgtctctaagggcgagccacgactctgaactgcaaggcggacggcggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcatagtctcattctgtcacccaggatgtgtg

SEQ ID NO: 689149 - DNA, 134 bp, Homo sapiens
ggaggaggagtacatccgccttggttctacagataaggttatttgcctgagtatcaactgctgatctcttttttaacaggtccaggtaagcagggcgtagggtttttattcactttatacagcaccaccagggc

SEQ ID NO: 689150 - DNA, 955 bp, Homo sapiens
  misc_feature (211)..(211): n is a, c, g, or t
  misc_feature (955)..(955): n is a, c, g, or t
ggcaaagacaaatggacatctgcccaagtgatccagctgcccttccttagcacgcatcacatgcactcccctcaattcacagtgttttagacaacttgactgtccctatgttagtctataaggaccacatgaaaacatgtagtaccctgtgattctctatttggtgtcgatgtaaattggttaactgcagggatggtgctatgagagctcntggtcacgccacacgtaagaccaaatccatcagcaaattctactggacaatcctcccttttagtagcagagttggaccggcttttcccattgcatgataggtttctttccctcattctgcctagtgtgtaagttttctatttccccagtacttttagccaaccttaccaagtggtgtgtaaagctagtatgtatgtgctttgcttactttttaaagaaactgtagttagactgtgaggagttactttatgtacgttgcatattcaaactgtgatgttttatccttcaaaacaagtctgcattagagaagatatggtgccctacgtagacagctttcattcactttattactctctcatatatgctgtgagaagttgtaatatcaattgggctctttgggtgggactctaagcagcgatcgcagaaatattgcttctggtccaacttgtccatccagaacagaagggcgctctagtagctgtgtgctggattattccggacctggattaacgtcaagttgctccattgatttcaccattcagtcccacttttattcccagaaaatcaatcagtgcgcaaaacttcgcaagggcactctaatggccgggtgcggagaacaccacgttcctggacatggcccatgggccactacgctgttccctgacccacgtttctttttacacggggggaactctcgcggtcccctatagggggccgaaaaaattccagaacccgttacctgtgn

SEQ ID NO: 689151 - DNA, 294 bp, Homo sapiens
cggctgtagtgaggcaaccggatgggatgtgttgtgtggtggggcggggacatttatgttctatggtgcgcacgggcaaaggtatgtactggaacattgcgattgggaatgtaagtaatacttaatggtaattttggttttctctttcagatatggagaatgttgccttataaggattggagtattagaaatggatcaattcactaagttagtttattaaattaaaaaagtctatgcttcattattatagctatttcctaataggtctctggatatgtcctcactacatgccat

SEQ ID NO: 689152 - DNA, 315 bp, Homo sapiens
agaaataaagctgcccaactacagccatgtcatcttctacaaagtcaacaataattaaaacaatatagaaaggattccctattcaataaatggtgctgggataattggctagtcatatgcagaagaatgaaactggactcctacctttcactataaacaaaaaattaactcaagttggattaaagttttaactgggacagggcatggtggctcatgcctgtaatcccagcactttgggaggcgaaggcaggtggattatctgaggtcaggatttcgagatcagcctggccaacatggtgaaaccctgtctctact

SEQ ID NO: 689153 - DNA, 227 bp, Homo sapiens
ttgctcggtacccctgctctcgatggccatgcgctacgaggggtgggaggtccggaccgcaggaaccggcaacgccgctgtccgggaggccaaggacttccagcccgacgcagtcgggctcgacatgatgctccccgacttcgacggtctccaggtgctgcggcggatgcgcgaccatgacgagagcgtgcccgtcctcttcctcacggcgaaggacgcggtcgagg

SEQ ID NO: 689154 - DNA, 392 bp, Homo sapiens
gcgggacgagcccggctcgactattaacacaaatttagccagaggtgcaaacctgtaatcctagctatttgggaggctgaggcaggaggatggcttgaacccgggaggtggagggagcagagagctggcactgagccacgccacggcactccagcaggggagacagagcaaaactcggggccagacaaagaaaaaaaaaaaaaacccagaccagaagaaagaaacacagagatatcgaacgggtcatacgatcggaaaacatcgtcgagcaattcaagaacaaaagagctcaagaatcccttatttccattataaggagcacctctgctccctgtactcacaaccttggatacaaggggtaagtgcatctgcaacgtgtggcccctgtgggc

SEQ ID NO: 689155 - DNA, 531 bp, Homo sapiens
tatgtcctgctccattgctgactcctcatcatccacgctgttgactagtgaagttgtttagctcaagaagcccactgggctccaccaccacattggagctggagtgacacggaatagcatactgaggaatagcctggatgataatttctgctggactctcttcagctttcttttggcctacattctgaatacgcatgaactggcctgtcgcaggcactgctggtggatcaattttccttgtcgttagggaagagccaacagtggatggactcgaacaggactctctacatttctgttgctggggagtggaattcgccatccctgccaccaccatgttggttgggggtaatgagcctgctttaccagtgagcatgttcttgggaagagcctttttttgtggatcccatatcatatgttctacctttgaatcaaacctgacctttcatcaaggacaattttaaaatgtccgacaatggtgggttcttagaagccctgaatgggagaatcgccttgaaactgggggagaaaagg

SEQ ID NO: 689156 - DNA, 120 bp, Homo sapiens
cggcacgagggcggccccggctgaactgctcatcatcggctggtacatcttccgcgtgctgctgcaggtgttcctggaatgctgcatttactgggtaggattccaggaacacctgcagca

SEQ ID NO: 689157 - DNA, 220 bp, Homo sapiens
actagtccacggtggctgccaggcctggacgaggggaagtcaggcagctgtcaatggggacagcagtttcagttttacaagatgagaaagttctggatatgggtttcacaataatgtgaatatacttcacactactgaagtgcacacttaaaaatggctaagatggtaaaacttatgtctattttaccatcttagccaagcgtggactagtgggtaccga

SEQ ID NO: 689158 - DNA, 612 bp, Homo sapiens
ccatcgccgtgcggtagctgcagctgaaccattcgaatctgaggccctggttactaatagagttcgtttaaaatttataatcattcttaggagagcgaaagagggtgcgaactagccggtcggaccgggcgggagagctggggcggcgggaggagacagccggggtgtagcgtgttgctgctcgtgacctagtgaggcagtccgtgtggcagtcctgtgtgctggcgtgtgttccgcggccggtgggggacggtgagtagcggctcgcgctgcggtgcagcggcgctgcactcactcgccctctccaggggctgggggttcgtccggctccactggggaagactcagcttctccccggggtcccgggttgtgccttactctccggagtgggcagggtatcgagggcaggggcctcccggcccggctcccccatcccccggttcggaccgcgagcgccggtctcccctccctgagcaccgatcccaagttccagctagagaaggtgggcggagcgccagcccgggccccctcccagtcccagcgattttgagagggaagatctgatctcctagaattagagttggtacagaaaccatttcagtccaaaaatgg

SEQ ID NO: 689159 - DNA, 231 bp, Homo sapiens
ttcacagagggggtcattttctctttaggcaacaagtactctttacggcactagtctacacggaggaggtgtgggcccctcttcccctctgggctaaaatatcctatctgaaccgttaccacaagctgggatgtatccaggacttggtctccttggaagacaggtctgatgtttggccaatcaattccttcacaccctgtctgaaacttgtatcttacgtgaacttaaaga

SEQ ID NO: 689160 - DNA, 1049 bp, Homo sapiens
tggaagtgacatcgtctttaaaccctgcgtggcaatccctgcacgcaccgccgtgatgcccagggaagacagggcgaccctggcaagctccaactacttccttaagatcatccaactatgggatgattatccgcacaactgtttcattgctgggagccagacaactgtgggctccaagcagcatgcacgcacgactccgcatgtcccttcgctgggaaggctgctgcgtgctgcctggcgcaacgaatcaccactgcatgcgcacaggccactccgcagggccaccctgcgaacaacaacccagcttcctggcagtaaactgctgcctcactactccgggcgcgaaatgctggcgctcttgctgctctcaccaacaggcgcacgcgcccctccacctgccccactcacgcggaccactgctctgccatggccccaagctcaccgcgcttgccagtcctgtcctgccccgctcgcctggctgcccactctgccccctcacctgcctgcacccgctcaccttgctgtccagatccgcaggcacagccaccttgcgccttcctccggcgtcccctgccgccccaggacacccctccccgatttctcactcccatcgcggtcgttgctcacgtcgcttacttccccgccgaccttccgtcccagcctccctcccgtgtcgggtgtcccctccctctctctgcacccacttcccccttgtcacgcgtcgaccttggcttcgcctccccctcctcgccgcctccctcacgcctacccttcggtgcaccggacctccccctcaccgcgttcggtgctcagtcgtccctctaccgctcccgctccaccgtctcgccactctcgctctccttggtctcactctgaacaacgccactcttgctgcccctctcacactcccgacacctctcctttctccacccccccccgctttgctccctccccccactctcctctgcctgcgctcctctcgtcgcgctccactctcttccacacctcacacttgtgccttgcctcacccccacgacctcagctctcgc

SEQ ID NO: 689161 - DNA, 177 bp, Homo sapiens
actatactatactgccctacaggattcatactagagaacctcgtgtactctggataaaaagatccatctgtttattccccccatgctctccattcagaccaccctacagataccctggcagatggctctgtccctctatgccataccagtaggcaaatccttatacagcaggatatg

SEQ ID NO: 689162 - DNA, 355 bp, Homo sapiens
attcggcacaggaaatgtctagtcaccgtttcagacagtgcaaatcataggagtgaagaccacaaaaactccggattccggccaaccggaaacactttgggcacggaggctctgccaagtcttccttctccagcagcatggggcatacgcctaactattctcagggtaaacatggaaatcctaatcgcatctgcctcactcctgccaggcggtggctgctccgaattttccaccacccggtgcgcttggccaacgtttctggggcatttgcgctcaaggccagagagcgtgcaggagatgagaccatcagtttcggcctgctgaagggaccaccgtccgagctgaaatgagcaga

SEQ ID NO: 689163 - DNA, 123 bp, Homo sapiens
atggaatcccatcaccatcttccagtgcagcgcacactcccaactcaagtggggctgcatgctggcgctgcagtagttgtgtcagtccagtggcgtgttcgcaccaccatggcagactaaggc

SEQ ID NO: 689164 - DNA, 683 bp, Homo sapiens
ggggaaataaaaaaaaaaatataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattgcggcccccctggcccaatgaaatttaaacccaaaaaagtttaataaatgggcccaaatttaggcttaattggcaaaatcgccctaaaagggggcgtaataaaaataaatggccggcttttaaaaaactttgaactggaaaaaccctgggtttacccaaataaaacgcctttaaaaaaaatccctttttcccaagggggcaaaaaagaaaaaagccccaaccgaaggccctttcaaaaaagggcccaacccaaaagggaaatggaaattgtaacgcgtaaaatttgggaaaaaactcggaaaaattttttgaaaacaaacttaatttttaaaccaaatgggccaaatttgaaaaatcccttttaaaacaaaaagattacaccaaaaaaggttaaagggttcccaattttaaaaaaaaaccccctttaaaaaaaccggcccctaaaagtcaaaaggcgaaaaaaccctttataaggcgagagccccttttgagaaaccatcccctaaaa

SEQ ID NO: 689165 - DNA, 114 bp, Homo sapiens
cggggagtagctgacaagatcgtagatctcatgccaggtagcatcaggggctgaagtgaagggcgtgtgcacatgaagactggtagtgtatgccctggcgacaaacggcgagat

SEQ ID NO: 689166 - DNA, 196 bp, Homo sapiens
  misc_feature (166)..(166): n is a, c, g, or t
cactcgagacgtaaattatggctagaatcatccgctacctatacacgccaataggcgcctcactatatctataatactagcctactatcctaacacatacggcgcgtgggcctaatatatcacggatacataatctactaactacagaaacacctagacaacatancggcatatatacctacctgtctatagcaac

SEQ ID NO: 689167 - DNA, 537 bp, Homo sapiens
  misc_feature (59)..(59): n is a, c, g, or t
  misc_feature (224)..(224): n is a, c, g, or t
  misc_feature (226)..(226): n is a, c, g, or t
  misc_feature (231)..(231): n is a, c, g, or t
  misc_feature (242)..(242): n is a, c, g, or t
  misc_feature (306)..(306): n is a, c, g, or t
  misc_feature (341)..(341): n is a, c, g, or t
  misc_feature (346)..(346): n is a, c, g, or t
  misc_feature (349)..(349): n is a, c, g, or t
  misc_feature (356)..(356): n is a, c, g, or t
  misc_feature (358)..(358): n is a, c, g, or t
  misc_feature (365)..(366): n is a, c, g, or t
  misc_feature (373)..(373): n is a, c, g, or t
  misc_feature (376)..(376): n is a, c, g, or t
  misc_feature (386)..(386): n is a, c, g, or t
  misc_feature (391)..(392): n is a, c, g, or t
  misc_feature (396)..(396): n is a, c, g, or t
  misc_feature (400)..(400): n is a, c, g, or t
  misc_feature (407)..(407): n is a, c, g, or t
  misc_feature (411)..(411): n is a, c, g, or t
ggaggctcggtcctgctggaggccacgggtgccacacactcggtcccgacatgatggcnagcatgcgagtggtgaaggagctggaggatcttcagaagaagcctcccccatacctgcggaacctgtccagcgatgatgccaatgtcctggtgtggcacgctctcctcctacccgaccaactccctaccacctgaaagccttcaacctgcgcatcagcttcccgncnggagntatccgttcangcctcccatgatcaaattcacaaccaagatctaccacccaacgtggacgagaacggacagattngcctgcccatcatcagcagtgagaactggaagccnttgcnacncaagacntngccaagnncctgtgnagngccctcaatngtgcnnggtngaantagaccngaantatcaggggagcccctggcgggatgggacctcgcttgacctggctgacacagaatccggagctgttcagaaagaatgccgaagagttcaccctcggattcggagtgaccggcctcctaactcatgt

SEQ ID NO: 689168 - DNA, 306 bp, Homo sapiens
  misc_feature (36)..(36): n is a, c, g, or t
  misc_feature (38)..(38): n is a, c, g, or t
  misc_feature (77)..(77): n is a, c, g, or t
  misc_feature (224)..(224): n is a, c, g, or t
  misc_feature (259)..(259): n is a, c, g, or t
  misc_feature (267)..(267): n is a, c, g, or t
agagagagagattgagatacaggcagtcagccagananagagagtaagacagaagataggcacagacagagagacanacagacaggcagacagacaggcagagaaagagagtaagacagaaggcagacacagaaagacggagacaggcagagagaaacagacagaaagagagagagagagagaaagagacaggaagggagagagagagacagacagacagaganggagagttagacagaggacagacacagtgagaganacaagcanatagagagagagagacagagacagatacagacagataga

SEQ ID NO: 689169 - DNA, 472 bp, Homo sapiens
atttattgagccacgctctgaatccgcataatacacatgggggtttgtgttatctagaaagggagtttgataaaaacttactaaaagccacttgaagtaacaatgcacatgcaagagattttcacacatttatctctaaggagtattgagcactacttcctgatcagctgattctaattaactggaatccgactatcacaacgtattatgaaccactccgctctatgtcatttgaaacaagcgttaactgaccagtaatagttttcagtagatgctacgggatacttctcagatttcgatgcttccatatcatccaagccaaggagccatgaggggcaaacgggtggattcagagatttgaaatgaatctaattgtacacctgggttcaatattaactgcaatgggatcttgttactcccaacaataatgtgggaacaaaaaatgatcaaataacatatattcaggcgtgtt

SEQ ID NO: 689170 - DNA, 209 bp, Homo sapiens
ggatagagcggtctggcgaatgaaaaacaaatgtgctttatccatacaggggaatagaactctgcaattttttattacagtgtagttgatttacagtgttgtgtcagtatcttcacacagcaaagtgactcagttatagctttatgtacattctggtgtttggggtgatcaaagctcaggtagggattgggaagcactatatgtgcctg

SEQ ID NO: 689171 - DNA, 100 bp, Homo sapiens
agcacgatagctcctaccttacatggcactggtggtctgcacacaatgcgacttcgccggtctgcacgacctggcccatcgaaccaaaggcggggtggat

SEQ ID NO: 689172 - DNA, 267 bp, Homo sapiens
cgcgaccactaattcccgccatggactcaggcggacccagcaggagctgtcgctcgcggtgcatcaccactgtctgtgataggctggtccaggaaggccatcagctcctcattaatgatcatttgctgatgatggagtgcccagtgggcacgatccagctcaaacatgtctagacagcgtctccatgctgatggagtcatagacactgctgtacgtgaagaggtaagtcctcagtgactcttcctgcaattaagaagtgaccatacg

SEQ ID NO: 689173 - DNA, 963 bp, Homo sapiens
accaggcgtgtcgtgcgtcgtgggaaagcggctgagtgagcatggaccactcggtgtccgagtgtcatccctggtcatgacgagctgcttggttgctggaccgaggcaggaacatagtcgtgggggggaaaggatctgtcgggacctacccatcatggattgacagtaccttgctgggtcggctccaagtgaggctcatatggaaggggtgcgtatgctccaatgggggtggctactcataattgcataattgacagcacaccgtgtccaggaagatttcatccaaggtggtggccggattgacaattttgcccctcttggtagggcctattgtctttttgtggaccaagttcccattgaagaattttgcccttaccagaaggggctacacagcccttcggggaaaaccgtgggcctctcgtggattattgtcaaattggccccagtggcaaaactacacggttggacaacgggtaagccccaaagacttcaatttccccagggtgagacgggacaccgtgacattatatattatcaaaacaccacgggaagtagttggacgctaaaagacagcgcggacctttcctggcacattacaaccacatctgtgcgcacacacggcgacaagccaaaccgaacgggcttcctttggagcgggtggcaccatggcaattttgggccacaagacgttgtgctagggccgtagaagactcacgacggaatttagtcacatttacattacacagtaggcccgttccccttaagagggacacaaagttccctcctgggacacttgtgcctataatattcgttcaacacttacaagcgcaagattgcggtaacttgtgtgagctctatcgcgagaccagagacatctcagacgccccctgtgcgagacaggccagtgctagttgttcttcgcgcatcttaaacacgacgcgccgcgatacagcgcactgtcct

SEQ ID NO: 689174 - DNA, 905 bp, Homo sapiens
attcagctcttgtgccgcagctgggcccaacggtaggtagagttgcaattactggctctgtcagctcgttggcttgcaggcattagtcgtgcgtcatgagtagctgcgtctgggttcatcacctaattgagaaacgcgccggctggagagaagcagcatgcgttacgtcgtcagcaaaattcgcgacggactcggaagtatctctgcaaggtcaatgtgacccttgcgaatcatattgcagaacaacgagagtcccaattgctgaggcttctggattagtctagagcctttgagccggccgcgcagtgcgctatgcttgataggggtgcacagatgtattaacaggaacgtttcaaccgcacgaggcccagttaaccaaacctaagcctatagtaagctctacacacaccttagacctggcaaccaaatgcgccataaatctgagtgaacaccgtagccaagggggcaccttagttcccacaactggcatgacgcacacgtcacttccagcggaattccccacggtcaatccactggaaccagagcggccacaacacaaaaacagttcaacacgctggccacacatactacagcacaccacaaccaaccacgttttgacaagacccaaaaggcctatggatgcaacacacttggcgcaccgccgcactttcggaacaccgcaactctaccctcgaacacctgctggacacacatggaataggactaacccacgaacaccacacggccactacagccacatcgcggcgaggacaagactgactcgtcaacacattcaaccgcttcgcctccatacgcacgcggcggggctcaccagcagccgttggcacctctcaaccattcactatacactatcctcacacggcacaaaccacttcgcctcgata

SEQ ID NO: 689175 - DNA, 284 bp, Homo sapiens
gtcgacaccagtgtttagtctgcgggtctgtcgggtggacacgtccaagccgtaggagccagtttcctttcttagctgatgtcttgggccagaacaccgtgggctgttacttgcttagagtaggacgcggtttgcatttaccgccagtaatgtattcattcttaatttactgtaacggtttttttggtacgcacttctcgattcttggaagagatgacaacaaatgtgggttatctactgttatgtgagaacattaggccccaggcaacacgtcattgtgtaag

SEQ ID NO: 689176 - DNA, 1634 bp, Homo sapiens
tttaattatctcaaaatatttattttatatctctggacctctcttttcaaatctcttgatttcaaatttcacaggtgtgctcaaagcaaatacaatgtgcaaagggggaaacgtgcaaccaaccaacacaaccaacacaaaaaatgtgtgtcccctatagaagggattaaaaggggctcacgtggggaccaaatctcattgtggtgatgtgtgtgagaccttaaaatctacgtctcgctagcgtgtgttaattataacacatgtgtgtctccacagagaacacacaccacacaaccaacacacactctctcacactctcacagtctctctctccttaatcacacacaaatatactctctctagtgacacaacaacaccgtgtcacacccaagtgaaaaagtatctctcttataatacaacctgtgtttcaccaaaaaaacacactgtcgtgtccagagtgcggcgcgtgtgtgctgtttataaccaacttttttattatacacacagcagagagtctattataaaagaagtatatacaacgtgtgcgaaatcacacttcttaccgaagacaaacatgtgtgagtgcccaagaacaccaatttttctatacatctccccgagtggtgtcctcatatatgaggcgtgataaggcggctctcaccacagaagacaatatttgagacaccccccagagagcgactattctcgtgttcaccaacaacaaacaacaacaaagagagggagagcgccgcccgctcctcttaaagaagaagtatttatctccctactctgaggagggggagccccccccaagaaacgctttatcacgacgctgttttaaccccccggagagtttattcttctcttgtgtgatcaccaaaaggagtggtggggcctccccccctattaataattagtagctgacaaagttctacgacatcttaaactataagacgcaccaataagaagcacacctgttggtgcacgcagcacaccgtcttatctcacaccaaacaagacgttatttcagcaaagaacacccggtggcggcaacacaacaccgcttggtcattaacacatgttttggggggagccaactacactttagtggcagtgaaaacaaggtggacacaccaccatctaaaccattatccagtagtaccgaaggggcatgacacccacacatacattgcgggcacacaacaatcactaataccccctcagccacacgagaaatttcttatcaacagggcctcccacataacaggggcaacaacatttatttaaccacgatctcctccacaaaatggtgggcataatcactcgccatgtgtctcctaccaactcattcccccttgctccacattatatccacctcaacaccacactatattacacaacattatctgcgcacaacaccacgacacattatataaactctcacttccaaccaccctttatttcctcacccggacgccctctcacatctacactaaatcctactctaaatacactatcataatcaacactctaaaacaaacaacaaacacaaacaacatacatatacaacacacacacaacactacaacataaaaacacaatactacacaataacacacaacataatcacataa

SEQ ID NO: 689177 - DNA, 1111 bp, Homo sapiens
tctcttggcttcttgtgctacctgtgctgtttcttttcacttgttgttctttattatctctctgggggatgttttatgttccttggtgtgggatcctcccccccctcatgtttgttgtgttgtgtgtctgaacccgctgcttgtcggaaactccttgcgtgttttgtgagaagattttgaccccctgcgtgtgtgtgggtttcccgccgctggggttgcccccccccacgcggggccctttttattcaattttgggccaccacccgcgccagggagaatttccggtgcctgaaagattgcttattattaccaaccccagggtcccatcagaagttgagggacattcgagagtgacctacacagaatggccctaactggcatagagatctggtacgatgtgtgagaacatccccattgggttgtgtggccaccagagtggatattaaggacaggaaagtgaaggcgagatcccttgtcgttcccccgtaagaagaatcttccgtactacgacctttctgcccaaagtaactaccactttgaaaagcccttcctctggcttgctaggaagctccattggagaccctaacttgggaatttgttgcccatagcctgctcttcgcgcccccccagaaagattgtccatggaccccagctttggccagccaccagttatgagccacgacttagaaggttgcctctcagaccaacatgcccttccccggatggaggatgatgaccctgtgagaatgaagctggagccccagcgtccagaagtctagttttatagcgccaactgtcccgtgatgtccaccggtgcagcgtgtgtgcccacctcattattatctagctaagcggaacatgtgcttcatctgtgggatgctgaaggagatgagtgggcttcggagtgaatagtggccagtttaaaaaataacttcattgtttggacctgcatatttagctgttttggaacgccagttgattccttgagtttcatataataagactgctgccagtccaccatccaccataattccagtggtgaaatcttgtttgttactgtcattccccttccttttcgtttagaatcagaataaagttgtatttccaaata

SEQ ID NO: 689178 - DNA, 1094 bp, Homo sapiens
gccgggtagggctgtgacgctgctgctggaggtcagaatgtcatacccaggctatacccccaacaggctacccaccattaccctggatatcctcctgcaggtcaggagtcatctattatcccccttctggtcagtatccttatcctagtggcttacctccaatgggaggaggtgccatacccacaagtgaccaagtagatggctacccagagagctggaggctacacctgacgcactggaggttatccagacccactggaggctatcctggatgccccaacagccagggaggagctccaatcctatcaccggagttcctccaggccaaggaattatggagatccacaccaggtggagcaggcttaatctggagtatccacagcacacactatcacagtcttataggagagaggataccaagacacaggattccacataaccatggatggcattatcctggagagacagatgccgttcatcagatatcctggacggacaacactaacttaccctaggtcagacctgcacacagatgaactcagagtacactcaagggacactcatccagacaccagactgccacacacgcatgctactacagacgactgcagcacagtacatatacgacaggcaaccgacaggggtacaagggacccgactgaaccagggcaaaaagaggactgggggaaggacacaacaccgccacacaacaaggcatccagcggcaccacacaaatacacacagacaccacaaccaaggacacagtccaatacatgccaaaggaataacaacaaaaaaatccaaacacaaccaaaccgatgacacaacgcaaaaacgaaccacgccccaaaaagacacccaagcaaaacccacaccggaaccacgacacgccaggcgaaccagaaccaccgaacgcgaaggggcacatacgacgacaaaaacaacacaacaaccgaaaaagaaacgacccaacgaacgcaacacaaacaaaaaaaccaacaacagaaaaaaaacgcggccgcccggatagaccaggacaacaccggcgcacaagaccacacaagacgacgaaaaacgagacaaaagggaaaca

SEQ ID NO: 689179 - DNA, 120 bp, Homo sapiens
gcggccgcctactactactactgctcgaattcaagcttctaacgatgtacggggacatggagaaatatattaaattgtacagttttatgtgcttaattaaagactgtaaaacgcaaaaaa

SEQ ID NO: 689180 - DNA, 107 bp, Homo sapiens
tatacatcagctcggccgtgttttcctctgtatctacccaacatctgtcatgcagaattggtcccctcctctctgtggaggatccgccgtgcccaagacacaatgag

SEQ ID NO: 689181 - DNA, 155 bp, Homo sapiens
agcagaagaaacagttagcgcaagacacaggactttacaattcttccaagttaaacaactggattattaattgccagaagaagaattagttacagcccatgattgtaccagtcaatcgtagcaggtttcttctttgatccgtcagtgagccaagg

SEQ ID NO: 689182 - DNA, 85 bp, Homo sapiens
  misc_feature (40)..(40): n is a, c, g, or t
  misc_feature (44)..(44): n is a, c, g, or t
ggtataaaacagattaaaggtgggagctgcaaagggtaanaatnaaaaagtgttcctcccgggaaacagcactgttggtctgatc

SEQ ID NO: 689183 - DNA, 1512 bp, Homo sapiens
  misc_feature (1046)..(1046): n is a, c, g, or t
  misc_feature (1128)..(1128): n is a, c, g, or t
  misc_feature (1166)..(1167): n is a, c, g, or t
gtgggtaaaagaagggagagaggtttagacatatggcaggactgtgatccctggcccagcacagccaaagactgtcactgtttgcctttgcttgtcctgtctggatagaggcacctgccatgtgcagactagtggaggcttctagaggccataggtctcaatttgtgcctatttgggttctaacggttttcagggtatttgttttgcatagtcactttcctgatgttgacataggtggctgctgtgaaaatgctgtggatggtgtgacattcttgactgagctgggtggctgtggagagaccacttaaatcttctggttcagatttcacttacagacttagtaagatgtccacttcagagcccgccctctgtgctacttactctgggctaatcacacttctttagggtgagaacctgccttcctagaagtgactgttggtgcttgtcagtggccatacccttcatcatcctcattcagaggtatggatcgtgagttctgcttgtgaatactgtgagacagctgctgtctgcttcaggtccagagttccatgggtggagagagtaacccacaaccagctcactcctctgggcctctcctcctgcttaaagattctagttctcaacctctccaagttcatgagccaaagatcagaagtgagtcttctgaccagcccgcctccaggctgtctacagccccaaaaaagccaacacttttctggcagccctttttgttggaggttagagaaggcctcagggaccaacaggggccagatctagacattcctgggggaagtttgtctaaggtggacagggggaaaaatcaagaggcaaaaagccagtgtcctttggtgaccatgaagcaacctcagagccttagttctcctagaatgcagagagaagcattctggaagccatgggaacaggagctcgaggctgcatcctgaatgcatctgcatggccctcgcagggtgtttgtgaggatactggaggtcaggctacctcccaagcaagggcttggttgagaaggaacccattgctcatattgntgggggagctatgaacctgacatgtcagtggccaggactgagacagctctccctggtcctgtcattgcatggctaatttcangggagtctgaggtcatggctttatttttgctaagagannaagttcaaggatgttcttgttgtagggcctttgctaatgagcagttttttaattagaaaacatttctttctctctttgtgacgtgatggtattgctcatttccttctctacccaaactgaaagatcatcttcactttaaagcagaccatgcccttggcttgcccattctttcaggcagcacattgccacgttctaagcagatggccttccgtgatcccgttttctagttggggtaaccgagtcttgaatgccttactagtccggcaatctttgcactaagcttctggcctttgagactacaatgagttctggaaggggacaggtcattccctttcaatttgaatc

SEQ ID NO: 689184 - DNA, 212 bp, Homo sapiens
aattcccccaaggggggggggttaaacaggggcggggcctttcccctttttcccgggttttttttttcccccccggggggaggccttttgcctcccccccggggggggggccccctgaggctttcccccgagggcaagcgggggccggggcccggcttttgggccggccggcggaccccgggggtaaataacccctttttttttttaaccta

SEQ ID NO: 689185 - DNA, 152 bp, Homo sapiens
gcacgagaaaaggggaaaccccttttgcttggctctcattctctcttccctgccaccgtgtaagacgtgcctttcaccttacaccatgattgtgaggcctccccagccacgtgaaactgtgaatccattaaacctctttttcttgtaaatta

SEQ ID NO: 689186 - DNA, 279 bp, Homo sapiens
gacgtgagatgggtaatgtgctgacctcagaacaaagtttgagggaggcacattgtatgtgagaatttgaagtgcttatgaagtacaaaagcggaggccaggtgctcacatctgtaatcccagcactttgggaggccaaggcacacagatcacttgaggtcaggagtttgagaccagcctggccaacatggcgaaaacccctctcttactaaaaatacaaaaattagctggatgtggtggtgtgggcctgtaatcccagctactcgcgaggctgagggc

SEQ ID NO: 689187 - DNA, 152 bp, Homo sapiens
ttatctacgtctgatcttatgagcaacacagtaggatgacagaggaggctgagcatgtgaatgagtattgtgcatgctatgactgcatcccagggcgcactgaagcgggcggcggaaaacggaacatattgatggccgagaggaatatactt

SEQ ID NO: 689188 - DNA, 415 bp, Homo sapiens
actgcatccaacgtacgcagcggcaaacgcggggtccccttccatgctgtggaagcttgttctttgctcttcgcactaaatcttgctggtgctcactctttgggtccgcgccgcctttatgagctgtgacactcaccgagaaggtctgcagcttcactcctgaagccagcgagaccatgaacccactgggagggaagaacaactcctgacgggaggaaggaacaactctggacatgctatcttcatgaaccgtaacactcaccgcgaaggtctgcagcttcactcctgaagccaggaagaccacgaacccaccggagggaacgaacaactccagatgcactgcctttaagaactgtaatactaaccacgaaggtctgcagcttcactcctgaggccagcgagaggggtaccgagc

SEQ ID NO: 689189 - DNA, 338 bp, Homo sapiens
cgatacatgccttttctctcctgtcacaacatcttgaagaggatgagtcacttccttaattgccacaatacacaggccaagggcaactggtcacccacaacccctacttgtatgcctaatgccataccaattgccttcttcttcatctgtaccaacgtaccctacagtctgcacggtgcaagcctcctgggcttgacctatctgtacccacagctgggggccaggcatgccccctctatgcttcccatcacctcatccctctccacgtacacaacaaatcctctaagggctgaaaatcaagcccccacctggacacagcgtgcccacagatggcatac

SEQ ID NO: 689190 - DNA, 139 bp, Homo sapiens
ctagcgtaggcactagtgtaggctgtgtgtggtgtgtgcgtggtgtgttatatggtctgtgtgtgtggtgtgtgtgtgatgtgtgtgtggtgtgtgatctttgtgtggcgtgtgatctgtgtatgtgtgtggcgtgtgc

SEQ ID NO: 689191 - DNA, 174 bp, Homo sapiens
agacgcgagcgagtaagagtaatattagggatcattacagaaacgtgcaacaatgagaaacaatctggtcttacctgcgcctctcctaccatggtaacagctaggagctcgcactatatcaggatttcagtggttttgtagtactagtcacatcccccacctccgtggcgattc

SEQ ID NO: 689192 - DNA, 975 bp, Homo sapiens
  misc_feature (10)..(10): n is a, c, g, or t
  misc_feature (77)..(77): n is a, c, g, or t
  misc_feature (85)..(85): n is a, c, g, or t
  misc_feature (104)..(104): n is a, c, g, or t
  misc_feature (129)..(129): n is a, c, g, or t
  misc_feature (144)..(144): n is a, c, g, or t
  misc_feature (177)..(177): n is a, c, g, or t
  misc_feature (184)..(184): n is a, c, g, or t
  misc_feature (187)..(187): n is a, c, g, or t
  misc_feature (240)..(240): n is a, c, g, or t
  misc_feature (246)..(246): n is a, c, g, or t
  misc_feature (252)..(252): n is a, c, g, or t
  misc_feature (256)..(258): n is a, c, g, or t
  misc_feature (261)..(261): n is a, c, g, or t
  misc_feature (270)..(270): n is a, c, g, or t
  misc_feature (289)..(289): n is a, c, g, or t
  misc_feature (314)..(314): n is a, c, g, or t
  misc_feature (318)..(318): n is a, c, g, or t
  misc_feature (325)..(325): n is a, c, g, or t
  misc_feature (329)..(329): n is a, c, g, or t
  misc_feature (336)..(336): n is a, c, g, or t
  misc_feature (349)..(349): n is a, c, g, or t
  misc_feature (353)..(353): n is a, c, g, or t
  misc_feature (355)..(355): n is a, c, g, or t
  misc_feature (360)..(360): n is a, c, g, or t
  misc_feature (370)..(370): n is a, c, g, or t
  misc_feature (379)..(379): n is a, c, g, or t
  misc_feature (387)..(387): n is a, c, g, or t
  misc_feature (406)..(406): n is a, c, g, or t
  misc_feature (409)..(409): n is a, c, g, or t
  misc_feature (420)..(420): n is a, c, g, or t
  misc_feature (448)..(448): n is a, c, g, or t
  misc_feature (472)..(472): n is a, c, g, or t
  misc_feature (538)..(538): n is a, c, g, or t
  misc_feature (751)..(751): n is a, c, g, or t
  misc_feature (784)..(784): n is a, c, g, or t
  misc_feature (786)..(786): n is a, c, g, or t
  misc_feature (814)..(814): n is a, c, g, or t
  misc_feature (821)..(821): n is a, c, g, or t
  misc_feature (823)..(823): n is a, c, g, or t
  misc_feature (827)..(827): n is a, c, g, or t
  misc_feature (838)..(838): n is a, c, g, or t
  misc_feature (852)..(852): n is a, c, g, or t
  misc_feature (862)..(862): n is a, c, g, or t
  misc_feature (864)..(864): n is a, c, g, or t
  misc_feature (874)..(874): n is a, c, g, or t
  misc_feature (891)..(891): n is a, c, g, or t
  misc_feature (919)..(919): n is a, c, g, or t
gggaggaggnacaggaagggggggaccctcccccagactctactcagattccaatgagcaccagggagggaaaaganggaaaacnaaaaggaaaaacaaaaggnaagccagaacaatccgcctagcccngcaggaggatctggngtgacagccaagggccagggaaggaaggaggancactctncanccgacgaagccaccggccctgcctgcttcaggcttccaggagcttccccaggnagcggngggggngggnnnggngcggcgcancaagggccagacggacaangccatcctcaccatcaatgcgcagnaggncgcccgnggcngcccgancctcgcccaggancacntncaccngggggtgctnggggggggngagaggcnccaggggcgcactggaaangcngacaaccttcncactgtccttcagggacacagagcacangccccccgtgacactgcggatganaccggtgtgtgccaccacctgtgtatccaggtaggtgtcccgcacctgcacctgaatgtcagtggntacccagtcgctggagttctgctcgatgcctgagcctggcgtgtgttggttgtagccaccaggggagggagctccaggtgtcataggactgtagccaacggggctcgggctggggctagcctgaaaggccatgggcgacggtgtagggtggtagctggctggggagtgggtattctggtagcctgctgggcttggcgccacctggtggtagcnctgggggctggggctgggctggtaggaaccttntngggagggggcagcatagggagagaactngtctgtntngtanaaaaccggcgnccctggcgtctgcnggttgtattntnggttgacctntggggacgaggggtctnggttgccaggtgtttggggattgggggntccccataggcttccggggacggggtgggctcatcatcgaaagcatactcatattc

SEQ ID NO: 689193 - DNA, 468 bp, Homo sapiens
  misc_feature (32)..(32): n is a, c, g, or t
  misc_feature (89)..(89): n is a, c, g, or t
  misc_feature (115)..(115): n is a, c, g, or t
  misc_feature (127)..(127): n is a, c, g, or t
  misc_feature (130)..(130): n is a, c, g, or t
  misc_feature (138)..(139): n is a, c, g, or t
  misc_feature (151)..(152): n is a, c, g, or t
  misc_feature (158)..(161): n is a, c, g, or t
  misc_feature (166)..(166): n is a, c, g, or t
  misc_feature (185)..(185): n is a, c, g, or t
  misc_feature (217)..(217): n is a, c, g, or t
  misc_feature (220)..(220): n is a, c, g, or t
  misc_feature (224)..(224): n is a, c, g, or t
  misc_feature (226)..(226): n is a, c, g, or t
  misc_feature (252)..(252): n is a, c, g, or t
  misc_feature (254)..(254): n is a, c, g, or t
  misc_feature (271)..(271): n is a, c, g, or t
  misc_feature (276)..(276): n is a, c, g, or t
  misc_feature (278)..(278): n is a, c, g, or t
  misc_feature (304)..(304): n is a, c, g, or t
  misc_feature (315)..(315): n is a, c, g, or t
  misc_feature (322)..(322): n is a, c, g, or t
  misc_feature (327)..(327): n is a, c, g, or t
  misc_feature (341)..(341): n is a, c, g, or t
  misc_feature (391)..(391): n is a, c, g, or t
  misc_feature (450)..(450): n is a, c, g, or t
ggttaagtgggcgtcttgcggctttgttatgnatatattcttgtgcctccgaaacatggcttttaaattttactccgtgttacgggaanggtattggggctttcttttttttccnttttcccggcgngcncctttaannaaaaacaaaacnnaacggnnnngggcngccttctctggcatgctcnggccggggggggtaccgtgtcctcttccaaangancaanangctctgcaggggctgtgcctgtgaananatcttggtattggaaanatcancnctggcagggtgggggcagcagaaaantaggggtctanacttgancaggnggttccagcctctnctggccggctaccctcagacccctgctgagcttcaccatccttggggganaggctaggctgaaggtggtggctggggctgtccacctgcccagcctcccggggtcagtntgcagggctgtggcagaa

SEQ ID NO: 689194 - DNA, 516 bp, Homo sapiens
tatcctcactaaagatctcgacacatcgttaccttgaaactgattataggatcatgcccacaatgatccaagctactggccgtctctatataaggggtgaagggtctgtgctagatcaaaaggcacggggtggcgatgtggcagagaagttgcttgtaggggagaccttgcttttaacaggcttctggaaaagctagggaaaagtggttgcccgctttccccctttccctccccttcaagcaccgattgagatatgggctttattattaagagctgctataaaaacagcttgctcaaatgttaagagaagcccaggggtacttcaagcattccttcggatgcttcactccagaaagagggagttgaggcaagtcctcattactaataaaaatcaggtgaggctgacacttctcttgaccttaggataatagcgctttgttgtctctcctgccacaggaaggctccatggttgtcctactttaagccttcggtgccttaagtgagggttacttgggg

SEQ ID NO: 689195 - DNA, 129 bp, Homo sapiens
ggatgcagtagactgagggcaccacagctttggtggagcggtgtcaaagaggacagtgaaatcctgggcaggagttcctgatgccgatagtgccgaagtactccatatccagtgtagttctccagtggt

SEQ ID NO: 689196 - DNA, 1070 bp, Homo sapiens
cgcggtcgcggcctgctagtaatgtccgtgagttgagtgtcttgcgggcgctgctagcgtggacgaacaagctgggggctctggagagtttatgcgacgcaacggtctagaaggaagaggcgtggtagagaggtggtaacagtgcgtgagggtgatgatttgtcgtcaagtgctgtgtggtgtcgtgtatatattgtgtacgtgatgcgcataatggctcttcgtgcggtgtaggcgtcggtggttggtgcgatggaggaggagcgtggtggcgggcaacgtcgattgtgacgtgttgatatagtgggcagtggaattttgttatttaatgtggtggtaagatttgttggtttagtggtcgctgttagcggtgtggcatttggaagacagtatagttggcgttagtagatcatggattaggcaagtaagtatgtgttgtgcttcggtttagtggtgtgtttgcaagtgatctctgttgtggtgtgttggattgatgaatgtggcaggggagaattgttggctcttggtgtcgtctgtgtgtgtgtgcgtcacacgggcctccaacaatgatgtgatggcgcgaatgtgttcgttgatgattttcatgtcaccagtgttgtgagaaaatagatgctgggtgtgcagtgcatggcttgaacgtgacaatctttaaggttgtatgtctcttatgctttggcttctgttgtgagatgaatggcttgcttatgatactacaaggagctgcagaagcatgcccttgtggaaatgagctggatgtttacaatgatgctgtggggcgttatgaaagcccggtagttggcctgtggggagcttagagcagggacaaatgtccacacttgctctacggatagcaaagtattcaggttaggaggaatgaagttctggtgttctacttgtcatcagcagcagtgtctatagttaatagtaatgtattatatatttcaaaatagctacaccaaagagaatctttaatgttcttaccgcaatcgatataagttgtttcagctctaataaatatgctaatgtagcctgatttgctcattccacag

SEQ ID NO: 689197 - DNA, 806 bp, Homo sapiens
  misc_feature (1)..(1): n is a, c, g, or t
nacgtgtatgaattcagaagaataccctctgtgcgtttaaaggaaacagggttgtcccccccgtgtggtgtgtaaaaaccgggtgagagggcgccccctagttctgtggcgggtccggtgcggtagccccccaccacagtgtgaagaagcgggtctccgtcgcccagcaccaccacgcgcagggtaggaagccttctcatccatagctcacactcggtgagcagggtcccgttcaagcagttttggatcgataatatgagcccaccccggtatctcgcgaggcgggaggtctgcacacaaaccacagcgcgggcacaagaggaccctcgaggtgctgcgaccacaggtggctcaccaaggggtgctggccacgaagacccacaaaagggcgcgtaagacaattctcttggcacgccgggcaaggccgccacgccccccctgcctatggaaccaacgagtgtgagatagatcacgcgcattgccagaaaccatgatgcgtcctaaaacaggcgcgcgccattacagcatggcatagcctaataaacacggggtgagagaggtgaccacggacgccgtgtgttcaactcctcctgccaggagcaaatatgagactaacattcattgtgggccacccacttggcgattcatgtttttgggcagcgacgcactatctgatagtagattgaattgtattacaaaaccgcgatcatgttagtggcgagaaccatctgtgaccaccaatacttgcattactctacatctgggcggtacgccgctgtgaaaagtgtcacgaccaaacagtagca

SEQ ID NO: 689198 - DNA, 1423 bp, Homo sapiens
ccaggagagcttcccggagtcgaacttcctgctggctgctctgtgaccgcttcccggtctctgaccctcttggccgaagtgcccagctaggcgggcgcgggcctcagacaatacaatgtgtgggtgaagagaacatgtctctaacgaaaccggctgtcaaagtccagtggaaaatcctgaggagagatgaagaccagtagatacaccgctgcgcacgggagtcccttagagcacacctagtcaatggtcgacattgacatagaaacgagttgatccgccaaaggacatcgcatcacgtgttcgcacaatgccagagggcgtagcagtgcaatttgcagagcgcccagtcttcttcaattgcacacgcgcacacgttagcgcgaggctctacatatctgcataggcatttcttgtgacaccaacaatccgtctccattctgaacacagacgctctagggcgaatcaaccgtttacgcaacttcacctgcgtctgcgcgcctagccatgccttcgttcacagcaaaacctgcgtcgttgtgaccgtggataatcccttgcacacggcggaacgtacagcacatatataggcaagagcccacgataaggaaacggccagaaccagcgggcattttttgaaggacatggcaaaccgcattccctatgcaatacccacacgtgggacaccacgaagctcatctaaaaaaattctcggcccaacggacggcaggaccgtccataccgtaccgttcatcacggcacctgggcagacccctatggccgcttttcggcaacgggtttgtcgggcacaccccaagctgcaaattccagcgacaacaagcctagagtctcgaactttaagtttcccaacctgcagtttgacgcttatccgcccaactcggcgggagcacaccgcacatgtgcggcgtctgaccgacattattcgcgcgtccccgtacatgtcgcacacttgcccctcaatccacgaggaccgcaaacaacgcacaccattcatggcgccattcagcacggcactcagacagagcacacctttgtgacagcggacgacctttcgcggcgcaccctgcgcacaaaacagatgccgggcaacaacgagcggggcacgcattggcgactatcagctgcgccactcagtgccaagcgcgccttactaccaaacggactccgacgctacaccaccaatgggcatcaacgattatagaaacaacttcgaccctacttatcaacttaatcggtcgcaccaccataccaagcctcatgtattccgacactatacacgccagacagcacgcacatgatcagcacactcaatgagttggcagcagaacaccccacatataatatagcatctcactgtagctgcaccactcactcaagcactgagacttacgcctcccaccatcgc

SEQ ID NO: 689199 - DNA, 232 bp, Homo sapiens
cctcggtaaagccaacatcacaataaagcaggaagcgcatagttatagtttcccagtgcatctaagtcatgtttactgcatattgcagtccactaaatgtgcaatagcattatgtctaacaaatatacaaaccataatttaaaaatatttactgttcaaaatgctgacacagaaacgcaaagtgagcacatgctgttggaaaatggtgccaaatagacttgcctgatggcag

SEQ ID NO: 689200 - DNA, 371 bp, Homo sapiens
ttcatgtccaggcctcatgcctagaaaaggaatcccaggattttccctcctgtgtgttttcgtcttgctcttcatggtccatgatgccagcgtgaggttgtcagtacaatgaaaccaaactggcgggatgaaagcgctggatatgaatcatgtccagtgctttcatgccagtaagaaactacgaaccgcataagtttatagaatgagctgattcccgaggcacatacatctaacagattacggatgaacacgagtatgaaagctcccgcagtggctcagtgcgttaaggacctggtgtctctgtgaggatgcaggttccatctctggcctccctcagtggcatgaaggccctcgacatgaagggtaccgag

SEQ ID NO: 689201 - DNA, 98 bp, Homo sapiens
  misc_feature (57)..(57): n is a, c, g, or t
  misc_feature (65)..(65): n is a, c, g, or t
ggaaacctgaaaattctacccacctccccccacccccgattataggaaaagagagtngatcactnccagggtctctgacttctgtgacctggaaatca

SEQ ID NO: 689202 - DNA, 152 bp, Homo sapiens
cactaggagcgcgggcggtaacgccgcggggcgcggggtgggcgcggccgacctggtccctgagccggacggcgaccccggacctcccgcgcgccccgcacccgaccggcgcagccggtcggtattgtagcactccctacgctcgcttgctc

SEQ ID NO: 689203 - DNA, 230 bp, Homo sapiens
cagcatctagactgttggacaagattggagaatatacagagcaggatagaagagggaggagtcaagatggctttgaaaatttcagcttggcttctctatgggtaagaagaatccattaacttgtgataaggagcactgaagaaggatcaactttaggataaagttgatgaattttgctttgggcccatggcatttaaagtgcttaggtgaatcatccatttatccatcca

SEQ ID NO: 689204 - DNA, 270 bp, Homo sapiens
  misc_feature (133)..(133): n is a, c, g, or t
ggggggcccaggttttttttccccccaaaaaaacccccccggggaaaaaccccttaaattttttagggggggggggcccttcccagaaagtttcgcttttttttgacacccaagaatttttccccccaaaaancttttttaaaaaaacgggaaaatcaaaagttttttgggccccccggccccactggttttcaaaaaattttttttaaaacccctgggtttccccaaaggggggaaaggttccgtttccctttaatttttttgggccca

SEQ ID NO: 689205 - DNA, 312 bp, Homo sapiens
taagcaacatcagataggcccactatagaactgtatttaaaggataataggttaattaagaaactaggtaccatgtctcggccgggggtggtggctcacgcctgtaatcccagcactttgggaggccgaggcaggtggatcacgaggtgaggagatcgagaccatcccagctaacatggtgaaacctgtctctattgaaaatacaaaaaaattagccgggtgtggtggcgggacgtgaagcaggagaatggcgtgaacccgggatgtggagcttgccaggagccaagattgcgccactgtactccagcctgg

SEQ ID NO: 689206 - DNA, 894 bp, Homo sapiens
  misc_feature (1)..(1): n is a, c, g, or t
  misc_feature (69)..(69): n is a, c, g, or t
  misc_feature (72)..(73): n is a, c, g, or t
  misc_feature (77)..(77): n is a, c, g, or t
  misc_feature (79)..(79): n is a, c, g, or t
  misc_feature (81)..(81): n is a, c, g, or t
  misc_feature (92)..(92): n is a, c, g, or t
  misc_feature (123)..(123): n is a, c, g, or t
  misc_feature (126)..(126): n is a, c, g, or t
  misc_feature (131)..(131): n is a, c, g, or t
  misc_feature (134)..(134): n is a, c, g, or t
  misc_feature (139)..(139): n is a, c, g, or t
  misc_feature (144)..(145): n is a, c, g, or t
  misc_feature (170)..(170): n is a, c, g, or t
  misc_feature (176)..(176): n is a, c, g, or t
  misc_feature (179)..(179): n is a, c, g, or t
  misc_feature (201)..(201): n is a, c, g, or t
  misc_feature (221)..(221): n is a, c, g, or t
  misc_feature (265)..(265): n is a, c, g, or t
  misc_feature (277)..(278): n is a, c, g, or t
  misc_feature (280)..(280): n is a, c, g, or t
  misc_feature (294)..(295): n is a, c, g, or t
  misc_feature (298)..(299): n is a, c, g, or t
  misc_feature (307)..(307): n is a, c, g, or t
  misc_feature (854)..(854): n is a, c, g, or t
nggttgatacaaaatgtcaaaaaaaaaaataacaaaaaaatagaaaatagaaaaatgtatttacaagtnagnnacgntnanttatgatgagnaagagcacaagggcgcctggcggctataatncangcgtnggngcggncggcnnctacggcgccgccctgcgggggcgncgcctnganaagaaagaaagggccacaaggnttgaactcttcatccgctantgctacactgatcaagaaccaagtaagggctcctgaagtgccangagtctatgcannantcagcacaaatgcnngannagtttgtnactgcggggtcagttgtgaaggggaaggacagcagcttatccatatacaaggaagccacagtaaactgctcgacatgctcaaaacgacagcaagcccctgtcagctacacagcgtgatcttagcaggatttcatttttgtttattcatatatatctatgtgtgtgtttatatatatatatgtacgtatgtataaaaaccgtgcccttgttcactgccaacacaacatctgggtggacatgaactcattacaacaaattcttatgtggatgttgtaagaagtcactcaatgtctgtggatttaataagtcacttcacaccacagaaaatatttaataaatccaaaaaaaggaaagaagaatataacgacagaagagcttctgtctcagttctctgaaactgagtcccctataggaaactggtcccaaagttctcgaggggtcattgaagaaacttcggtttgctaatttttttcatccttttagtgttcaaaagttctagaaagactcctcgctgttttcagtttttaaacagtcaaatctccatctncccccagaaggtaacagtctggtgcagatccataaaaacg

SEQ ID NO: 689207 - DNA, 1415 bp, Homo sapiens
  misc_feature (1415)..(1415): n is a, c, g, or t
taacaagcttaagaatgaacttattatagtatcaatgcggtgattcacaaattactcaatatttcctaaagaaccagtgaagaaactccagaaacccattcttacacgaggcccgtgtgtggaaaaaatccaagcgaggaataatgggattattaccagccaggtgactttcaggaggaccaccattattcttacaatggtgtcttccactattggttattctgagaaaaatggttattctgagaacgacactccaaaaacaccaatgttctacctccaaatacggcttaccacaagcagagtcttttcctggtagacattctactgggtggcttccagaaccaaatcagcgtgcgtgagcatttattgccaaggacctatacaagtgaagtgatatttcgggacaccctcgaatagtgccaatataacttctcttgggggggcataatgggatacgtggtgtggcccaaaagaatataatcaaccgtaccgtggtgtaatcacaaaagtgtgaaaccctccctggaggagactcagagtgtgaaacgaaaacaatattcgtggggattaacaagtgaccatataacactgcggggaaacgcccagaacaaatttaaaacacccaaaaagaaagaaaatgtcccaagaaagagtagcatcacatcaaagggccacaatttcaataaagcacggacgtagacacaacaataagagatgagtaggatccccacacgaagtgtggagccaaaggggcaaaaccgcgcgatgaacagacacgaaagtgtacgcggaaacaattagagagaagaggaaacaccacacagaaaagtgacaaagaggacgaaagggccccaacaagaacatagcagagagcccattaatacaaacaaaagccccgagaaagccgtgggacacccccaagggatgcaggacgatattacataaggaaatgcgtgcccccaagataaaaaacacgaaaataaatctgatataaacacaagagacaaccacaacaaggcggcaggggccagcaagaagaaaaatcaccaccgacgaagaggccacaaaagaaaaacgagagaacaccagcgatattataggacacaagaggggccccaaatagagcgcgcagaaaacagaacagaagaccgagacgcgacgaaatccacagaaccgacatagggaaacacgacgacgaagcaaacaggagcaagacaccaaacgggaggaggacaaaggacaaaccacacaacaaaataagcccagggaaaaacagtcagagatcggagacagcgaaaaacgacgaaaaacacagaaataacatagacaggaacagaacaaggggagagcgcgccacaaggcagtcagcagagcaagaaagaagaacaagcagcagcacagaacgagaacacaan

SEQ ID NO: 689208 - DNA, 103 bp, Homo sapiens
  misc_feature (56)..(56): n is a, c, g, or t
gacagacgagcactcataaactgtctgaaaccccaggcagtaaagcagagtttcantccctgtctttaaactgggggtatgtccactctagcaagtagacgtt

SEQ ID NO: 689209 - DNA, 838 bp, Homo sapiens
  misc_feature (194)..(194): n is a, c, g, or t
ccgcggggtcccgccccgcattccaggggtgccacccaagggtcgccacaaaaggggaaatagggggcagcgccctctgtcgaccccgcgcgggccaacgaggtgagccgcccccctcatggatccctggggaggatgctctcgacccatcttggaaagatgggaacacgtcttggccgcgtccccaaaacatngtgggggagaggatagcgcccaaggacgggggtcccccaaagggcggcgcccgccaacacggccacggctcattgggcaatacagactctctctaaagagcggctccaggccgcttatatgtcccaatatctgcgggcaaacaatcatcgtagagtccactctattcaagggaccctccctccccctcctccctgtgtacaccgcagtttctctccataaaaagcccgttctttttcaccaatacaaagaaaagtctccccccaagaaattacaatttttcttcgcccaaacaatttgccaaggaacttcatagaacgcttctctaagaaatcccccgaggtgaagagatttgtacatatacacaaacacgattttgtcccactcacatacgccacccttattgagaatacgcccctctgaacagcactcctttcctgaacccacggtgggagtgtctttaatattgcattgccggtagcacgaccgcgccgtgaactctgtctatgttcgggtggagatcgcgccaccaaagaggctctgtgaccccctcgcactatacaccacggaagggggtacattataccattctgagacccccccggggggagaacaaaataaagctttcccccagcgtaacaaaaca

SEQ ID NO: 689210 - DNA, 706 bp, Homo sapiens
gatttcggggcggtaccaagatggactcctcgcgggccgacagcagctccggcggcgattcctcctcctgccggacgccgaggcccagctggatcgcgagggtgacgccgggccggaaacctccacagctgttgagaaacaggagaaacctcttccaagacttaatatccattctggattctggattgtggcatccatggtggtgacctattatgttgacttctttaaaacccttaaagaaaacttccacactagcagctggtttctctgtggcagtgccttgtgcttgtcagtttatcaattgcattttacttgcatagtctacctggaatggtactgtggaatcggagaatatgatgtcaagtatccaagccttgatacccattaacatgcctcatttattgcagcaggaatttgttcaacatgtgctttatggcatgtgtggtcggtatatcagtccattgtagtagtaaccagttaatggggagtgtcaatgtctatcaacactccttggattgatttccgacagagcacagagtctcctatgttgcccaggctgtctttgaactcctggggatcaagtgatcctcctgcttcagacttcgaagaaagttgggaaatacaggccacgcaacgtgacatggctggacctcgtcacttcgaacgtgactggttcaacatccaggtaactgaaaggctgggcaac

SEQ ID NO: 689211 - DNA, 372 bp, Homo sapiens
  misc_feature (66)..(66): n is a, c, g, or t
  misc_feature (74)..(74): n is a, c, g, or t
atcctgtaatttttcctgtacatacatgcctatgatagagtttaatttatcaattgggcacagtangagattancaacaataactagtaatacaatagaacaattataacaatatgccagcatcactgctgtcgcactttggggtcattctcaagtagagttagggttcctggaaaaccaacactgtgaaactgcaacaggcatgcttggccatgcttatgtctctaagaactcatcattagtattttcagtttgtagaaaacatacagaaaaacttctgaaaacattactggttctgctgtttacattagggaaagattatctgttgatggttatattggtgtttgagtgttttaatgataactgagatgg

SEQ ID NO: 689212 - DNA, 470 bp, Homo sapiens
cggcacgagggttttttttttctttctataatggacttaaagacaatgaaagtttatttatcaagtccaaaatgagcactacgcattggagttggctttcctccaaatgatgtatttggaggaaaatacatcaggaaaccggatgtattccatcttgtggtccttttatcttcaacacatggcttccaagtggctgggttcctctgcagcaagctgtgggaggggaaagagagggtggagaagatgcacccatttcttaattgctgttgcccggaaataacacatatcacttcctgtcatgttccattcattggcaagaacttgtcacatgacttgatctagaagagaggagtacaaatccatcaagggtcagcagagatctgtgctcctcgttgtcctcaatctgggacccaggctgatggagcttccaacatcacgtacgaggagaaggcggcggcggcggcggccgc

SEQ ID NO: 689213 - DNA, 451 bp, Homo sapiens
  misc_feature (10)..(10): n is a, c, g, or t
  misc_feature (400)..(400): n is a, c, g, or t
  misc_feature (420)..(420): n is a, c, g, or t
attcggcacnggaatgacacacaaatttgtgaagcattccataaaagaaaacctaaatagacttataataagtaaatagattgaattaataatttaaaaacttgtcacggccgggtgcagtggctcatgcctgtaatcccagcactttgggagtctgaggcactcggatcacttgaggtcaggagttctagaccagtctggccaatttggtgaaaccccgtctctacgaaaaatataaaaattacccaagtgtggtggtgcacactggtaatcccagctacttgggaggctgaggcaggagaatctcttgaacccagggaggtagaggttgcagtgagccaagatcgcaccattgcattcaaacctggggcaacgagcgaaacttccatcttcaaagggnaaacccaaaaacttgaaaancaagttcttgttcacaagattaagcttttgg

SEQ ID NO: 689214 - DNA, 1265 bp, Homo sapiens
gttctagatcgcgacggccgccctttatttttatttttaagtaaagacaggatttcactatgttgcccaggcgggtctcgaactccgggcctcaagtgatgcgtccgccgtatctcaaaataataagagctatttatgacaaacccacagccaatatcatactgaatggacaaaaactggaagcattccctttgaaaagcgtggcgcaagaacagggatgccctcatctcaccactcctattcaacacaggtgttggaagtcgggccagggacaatcaggcaggagaaagaaataaagggtatccaattaggaaacagaggcaagtcgagataatcccgtgtatggcagaatgacatgatggtcacatgtagaaaagtccataccgtctcagcccaaaatctcctaaagctgactaagcaacttcagcaaagtctcaggactacaaaatcaactggtgcagaacaccacaagcaatcacctataacatcaaataaaacagacacacggagaagagcccaaatccaggcaggtgaaccctcccattacaacaaatgggcacacacaaacacaacccacacaaacacgggcggagcgaaacaaaaaagagtactccccctagaaatggaccccaaacaataccacgccacaccacagagaacacatgtgacacacaaagcggggaaccaataatcaacaacaccccacacacacacgccacagagacacacgagacccaacgacaaacacacggcacaaagaccgtgcgaaacacacgcggcaccaaagaacgacaacactaatcggacacgccgagcaccccccaaccacctacgagcggctgcacacacaacaacgtgaggacaacaaagatacccacaccgaactatacgacccacagaccgacaccagaacaaccacaaccagcactcaacagcagcctcacaccacgaccacaacagacgcaacagaacgacgaagacttcaggcaacaagagcacaacgaactgccgaagaacgatatacacgggccccccccggtaacacacgcgcagccgagatgacacgcaaccacccgcaacaagacccacacgacgcacacacacgaacacacacccacgcacacgcccccagcaacacaaagccccgagcccacaaccaccacaccgacggagccacgcaccaaccacaagcacacgcaccccgccacacacagtcagcacacacacaaacacaccgaagcacaagtgacgcagcgccagacacc

SEQ ID NO: 689215 - DNA, 362 bp, Homo sapiens
ggaaatcttgaagctatagcatgtgtgacccaggcatacacacattcacttgttaattaaacattcattgatatataatgccgagcgcattggttctacacctgttattccagtactttgggagatggaggttggccaactgccttagcccgcgagtctgagaccagcctggactctgtgaacactcctgccgtcttcaaaagtaaaaaaaaatagccaggcatcgtggtgcctgctgtagtcccagctactcaggaggctgagaggtgggaggatcacttgagcatgggtggtcaaggctgcagtgggccatcatcgtgccactgcagtccaacctgggtgacagggagatcctgtctcag

SEQ ID NO: 689216 - DNA, 392 bp, Homo sapiens
cggcacgagggttttttttttctttctataatggacttaaagacaatgaaagtttatttatcaagtccaaaatgagcactacgcattggagttggctttcctccaaatgatgtatttggaggaaaatacatcaggaaaccggatgtattccatcttgtggtccttttatcttcaacacatggcttccaagtggctgggttcctctgcagcaagctgtgaaagggggaaaccgtcccctcgcccgtcccgctcgaccccagccccgcagctgagcgggcacttctgggccgcccgccacccgcacggtctgagatggaacgttcataatttaatcaaatccaaagaagagatcaatgcgcaaatttgaaggggcagagaagaagacggtgact

SEQ ID NO: 689217 - DNA, 908 bp, Homo sapiens
ccttccgacatgctggctagacatacgtgtgcagcgcggccgcagttagataatctgaactgatggtcaatagccagataggctagcgatatctggtacatgactaagtgcattggatcctcaggaataaaaaatggccgggtgcaatgcgatgcgtgctagaacatatatctcaagaaggcaagtctccgacgaggcatagagggggagtctattcaactaggactcacgaaagtcagaagatgcgatcatcaacattgaccgtcgccccggaactggaaggatctgaacgatcaggtcttaattaacagagcccggtgacctgggtaatagcagatttttagcatccaagaaacacaaatttcctttaaattttgaccacttaccggaaagaaagcaagtgagccccagccagaaagaagcagatggaggtctgaagtctttggagagaatcctgtgaacaggtgctttaagagcctatgtgaacagaccattattccaacggttctgtactgtttatgctaaaatatcgatgggcaacagactattatggcatgtatttgaaagccaccagtttccagcctaaaaaacttctgaatggtcgtggagatcagagtgaagttcaccatcaacaccactacagccaggggttgcgctgcttaagaattcaggttccctattaatgcacgatggcaatgttccaggggtaggtcatcaacgatgtcaggcattcatcactggttcgaattgaagccaaatgccagggttattaatcctcggcttgcaaatggttccccccgcattgtgaactttaccagtcgatcccgcaggctgcgcggttccatacccccaacgtgacacattcctcaatgcaaagcagtacgggggccctgcaagcgggcccacag

SEQ ID NO: 689218 - DNA, 451 bp, Homo sapiens
gtgcctcatgcctgtaatcctagctctttgggagggccggggtggggggatcgcttgagctcaggagttcgggaccggcctgggcaacgtggcgggaccttgtctctactaaaaattgaaaaaattagctgggcatggaggtacaaacctgtagtcccggctattcaggaagctgaggtaggaggatcacctaagcttgggagacagaagctgcagtgagctgtgattgcatccctgcactccaccctgggtgacaaagtgagaccctgtctcaaaatcaaacaaaaaataaacaaacaaaaaaacccataattcaaacacatgggggctacagaagtttaaaaaaaaagatagtcaataagagaaaagtaacctctaaaaggctatcattaatatcctcaaagagaaaatagatgatacaattatacataaaacaagaagagagtgcaat

SEQ ID NO: 689219 - DNA, 504 bp, Homo sapiens
gtgcttaaaggttggggacagttactccgcagtgttaagacgtacatatggaagccatcatctgagtagcataatatactccctatagtgccacaggaacagtctttcttcacgtagaaaggtagtctctcttaaccacagcataatattctttctctagaaatctttcttattaggctcaatttcgctctctgatatggttaggctgtgtccacaccaaatctcatcttgacatttccacgtgtagtggcagggcacccggtgggtagtcactgcaatcatggggcaggtctctcctgtgctgttcttgtgatagtgagtaagtctcacaatatttggtggttatcactaaggggcagttttcctgcacaagctctctttgcctgctgaaatccacgtaagatgtgacttgttcctccttgccttctgccacgattgcaagggctcctcagtcatatggaactgtaagtccaattaaacctttttcttatggaaccaatcact

SEQ ID NO: 689220 - DNA, 225 bp, Homo sapiens
  misc_feature (86)..(86): n is a, c, g, or t
atgtacagctcacatatgcatccatacacttgtgtgtggctggtgtatgggtgagcatgcacatgtgtatggatgcatatgtgagncgtacatgttagaggacatggcacgttcgatcgcacagggactggacgtaatcgccagtaaaagtgagaggatgctttgtttccttcttttttctctcttctgcgtttttctcttttttctttcgttctttttccttgg

SEQ ID NO: 689221 - DNA, 313 bp, Homo sapiens
ctagacatacaatgaactctacaataattctatccttccaaaattcagagtaaaattcatgtcctagaaggtataccttttcattcagtgcgtgggtatattccctggtaaaactcatcttagtcaagaagttatgcacttgagaggcatgtaaactggcaattctgaaaagtagatcttattatgcccattttacatatggaataactggggcatagagaggtaaagtattcgagatcaggaagagacaggattcaaacctaggtccatctgattacaaagccacacgctctttccactacaacctgccggt

SEQ ID NO: 689222 - DNA, 194 bp, Homo sapiens
aatgggccctttgggaaaatggcccaatctttccccgcttttttatagttaatattaaaaaccctttaaaagttttcccttccggttgggggcttttttctgtccccccgaaggggccctgttttttgtttgaaggccgggcctgatccccctaattttagggttttttttaaaaaaaggttgcctttccctta

SEQ ID NO: 689223 - DNA, 220 bp, Homo sapiens
gtgagcaaacagcagtacaaccatttacatggaatttgcatcgtactgagtattgtgactaaccaggaggtgacttaaagtgtacgggagaatgtgcgtatgttgtctgtacgtactacacgattttatgtaaggggcttgagcatcctgggagtcttggaaccaatcccacacagatactgagggataactataccacatgaggagcgatactccgccg

SEQ ID NO: 689224 - DNA, 129 bp, Homo sapiens
tctagagctcccgatggatcacggaacttttttggtggtgtcccttgaagtacaaaagcttttaatttcgatgaagaccaatttatctatttttttctttttttggcttgtgcgtgtgggtgtcatacc

SEQ ID NO: 689225 - DNA, 202 bp, Homo sapiens
cagtttctgcaccaccctgaaccagaccttcagccgtcaaaccaaacaggttggtgaccagcacaccgaccagcgccgcaatcagcgtggtaaacaaaagcgtaccgatggtcagaaaactgattttgcctaactgagatgcgttatgcagacgggcaaccgcgctcagaatagaggcgaagactaacggcataacgatcat

SEQ ID NO: 689226 - DNA, 714 bp, Homo sapiens
tgcgttctggtgccgccgtaatgccctggcctagtgggcagctttgactcgagagcctggctatatgtgctgcatggaatggttccctgtgaacgggagtgcgccagctgggggcgctgtgcctgccgtgctaaagcacagctcgactgttgcctgccctgaaatgcacccatgtgtcctgtgtggctacgacttcaacctgctggtgtgaattacctgctgcacttgctgtgatgtgccttctggcaaccacctgtgcttccaatgcacaccacacttccgggctgctgctgtacatgcaatgtcaactgccatgatctgaggaagaatgctgtgaaccacatgtcacagtgatgaatgaccatgcactgctggactctgacccatgagcctgcctgcccacttaccatgctgcaccattttccttgggatatacatccaacctcatcatgttcatgtgcatcctgtgagaccattcgctacctatgtgcatgcacaacatggttgtgacgtatatggttgaccacatgctggctggcgctggagtgaagacctcatcaagtgccttggcgcccacatactttgtggcgagttttagcctcatgtggtggaagggagctcctgggagaactgggatcaatatgtgatctggaaacctgctgggtgcccaatgataattaattggcagttttgattgactggctgatgcccata

SEQ ID NO: 689227 - DNA, 106 bp, Homo sapiens
gttattattgatatgacagttggtaaggctatgatgaaaactggcatgaacggaagaatggtgaaacagaccatgcagcattcagagacgggaatcaactgggtgg

SEQ ID NO: 689228 - DNA, 132 bp, Homo sapiens
ggattcggcacgagaacttctgacctcaagtgatccacccacttttggctcccaccttggggctgggattacaggctttacgtgcccagccctggcctggtcctctttagtctctcaggccctcttacaaat

SEQ ID NO: 689229 - DNA, 161 bp, Homo sapiens
gcatagatccggtcagattttacacacacagcacacactcactcaacgctgctgcatagatccggtcagattttacacacacagcacacactcactcaacgatgctgcataaatccggtcagattttacacacacagcacacactcactcaacgtcgacgc

SEQ ID NO: 689230 - DNA, 603 bp, Homo sapiens
ccgctaccatggcaaccgggagagggacgctgttctccaagaatctgctactcatgaagtttatacacaggggactgtactcagaaaccacgaatcatctaccagacgaagaaaagaaaatcatcagtgaagacgcacgtggactcggatttgccacaccttaccaagaacgacagcggggtgggataatagcagagctgcttactatgagaagatcttctctatggaagaatgtcattcagaggattcaatcctgaggctgcgaaattgatgcttcagatgaatgctacgcacaaagctagaagaagttgaagatgaaacactagagcttgatgcagtcaaatgaagagatgcctagaagatatcagaccttggcgaggacaatgggcaaaaggttggccagaaagagagaccatgccaattatgaagaagatgattaagatggatgcctcaagcgaaggcccaggagtgcttgtggcaatccatgagcgcatctggagctcatcccaatggtgcctatataagtattaatactgcaacgtttacttgtaaagagattatgatgttagaaacatgctgaattcgaaacagatgtgtgatcgg

SEQ ID NO: 689231 - DNA, 107 bp, Homo sapiens
cgtacagtctgagagcttgtaccgtccatgatcaccatctcgatctcttcatctccccatcgtcttgatgccttttgaaccacctctgtacttaagccttctcggcg

SEQ ID NO: 689232 - DNA, 113 bp, Homo sapiens
tcggtacccggtgtacggcgagggcatatcacggccgcaccttctcggcgcgagggcgtcacagcgatcgcgagcaccagcgccgagtcgatgccacctgacagaccgacgat

SEQ ID NO: 689233 - DNA, 171 bp, Homo sapiens
gatcgaggtcgacctttctggtacgcagttcttgctatcacggtctggtttctactatttcattcactttatctattttgcaggtagtctcccggcaggaataaacctggacagttcctgatcaatgaattccacaccaacaccaaacgcttctgccattgggccagcggg

SEQ ID NO: 689234 - DNA, 281 bp, Homo sapiens
gcgtcgactgtctatctgtatttctctctgtctcttgtctatctgtatttctctctgtctctgtctcttgtatatctgtatttctccctctctctgtctctggtctatctgtatttctctttgtctccgtctatctgtatgtctccctctctctatctgtatgtctccctctctctgtctatctgtatttctctctgtctctgtctctgtctcttgtatatctgtatttctccctctctctgtctctgtgttaaccaaccctgcactgtctgtgtcgacgc

SEQ ID NO: 689235 - DNA, 172 bp, Homo sapiens
cattggtccgagagaaattagggtgagcatcataacatggccgtgtggtcagtttgcagagccttcagcccacagggatgacagaagggaagtgaggtcggcaatatgttgtttttctggaacttacttatggtaaccttttatttattttctaatttctctcggaccaatg

SEQ ID NO: 689236 - DNA, 922 bp, Homo sapiens
agcgggtggggcttacgccaccgaagtaacctggacgcgggcccggcccggcgagatcactgactacatggccatccgagctggggcgtgctgaaggtgcgtggacgaccattcgatggacacatgaccaatacatcatataagatgatatcaataaaatagacacacataagaatgataaccaacaaaaacggaacggaacacatggaagatggtagcgatggcggggtgtacagcccaatacagaaattaagaagcatgaacgagaacaataacataatacgtgaaatgaaacaaaatggaggaaaatgaaaacaaaaaaaatgaatgacacaatacagaatatacaacaagatataacaatgataggaagcatggaacatatgaatgaccagatacatcaataataatgacaaaatggaaaaatagaataatcttgagacacaatcataacaaagatatcaaaaaaaaaaaaggataaataggaagataaaagaaacacatggcaaagaaagaaaagaagaaatgatgcagcatagaaaggagaaaaaaaaaaaaacacaatgccatttcaaaaaataaagtaagagacttgaatatacatggggaaaaaaaaaaaaaaaagaaaaaaaacaagaaaacaaaaacaaaaacaaaaaaaaaataaaaaaaaaaaaaaaaaaaaaaaaataaaaaaaaaaaatatcaaaaaagaaaaagaataagaaaatgggaaacaagagacagaaaaaaagatggaaacccgagagaacagagcaaaaaaaaaaaaaaaaaaacaaaagaaaaaaaaacccccaaaaaaacaaaaaaacaaaaaaaaaaaagaacaaagaacaacaaacaaaaaccaaaacacaaaaaagaccaaaaaaaaaacaacaaaccaaacaaaaaaaaaaca

SEQ ID NO: 689237 - DNA, 507 bp, Homo sapiens
  misc_feature (184)..(184): n is a, c, g, or t
ttccccgtaggaaaccggaaaaggctggattgcttgaaaaccgttggtttaatggcagccgatcacgcggagctgtcacccgtgcgggacttcaaaaaagcctgctcccgccagtattaaatgggaaaaagcccccaaggcggcttttgcaacttcatgcatttaaagcccctttccaaaaagntgcggggggagcggtatggcccccgtcccaaaaaaaataaatcaaaatcccgatcccgggagggtggttttcggtttaaaaacccggggtcgtgccggggccggggccggtggtgaaggtgcccccccccggaagcgtcacaaaaggcggtcaaaaaatcgtaaaaaatttgggggattttgaccccccccctttttcccttatgtttgctaaaaagggtgggggttgattgccccaccccgttcataagggggattttttttaaaaacccccaaaaaaaaaaacacccaaaaaggggtttttgaataaaatttgtggtgata

SEQ ID NO: 689238 - DNA, 225 bp, Homo sapiens
  misc_feature (29)..(29): n is a, c, g, or t
  misc_feature (79)..(79): n is a, c, g, or t
  misc_feature (90)..(90): n is a, c, g, or t
  misc_feature (129)..(129): n is a, c, g, or t
  misc_feature (163)..(163): n is a, c, g, or t
  misc_feature (192)..(192): n is a, c, g, or t
ggctggtgcagttgtggtccaggtaaggnaggttgccccaaaagtaggcagattcagtaccatttagaggtaggatttncaccacctgtnactgaggaatttccaggcaggaggaagaaagtggaaaantcaagggtaacttcatgtttgtggggtgtctgtntggggcagaaaaggacgaggaaatttttnccaagagtcattcattaagtggacaagcgatga

SEQ ID NO: 689239 - DNA, 511 bp, Homo sapiens
tagaatattacaaaactttgttgataaagcaatggcagggtttgagagtactgactccaattttgtaagaagttctatgggtacaatgctatcaaacaccatcacattctacagagaaatctttcatgaaaggaaaagtcaactgatgtggccaacttcatttgttgtcttattttaggaaattgctgcagccacctaaaccttcagcaaccaccacccccgcttttttttctgtcacccaagtgggggtgcagtggcactaccatagttcactgtaacctctatctccccagctcaagtgatcctcctgcctcagcctcccaaagtgctgggattacaggcatgaaccactacccagcctatcagtcatcaccctgaacagtcagtagtcatcaataccaaggcaagaccctctataagcaaaaagatgatgactcactaaagactcatatgagcattagcattttttagcaataaagtatttttaacttaaaaaagaaaaaaggaagaa

SEQ ID NO: 689240 - DNA, 1002 bp, Homo sapiens
atcccagagagccctgagcagacccacctgtactgcctgcactgtgcctagttaccatcgacaccccgggaggagcctgcagctgccgcagccggccccagtcaccatcaccgcaaccatgatgcagctgaggccgagacccagcagccgaccctgactgaccaaaccaccagaccgaccctacccaacaacactacatcacactcaccccactcacaccacatcctcaacacaagaccaaccacccaactactacaatcccaccacaccctcacaactacctacacataccacacacacccatactcctcccaactcatatccacactccccgcatcaccctactacccatcacccctccgtccgacacgacagggtatactatttctaatccgaagatccacaacagcctactatctacgggtcttggttatctgcttcataatctcgtggcacccccgctcaacctgggcacactcatagaccttatgacccttacaccgccctcgtactccagctcactcgcctcgcgcgatcagatgaggctaagcacccgcacaagccgggcgccaatggacgcggcccttgggtcccgagcaccgctgaaactacgagaggaccgctacaagaggtcatcgacagagcagccaacccgcggccgctccgcgcgcaccgcctgacgagcaccagcaggccagcgcatgagtcagaactcacttcgacagctaccgcccacaccgacacaatgaccccgtagaaggcgcatccggagacactacaacacaccatagaacaaacaccaactacaaaacctccttaatttctctactcacccactcctacactctaccaaaccactacccacacctcaccactcaacatcctaccctaacaccacctcacccacctaccacctacatctataccatttcatacacccttcactcctacaaccactaccactacactaccgccgccatacgcatttaatccaatactata

SEQ ID NO: 689241 - DNA, 828 bp, Homo sapiens
gatatacccttcattttagctgcttccaattgttttatagtttttttctatttgtgagattgtgtctcttaagtgcgtgcatttctgttcttaatcgctggtctacatttgtcggggattacttttagagtcgtatactttgggcctattacgatgactaccatgattcgcaccaattactctgtccttttcccattatttgacgtattgatgtcgtgtgtaacatttatggtatgtccacagctaagcttgagattgttgaggcagttaatacattgacagtgaaatatccttgtgagggggcaaggtgtcagaccagcacaagttcttggttccacgctgcaactactattttaggggaagcacgaagggatgcaaggacttttgtctctcgaaaagcaggatcattctataatgttatatagagaataataagtcacactaaccttagcttactgtaaattttctagtttagaaacttagttacaaaacaagttctggacctcttctagtaataacgtagccttaaaacacacattgcatagctgtacaaaaatatgttcattatatccttattatataagcttgttatctatatttaattctttgaatttgttctagactttttggtcgaataccaagacaaacacagctagcctaggcctatgcagggctcaggatcatagacatccctagcaggtgacaggaatttttcaactccattataatctgtggggccaccatcatatatataatgtacattgaccgaaacatggttaacatgacatatataatttgcgtcaatactgcatcagtgtgccatattta

SEQ ID NO: 689242 - DNA, 693 bp, Homo sapiens
ggcagaagcctccgagacgcggccgccattccgggcctcaagcccataaagaagaaataccggagccggttctggcaccaatttcggggtgccaagagcagccatggaacgagcctgcagctccgctcagaagcccacgacggcagccggggacccaggcacggtgactgaggcaaacaacggagacggcgtagtgctcagggcccaggacctttcccgatactgttgagacccatcacgaagcgaactactagctagcataccacgagttcaagcacacttagaccaccaatagctgagacaaagagagagctagtgaacacccaactatcacacttgataatgcctacacaagaaccgcattgacgcccgagcacctaccctgacaagaacgcgcacgggccccttggacgagacccatagcccccccacgacagccttccaggagcaagcgcaaccgcgaaagccacctcgagacccccaacaaatccccggtaagagccccacaaacgaaaacaacaaccacgacccacagcccgccggccccagctcacctggacgaaacctaaacagaccgcccaagcgaaacgatccacaataccacaagggcacacagagaataaaactaacaacgtaagaatagccacaactacgcgcgagcccaaggacacgtcccacccatgctgccaatac

SEQ ID NO: 689243 - DNA, 147 bp, Homo sapiens
aacacccaggctttatcttctgcttcgccatcctcaacctattgtatttttatcctgatgtttaatggttctcaaagtgtggtccccagacaagcagcatcagtgtcacctggcaacttgttagaaatgcatattctggccaggcac

SEQ ID NO: 689244 - DNA, 999 bp, Homo sapiens
ctatggagtctcggtgcggagcttggctgcctctggtgctctttaggtggggcaagaggaatcgatagcagagtgtgagtgtatagagggtggactgtatgcatgacaagatgtagctaagaaggaattaaatgaccgtgttggccaaggtagggcacgaccgatcggagaagtgtgacgccggaagcctcgacgtacgtgagtgcgccagaatctcctgtggatcatctaagtagccgtacaggacgctagctcgaaggaacccagtgaaaatgactttctttaacgagcagacccgacaagaatatagtaaccaacgcgcattctactcatgcgtgagatgatggggctatcatctgcatgagagttgacttttggaccaactccctgtaactgctagtttgcccttgggataatccaaagtcgcattcctctacggctcgcggggaactttacactgagacaggactcgtgtacacgaatacagggttccaatcatctttcaaactaaggaccctttgattgcgtacttaaatatcaaaataccatgatgcaaagaacctgaaagtgtgcactcacgcataatgagtgcagactgggcgcgtatattttggaattcaaacacagacatcaaagacaaactgtgttatcaatggaaaactttcccatcattattggttgatatacgcaaaatcccctttgtttaccagttaaattaagtgccttcccctgtcaccccattgcttaggacgagtcttacttatgatactccgagtagaacactcgttaactttgcgcaactatgaacaagtccattagaaaacgttgagggagtgggaactgggtcgcgtgggcaactattggtgataggtttccaaacaggtagcgttcgtgacatattgagtcgcgtattgccaattgggacgattatttggtccccagggtcttggggggaaaataacttggagctaacagtatgaactccaaaatcccacagtc

SEQ ID NO: 689245 - DNA, 401 bp, Homo sapiens
cgcacgaaccgcatgccggtgtaagttcagcgctcaaatcgggcctgcggcgctagttagctagcagcggaggcgcctgagacctgacgtgccgtcgcttccgccgcattgcgccgcgctgagctgaacttgcacgtacgtagctggctgtggtggctagagcggccgacatgcttgccgtgtcctccgcgaggtgcctcgccgccgcggacgagcagcgcgccgaggccgcgcccatggagacggttgggggtgcagcggtggtggcggacctggacatagacttcgacttcaccgtcgatgacatagacttcggggacttcttcctcaggctagaggacggcgacgcgctgccggacctggaggtcgaccccgccgacatcttcaccgatctggaggcg

SEQ ID NO: 689246 - DNA, 386 bp, Homo sapiens
agaacaacagcaggaggcattatgtgaaattacagaaccagaacattggagactgaagagaagatatcaaaggcttcccaagagaagcaagcaggtcacctgcaaaggatcaggagctcggaatctggatggcaggggacttctcaatagggtggagggagcttgttttttaaagctatatatttttggaagctaagaaatgagagcaacaccttcacaattccaaagggaagagaatctaaatcctaaattcacctgactgataaagaatctaaatcctaaattctgctgagtgatcaattaaatttgagggagatttaagatatatttttttggacatgcaatatttcaaaaacatttttttcctatgcactctttcctggaaa

SEQ ID NO: 689247 - DNA, 804 bp, Homo sapiens
  misc_feature (804)..(804): n is a, c, g, or t
ggtctgcgattcctccatttactgcagacatgccagggtctcgcacgagtctagtagctggaggctccatactaacttccgatcactcaggcaaccactatcatacaccctgggatgcactcggaattagtgcctttcaaggattagccatataagaggagctgtctaatgacaccatgctagatcgctgataataatgcatgcgtaataatcgagagtgcgacgccagaaggctcacacgtaaatcctttatagacacgcccctatatatcaatacagtgattgtgtgctgccatcactatcaaccgattatcgcctgagagaatgtagagaggagggaagcgcctgaatatggtcttgcaccctagtcctagccataatgtccaattgtaccctataactttgggctggcattcaattgagccaatcggatcattcactgacttttccgcgtcggtaggccctactataatagcaccccatgactcagatacatcatagtcggaggaccccaagagtctcaaagactccgcattgtcgaccccagacatagctccttagctaggcataggaaggaggcgactccacttatgccctaggtcaaaatgggaacggccctgaggtcccaaaagccagagtaagcgcgctgcagagacatgctcgcagcactctcagcccaactggggctaaaaacactacaagtggggcctggccaggcccctgggtaaggatagcagaagcgacgaaacgcggggctaccgcacaagaacacagaccagaggggcacgaccatgcgtaaaaccn

SEQ ID NO: 689248 - DNA, 438 bp, Homo sapiens
  misc_feature (103)..(103): n is a, c, g, or t
ctaaatatgttagctgtagataggaggtgcttctggtgaactgaaagtgtctgactcgtgaggaacatggtaggttcctcacttatccactgtagatgattcnatatggacacaacagtaagaagaatggggcctcgtccctgtcgacttgaatattatccctatgtattgcatgagaggggtctccctcattccatcagagtaatacacttgctttaattcttaagccttaagtgatacaaacatgccgaattacctgtaaagaatgcatttaaagctattctaaatgggtttttatttgtaagacattatttactaggaagctggtgatattaatgcttactgttctaatccagtggccaaggtattaagaatttgcaagtattttagattttcgaaaatgaatgagagaactgtgtaaacaccccgctgttcctt

SEQ ID NO: 689249 - DNA, 388 bp, Homo sapiens
ctgctgactgctattagataaacggagcctgcatggctaggtgtaaagaatatcactattcggcttacaacaatgcgtgtttatcagtacatatggttgcaacagcccttatgaaagatataaacatccctgccctgactgcataaatgttgaaggtagacctagtactggatacctgagtcagaatctatccagttgatccacaacctcacaaggccagagaagcgagaggagattactatactgaaaaggagtgagtggacagcacaaactggttaggaaaacacgacaaactgcgcctgcatttaacagaagcaatgcacacagaagaacgtcctaaagctatctggtctcgcacacacgcttggaactcacgggcggggcctta

SEQ ID NO: 689250 - DNA, 506 bp, Homo sapiens
  misc_feature (50)..(50): n is a, c, g, or t
  misc_feature (79)..(79): n is a, c, g, or t
  misc_feature (81)..(82): n is a, c, g, or t
  misc_feature (87)..(88): n is a, c, g, or t
  misc_feature (107)..(107): n is a, c, g, or t
  misc_feature (307)..(307): n is a, c, g, or t
  misc_feature (461)..(461): n is a, c, g, or t
tcccccccactgggttcgagttcacagtctgataaggacttaacgtcctntcctcaattgtattaaatagcattggggngnngcttnncctttttaaaaaaatcccnggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggncggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccngctctgggccacgtgccccggaagcaggtgtgtccagagtcagct

SEQ ID NO: 689251 - DNA, 357 bp, Homo sapiens
  misc_feature (77)..(77): n is a, c, g, or t
  misc_feature (165)..(165): n is a, c, g, or t
aggacatattttgattctttcagtattcttacacccttttaaacaaagttcttgatagtacccactattattgggtntgttttatgccattattgattcttgatattcaagcatttacaatgtagcatatttgatttcttttttctttctttttttgggcatcantaacatttcatttgaaatgcatattgttctgaaaggactttgtttttagcataaaggtgggccatttattctaagggttggaataaaaccattggggtgtttaaccttccattggcttggaaaattaaaaaaggacccttaatttcccggaaggccaccttttggtatggcccattaaattttttttaagtt

SEQ ID NO: 689252 - DNA, 464 bp, Homo sapiens
  misc_feature (4)..(4): n is a, c, g, or t
tggnttgaggaacgtcactgtttattgcttcctttgttgtgcagaagcttttaacatttagcatggtcccatttgtctatagtagttttgttgcctgtacttttgaggtctcaggcataaaatctttgcccagaccaatgtcctgaagagttttccctaggtttttctccagttattttatagtttcaggtcttatgtttaaatctttaattcatcttgatttgatttttttatatggtgagagatacaaaaatcatttcattcttctgcatatgcttattgagttttcccagcaccatttattgaaaagggtgtcctttccccactgtattgctgttggtgcctttgtcaaaaatctgttggctttatttatttatttacatggctttatttctgggttctctattcttttccattggcctatgtgtctgttttcataccgacagcatgctgttttgtaatat

SEQ ID NO: 689253 - DNA, 117 bp, Homo sapiens
  misc_feature (38)..(38): n is a, c, g, or t
ctctcctacctcgcatctcatcccctgtctcctgcatntgatacacagatggcattgtactgtacatttcgttgtgttgcttctttttttttttaaccaaaagtttaatcctaaaag

SEQ ID NO: 689254 - DNA, 667 bp, Homo sapiens
gatcgtgacgtgagcgcccgtttcacacgccggccgccgccgccgccgcatagccttctcgccagacagcacaacgcactgaagctggcttcccggccgaggacgagttccccgacctgacccacaaaacaatggccaaggtgctgaccccgcgagcgtgtacgcggagctgagcgccaagagcacgccgagcggcttcacgctggacgacgtcatccagacaggcgtggacaacccgggccacccgtacatcatgaccgtgggctgcgtggctgggcagacgaggagtcctacggaagtgttcaaggatctcttcgaccccatcatcgaggaccggcgacggcggatacaaagcccagacgatgatcacaagagcgaactcaagcccgagcaacactgcaagggacgagagactgaccatggaacccaactacgtgctgagctcgcgggtgcgcacgggccccgcagaaatccgatggagttcttgcctcccccgcgtcaaatgaaagacagagggagaggcgcagagaccatcgatgaatgctcgatagatagaatgccctatacaggcaggacggactagctaggagaggccgagtactacgctgcacccagagcatgactagtcggagcagcaagcggacatgacgagcaatactctcaagag

SEQ ID NO: 689255 - DNA, 285 bp, Homo sapiens
aggggaattttgtgaagggggtccggggggttttttccccccaccagcgggttcttcaacggaacctggggcaggaaccccccccccaaggggtggggggggtttggtttccccggggtgggcccccccaggagtttcaatattaggcccccccaaagattggtttccccttttttggcggggggccctgggggctttccctgcccccccacatgggggggggggtttttgggcccccaagggggggcccccccccttttggttttccccataaagcctttttta

SEQ ID NO: 689256 - DNA, 401 bp, Homo sapiens
  misc_feature (274)..(274): n is a, c, g, or t
gcaggtgtcaccggatgaagtagcttaagtcaagggctgcgttgtgtgaaatctgttaatgcctgggattagacccaggaacaggaagagaagaatgaagaaactgggagcagttaggaagtgaataacccacttcctcataccagctcacaatgacaggccctgttcccagcactccctctgcaaagggcttttcattaattctataattgcatgtatgtgtcacttgtaccgtgtggtgtattctcaccttaaggtgtgcagcacagaagtncaatgctaaactttcaaaagaaaccgactaagctccacctctcactgcctttgcctctgcttgccctccacatcctagaagctgtgactcttctacctttcctaggaagtcattggtttgtccgtgt

SEQ ID NO: 689257 - DNA, 731 bp, Homo sapiens
  misc_feature (54)..(54): n is a, c, g, or t
  misc_feature (99)..(99): n is a, c, g, or t
  misc_feature (124)..(124): n is a, c, g, or t
  misc_feature (161)..(161): n is a, c, g, or t
  misc_feature (163)..(163): n is a, c, g, or t
  misc_feature (165)..(165): n is a, c, g, or t
  misc_feature (167)..(167): n is a, c, g, or t
  misc_feature (175)..(176): n is a, c, g, or t
  misc_feature (182)..(182): n is a, c, g, or t
  misc_feature (253)..(253): n is a, c, g, or t
  misc_feature (286)..(286): n is a, c, g, or t
  misc_feature (291)..(291): n is a, c, g, or t
  misc_feature (296)..(296): n is a, c, g, or t
  misc_feature (311)..(311): n is a, c, g, or t
  misc_feature (349)..(349): n is a, c, g, or t
  misc_feature (353)..(353): n is a, c, g, or t
  misc_feature (357)..(357): n is a, c, g, or t
  misc_feature (390)..(390): n is a, c, g, or t
  misc_feature (395)..(395): n is a, c, g, or t
  misc_feature (399)..(399): n is a, c, g, or t
  misc_feature (418)..(418): n is a, c, g, or t
  misc_feature (424)..(424): n is a, c, g, or t
  misc_feature (431)..(431): n is a, c, g, or t
  misc_feature (480)..(480): n is a, c, g, or t
  misc_feature (482)..(482): n is a, c, g, or t
  misc_feature (494)..(494): n is a, c, g, or t
  misc_feature (547)..(547): n is a, c, g, or t
  misc_feature (592)..(592): n is a, c, g, or t
  misc_feature (620)..(620): n is a, c, g, or t
  misc_feature (625)..(625): n is a, c, g, or t
  misc_feature (627)..(627): n is a, c, g, or t
  misc_feature (647)..(647): n is a, c, g, or t
  misc_feature (653)..(653): n is a, c, g, or t
  misc_feature (660)..(660): n is a, c, g, or t
  misc_feature (664)..(664): n is a, c, g, or t
  misc_feature (668)..(668): n is a, c, g, or t
  misc_feature (682)..(682): n is a, c, g, or t
gctgccaaagaaaagagacaagaggaaaaccacggcaaacttgatgtcaattcnaactgtgttaaatgaagagcaaccagaggctgaagtaggtatctntcaaaaggattccaaacctgaagantccggggaaggaaagaaagaatctcttgaaagcgaantnanantggaaggnntacagnatgctcctgcagggccacaagtgtctaaggagtaaaaaccagagcaagtcccagatttggatggtcctaancctgcaagaagcatggaaaactcctaggaatgnatatntcctnaccttgttacacctncgtggcaccatggcaggattccacatttcatagaatanaggntttnaagcaaacccctagttagaccatgcactaattncctantganttctgtactatgattgaanggatanacctatngaaaattttttgtttcaaaatacagagaaaaacattcctattacctttntnaggctggctttncagcaattgtttcaaaggaaaatagatccccttaaagaaaaaatacaggcttnagggaacaaagggacaagcagaacaggtgtagaagagagattttnaggaagggaaaaatttatagctacaganggtgntnagaaaaatcataactaatangtaaanaaaatanatanaagnagcatttacggtantagcattctacttattaaagatgcaatgaaatgaagaaaggctttatgt

SEQ ID NO: 689258 - DNA, 199 bp, Homo sapiens
  misc_feature (126)..(126): n is a, c, g, or t
atcaaaaggatcgttttgttttgtttttaaaaaaaggggagattggcttggtttttcatgagcccctttgaaaaagctctttttttgtttttccccgcccatttcgttttggggaaaaaatttgtnctgtattgggattgtaaaaaacatttttgcccccagcccgtttcaaaaaataaatgttttttttgtttttcca

SEQ ID NO: 689259 - DNA, 143 bp, Homo sapiens
cgggggcccccccccccggggggggtttttttgaaagggttttttttgaaagggaatttccccttccggggggggggaaaaaccccccccgggccccccttttcccccttttgggggaaaaaaaaggggttttttttccccca

SEQ ID NO: 689260 - DNA, 318 bp, Homo sapiens
gcaacattaaggaagggtccccaggttggggagagccccaagttgagaacaataatgaacaattatagtatgaacaatagttagaaacagcgtaatcacaaacaacctgcgggcacaatgacctcattccacacgtagcacccttcagcaggaccctataaaactttcctccagcccttgcctcttggcaggtagccccttctctgctgagctgcccactggcaacatattttcacaatggctcgtagtaaagtctgcccttctttacctacaactatcttggtaaatggctttaccacctgcaaaactgaccctagg

SEQ ID NO: 689261 - DNA, 330 bp, Homo sapiens
aatttaaatggtggttgttgccgtaattgtattttgcctgtttttttaccttttgtaatggggcttttttggtgggttttaatatccttggggctggggaagttcacaagttttttttaaaggaaaattgtttactttgacaaaaattatccgttttgggggattgtttatgcccctgaagtgggttttttgggtgtggaacaaattgtggggatttgaatttgtcccccctttttttgttttggaattaagtttaatttatttttcaagtcattttcatgccctggttttttttacttgtttttttcaattaacattttggtacttgga

SEQ ID NO: 689262 - DNA, 204 bp, Homo sapiens
tgttcatcctgccgagtaacccttgaacccctctttgaacagtatcaccgatattctgatcaataacagtgattaatttgatacaatattgttgtgtgttatgagatcacttgaatgtgatcttactttgatatctgcaacaccagggtcactcatcgcatgttgtaacactcacactgtgtgacggcgggtaaccgtcactat

SEQ ID NO: 689263 - DNA, 291 bp, Homo sapiens
  misc_feature (20)..(20): n is a, c, g, or t
  misc_feature (291)..(291): n is a, c, g, or t
atcccccctcctcttcccanataaagatgagggactaaagttgtcttgggttttattttattattatttttttctttttccagtatactagcttgtcttttaagagaggggatattaaaaaaaaaaaaaagacaaaagggtttttaaaaaaaagcaccccccacccctgggtctgtatatagccagcttatctggggtccaatcgttggatctttacagagagaaggggaaaaggctgtatcaggggggggcttagctgggcctttccaataaagaggggagaggcttccn

SEQ ID NO: 689264 - DNA, 352 bp, Homo sapiens
  misc_feature (114)..(114): n is a, c, g, or t
  misc_feature (123)..(123): n is a, c, g, or t
  misc_feature (198)..(198): n is a, c, g, or t
  misc_feature (269)..(269): n is a, c, g, or t
  misc_feature (272)..(272): n is a, c, g, or t
  misc_feature (279)..(279): n is a, c, g, or t
  misc_feature (306)..(306): n is a, c, g, or t
cccagagataagactcccctagatcccccacttagatcaccaccctttctcagggggtaataaagtcatcttccttggaatgtagcaatctataaccaatcaaagcactgtaanatatgcacnggtcttgtatggaaaatgttgtaatcctgctaaaattcctctctctttgcctgtggaagtgaaaccttaacttcnccagtttggaatgctcaccccattcctttggagtcaatgcttactgggtggctattctcaaactttgcacncanagaaacnctatacttagtcttattttctgaatcncattatttaaggttgacataataaacaactaatagtaagtaaagtg

SEQ ID NO: 689265 - DNA, 110 bp, Homo sapiens
ccgtaacctagatggctattgaggagctatccttgacgcatgggggtcaggcgttgaggtcttgtgtgagtgcttttagtgcaggttcagcgatggaggtaggattggtg

SEQ ID NO: 689266 - DNA, 568 bp, Homo sapiens
  misc_feature (2)..(2): n is a, c, g, or t
  misc_feature (24)..(24): n is a, c, g, or t
  misc_feature (37)..(37): n is a, c, g, or t
  misc_feature (62)..(62): n is a, c, g, or t
  misc_feature (142)..(142): n is a, c, g, or t
cnagaccgggccctcagaattaanccaccatggtttncacccatttgatctttggccaaccntgccaaaaccaagaaatgggaaaggttctcctattccagtaaatggtgctgggaaaacttggctagccatatgcagaaanctgaaactggaccccttccttacaccttatatgaaaattaactcaagatggattaaagacttaaatgtaaaactgaaaaccataaaaatcctggaagaaaacctaggcaataccattcaggacatagggatgggcaaagacttcatgatgaaaacaccaaaagcaattgcaacaaaagccaaaattgacaagtgggatttaattaaattaaagagcttcttcacagcaaaagaaataatcatcagagtgaacaggcaacctacagagtggaagaaaatttttgcaatctacccatctgacaaaggtctaatatccagaatttaaaaggaacttaaacatatttacaagaaaaaaaaaaacaaccttatcaaaacataggcaaaggatatgaatggacacttctctaaagaagacatttacatggcc

SEQ ID NO: 689267 - DNA, 529 bp, Homo sapiens
gctggaatttggagaaagtcagtgactgaaggtaagacagtagtgtgtggtggagttcggaattgcaattggctgtccatggcttttctagcctttcaaggctgccctgttgtgcctacctttggtctaagctcaagtgtcattctttacatctccttctgttttctgtttatgcatgtcacaaacatataactatgtgataagattttgatcgctcagacagcttcacttctcacacagcaagagcattgctataccgatcctcttggctgactcccatctgcaaggtagaggagcagatcatcccctgggcttccccgtcacacatgtgacatgctccatgtgtggcagatgacactgaaagggagagttcaaggacagacacctggtgaattcatgctggtgaagctccaggagatgtcagagggcagctgttgggagtatgaggcccagtgtaaccttctgcaagaatgtttgcaaccagcctattgtgggagagatgttcagactggggccagattttttttta

SEQ ID NO: 689268 - DNA, 117 bp, Homo sapiens
  misc_feature (7)..(7): n is a, c, g, or t
tgtcgcncgcgtgatagaggatcccatcattgcttgctgtgttaagatataccaaaataaaaatgattacttctaagtaatagagcacataaacgttatgatgaatataattattgt

SEQ ID NO: 689269 - DNA, 687 bp, Homo sapiens
agtttttttttcaataaaagtttagaaagaaaaaagtgatgcctgatctttcaacagacaggtggggctctgtagctgccactaccacagatgcacacaaaaacagcaccctcatttccagggggagcctcaggccccgagataaatgtgctccatggacctggaagcgggtagttccaggtccaaaaagttcctcctgaggctgctcacaaaacagctgactatagctatagctatggctcttggggtttcagtctcacactgagcatctgactctggctcccaaggggtcaaagaacaagccctgggactggcatacacagggcatcctgctagcccatagcttggccatataggaccaggtcaacacacatatatattccctaacttgaatctctctcggccaggcacattggctcacgtctgtaatcccagcactttgggaggcaggtggatcacttgaggtcaggagttcgagaccatcctggccaacatggtgaaccctttctctactaaaaatacaaaaattagctgggcgtggtgatgcatacctctagtcccagctactcaggaggctgaggcaggagaatcactgaaacccaggaggcggaggttgcagtgagctgagactgcgccactgcactccaccctggcgaaagagcaagactcatctccagaaaaaaaaaa

SEQ ID NO: 689270 - DNA, 372 bp, Homo sapiens
ggtcgacgaaaaacctctggcccatttggataaatacttgtacaaacctccagctcactcagataaaggaacaagaacgacctagcacagaaatgcctttgtttgaccagccacggtggatcatgcctgtaattccaacaatgtcggaggcagctgtgggcggatcatctgaggtcgggagtttgagaccagcatgaccaagatggacaaaccctgtctttactaaaaatacaaaactagccaggcatggtgctgcatgcttgtaatcccagctacttgggaggctgaggcaggagaatcgctagaacccaggaggtggaggttgctgtgagccgagatcgcaccattgcactccaggctgggcaacaagag

SEQ ID NO: 689271 - DNA, 477 bp, Homo sapiens
cagactccaactatgtaacactagtaatttttatcatctttgcctcgggaattataagcaaagtaaaaaagggtattcaaatatctgtgctaagatttttaatgccgtaaaaaaaaatttgcaggctgatagcaaatataaaattaaaatattaccaactgtagtaaatttcctctaaaaaaaaacacatgcacactaacaaatcaaaaagccctgttatttcaaagtgaaaaatgaacaacagtagcagaacttattaagtattttaatgccagtatctttaaagaggaaaggaatacaacatgctggaaataagaataatttctaaatcacaattaattctttcacatttcactaagtgtgagttttgatattctctataaggaagcagatacttgctaaagaaacttttgtgtatgtatatatgtaaagacaaaaaaattattccctttccaataaacgttctttcaatatttt

SEQ ID NO: 689272 - DNA, 468 bp, Homo sapiens
taggaaatagcgtgaggtgggtccaggagtgatcactagcccatgtgtgtgcagctgagctgtggatagaactaccaagttgcagcaaagatggtgatcttgtgcgagaggtggttagagagtcaggtgtagtttgtggtgggctttaggaagtcaggctgaggatattgttcatgtccatggcagtcttgagtgtagggaaggcaggcccgctgtttcccctactagtgatctgttgaatacatcgcatggtcctccattgtcctaagctcccatcgtggttgcatctaggactagttcataagtaggctcaggtgtcgaaaggcgtggttacccagaagggcaaatcagtcaaagcttcaagaagctgagtttcgtttttttcagttaccaaagcggggccctatcttgttctaaaatatttggccctatatctgactttggtcaagatttgagtgatcacaacct

SEQ ID NO: 689273 - DNA, 1075 bp, Homo sapiens
  misc_feature (759)..(759): n is a, c, g, or t
  misc_feature (791)..(791): n is a, c, g, or t
  misc_feature (836)..(836): n is a, c, g, or t
  misc_feature (917)..(917): n is a, c, g, or t
ggcgacgcgacggtgggggtttcggcctgcgttcgggccgcagacagagcctgggcctgggcctgggcctgggcctgggcctgggcctgggcctgggcctgcgcctgcgcctgccctgggaacgggttccggcagacgctgaggttgcgttgacgctcgcgccccggctcccgttccaggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagcttattcccgtgccaaagttaagtttaatgtgaaccgggtggacaatatgatcatccagtccattagcctcctggaccagctggataagggacatcaatacctttctctatgcgtgtcaggaagtggtacngggtatcactttccggagctggtgaagatcantcaagcgacaatggccacatactgccgtcttgcccagttttattnggaaaccgaagggaactgaatgaggacaagctggagaagctggaggagctgacaatggatggggccaaggctaaggctatnctggatgcctcacggtcctccatgggcattgggacatatcttgcattgactttgataaacattcgagagcttctccagtcgtagtggtgtctttatcttgaagtaccggcaggagcctacacaattaccttcgcttccagattcaccaagtagcccca

SEQ ID NO: 689274 - DNA, 527 bp, Homo sapiens
  misc_feature (433)..(433): n is a, c, g, or t
  misc_feature (443)..(443): n is a, c, g, or t
  misc_feature (517)..(517): n is a, c, g, or t
gctaaaacaccaaaacgaccaaaagcaaggacttctgcacagaacaagttagcaaggttgtaaatgcaaagaaaagtctttgaaaaaattaaaattgctagtgaacatacaattgataagaaaggaaaacagccttatttctgatatagagaaagttttagggtctagataaatgatcaaagaagacacaacattcccttaagccaaaaccgaattcataagaaggccttaactccaattctacaaagcttgagagagatgaagaagctgatgaagaaaagttggaagctagtagagattgtctcatgaggtttaaagaaagaagctatctccataacattaaagtgcaaggtgaagcagcaagtgctaacaccagaagctgcaacaagttgtccagaatgtcctagcctaagtgatgaaggtggctatatanaccaaccagntttttaatgtagacaaaggagccttctgctggaaggaggatgctatcttaggactttttgtagctaaagaaggngatgtccatg

SEQ ID NO: 689275 - DNA, 924 bp, Homo sapiens
  misc_feature (5)..(5): n is a, c, g, or t
  misc_feature (608)..(608): n is a, c, g, or t
  misc_feature (640)..(640): n is a, c, g, or t
  misc_feature (685)..(685): n is a, c, g, or t
  misc_feature (766)..(766): n is a, c, g, or t
tttcncgggtttggcagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagcttattcccgtgccaaagttaagtttaatgtgaaccgggtggacaatatgatcatccagtccattagcctcctggaccagctggataagggacatcaatacctttctctatgcgtgtcaggaagtggtacngggtatcactttccggagctggtgaagatcantcaagcgacaatggccacatactgccgtcttgcccagttttattnggaaaccgaagggaactgaatgaggacaagctggagaagctggaggagctgacaatggatggggccaaggctaaggctatnctggatgcctcacggtcctccatgggcattgggacatatcttgcattgactttgataaacattcgagagcttctccagtcgtagtggtgtctttatcttgaagtaccggcaggagcctacacaattaccttcgcttccagattcaccaagtagcccca

SEQ ID NO: 689276 - DNA, 589 bp, Homo sapiens
  misc_feature (170)..(170): n is a, c, g, or t
tggtccaccccttgccgcgtgggggggcccctcctagaggaacaatgaaggttcttcccttatgtctcttccgctgtgggggggggcgaccctctcgtctctcgtgggtgctgtggtttgttcccaccccgcggtgcggtgtgaggaggatggcgggctcatcccccgcngtggacctgggtggggtgtgggtgacgcagggggggggccctcttccccccaaggccctcccccccccccggggaaaaaaggcgccttttttttacccgggggtttggggggccccttttaaaaccgcgggttttggtgggtgcccgcggggcgcccccccccccaggggtaaaacccggggtttttttggggcccccttttttttgtttttttttcacccccccccccggggtttgggggggttggggtttttttccgagcccattttttggggcccgggggggggcctttttttttttccccgccccgccgcgcgagagagggcccccccctttttttttcccccctttttttttttgggggggggggggaacccctgtggggtttttttttttgggttttcccccccccccccggt

SEQ ID NO: 689277 - DNA, 902 bp, Homo sapiens
gtctagataaaaaaagagataaagactacagaaggaaagagatcttgccttttgaaaagatgaaggaacaaaggttgagagaacatttagttcgtttgaaaggtgcgagagcaatggaattcgacagacgaagagagattgcagagacgacgacgcgtcgacgacgcgacgaaccgcattacgaactacacttcgtgaacgggaacgacaccgggacaccgcttaccagacgacgacgacgacgcacgcgccctacgacacacttgacacacggcacaaacactacgacgacgacgacgagacatggacacgcgaacgcttggacccgggacacgcattcgtattgaaccacggaacgtcgtacaggaacgctgacaccggattgctcgagacaagacgaggaactcagacacggcaacaacagcacgcttcgtatatgacacaagaaaaaaggaattccttgaaagagcccacgtgatgtagatcataggcgagatgatccttactggagcgagaactaaaacagttgtctcatagaatacagatgcacgaatttggccatggatccgactaatctcgaacaacagaacaagatataatgactgtgatcaccgagagaggggcaggatacctgagagtcagcagtacagtctacatctttcgaaaggcgggaacgcatagtggtcaaagtgaggggacaaaaagcacgaactactgcacgaagggaagatccaagcttcgaacagatatcccacaaattccagaggaatccagaagaaactgagacatcaagcaccaaagacatgcacatgagagaagccaaacaggggaaaagtccgaggaagagcgcagagaaacggagaaacgggacaatcactgacaggctgatatcaccaccaaga

SEQ ID NO: 689278 - DNA, 170 bp, Homo sapiens
tagctcggtccagagctgctattgacttctctgccatgacgtaaggtcctaattgaaaaaaaggtaggcaaataaacagtaccatcataaggggtccgcacctactgcgggtaattccatggcagagagaggcagcatgtacaaagtgttcacgtgcttgagatgcaggg

SEQ ID NO: 689279 - DNA, 1106 bp, Homo sapiens
  misc_feature (292)..(292): n is a, c, g, or t
gtcctctatttcaaggcaccaacactgaccctggaacagatgaatcgacaactgcctgtctgtctgtactcagtgggcgcactactcactaagacttgagcaggaccatgatgctgcctgagtccctgatcatccctgagtctgagagagtcccccaggcgagtatgctgcgccctagaacgatccgtattcaagtcccactcgatggatcgaggatcgaccacgacatcctttctgagcaatagaatcacacctctctagagcttggcttgatgatagcccttcgatgtcntcattcccggtctagtctggccagcaacctaagatcacaacatggaaactcaaataatcttttggttcatcccctcaatgttggatcaaatctgcgtaatcgacgtcgcctttgcaacatgcttggtcctctggagaaccgaaggcgtctgagagcttcagcggattgcataatccacctaggatgtgtgccttagaatatgtgctatatcctacaccggatgaatgtctcgggaaggacttcacgatatccatgtatggtgcattcccatgggacctctctcttcccatgagccccttcaggtgtaggccatcacggcctgactcctatatgaccacacggacaagattggccttgttaccatccagctgcatgggcctggaaatctagtggaatcagacctagagcgtgggcattgttaacaaccacagtttggttaccaaatcattacatgccctttcaaatgttcatctctcgggtcaatcacccgaaatgtagggcctaggacaaacagtgatcgaaggaagttagaagtgggaggcgcggggttactcaagtgggaccaccttgtgcgactttgggtcctagggatcttgcctaatgatgaccatagcttttgtgggccactgtgctgaagttaccatcttcacttttgggagtggcatagcttggagacgagaacccttttgaagctcggcggccccagcccgtgggaaacgtaggtaccttcacacggtgcgttcacaagttggaccaccgctgccggtggcctaatgacttgaagggtttagagcctgtttggaatactccaggc

SEQ ID NO: 689280 - DNA, 157 bp, Homo sapiens
ccgggggggttttttttttttcccccggggtcccccccccccggccccccaaagggggggggtttcggggggttccccccccccccgggggggggttttttgggccccaaagtttttacccgggtttccccttttttttttttttttccccccccca

SEQ ID NO: 689281 - DNA, 193 bp, Homo sapiens
taaaaaaaaggttttttggcaccccgggaaaaaaggggaaaaaaggccaaaaaaaccccccaaaaaaaaaaaagggtaaaacgggaacccaaaaaaaatttttcaaaaaaaaaaaattttttttttttcccaaaaaaggtttttttttttacccccaaaaaaaaaacccgtggaaaaaaaaaaattttttttt

SEQ ID NO: 689282 - DNA, 169 bp, Homo sapiens
cattctgtggtcgctctagagatccccgctcctaggcggggtggttgccggacggaggtcgctcctcacttctcagacggggcggttgccaggccgacgggtttcctccactttctcaccatcggcaatcggccgtcgcggacgacgcctccccactctcccagaacag

SEQ ID NO: 689283 - DNA, 826 bp, Homo sapiens
tgcatgccgccgtctccgcctcgtgggcctgcctgtgtggtgctgccctgcttgatgctgctacccacttgtgctgtcctgctgccgatcctcgctggtgctgacccctgcggccaatggcccccgtgctggtgatgctggctccctgggctgccccgaactagcccccaactttgggctgaagtttgcctgctgcctctccccgcccccactgcggcgctgcctgtgttgtgcctgctggacggcatgctgtgccccctggggatgcgccttcccggggtaccccgtggctgcgccctgctgctgctgctgctgctgccgctgctctgcgccgctgctggtgaacagggtgctgcctggccgagctgcgggtcctgcgtgcggcttgcctggacgagcatggtgtgacctgaggatgagcctgcatggcggacagctgacgcggacagcatcagcctcgagctgcgcaagcccgactggcaccctcgtctccttcaccgacgacttcaagaagggatgtgaagggttcttaccgggccctgatcctgggggagctggagaagggggcagaggtcaattccaggccctctgctttgtcacccagactgcaagcacaagttgagatcatccccaagtgatagccatggccaagctccggcagaaaaatccccgggcagtggcggaagggcggacggaggtcggggtctggagcatctgcacatgaatgtcgctgtaactatcagccagggggccatgtgagtcccatctccaacgtttttcctagccggaatcgattaccccgcagaagattcgatctgctgcgagt

SEQ ID NO: 689284 - DNA, 171 bp, Homo sapiens
  misc_feature (53)..(53): n is a, c, g, or t
  misc_feature (67)..(67): n is a, c, g, or t
ccgccgtacagttgcggagtcattacaaaagatgaatcctgaattcaaacatngtcgtagaaatgtncacatgggtttattgtcatatgccaagacaggggaacttgcttcattcatcatgcatgcatatttacacatccgttccacctacagcgcaactggtacggcggg

SEQ ID NO: 689285 - DNA, 889 bp, Homo sapiens
ggaaagaatataccaccatttcatctggctagttcaccatcacaaggaggagtgcttaagtgctttcaaatattggtgtcaatatgtgtcacataagattacaggtagcaaatgtattggaaagcgacttaagcacttcactccgttgtggaaagaagtataccatctagttatcatcgatggacctagtagcaccagtcacacactgacaatagccagaaaggggattctagaaaaacgaggagttgaccaaaataaataatcgtgcaaagaatgatagcttttaacccgtgaagtgaccagcttgagtctgagaagtgcttagatgacatgggcccaatatacgtcagtagcaatagaaggaaacgacttgaagtgggacattgtagacgccttcaaaatagtcagaaaatcataataacacgcacacataagaaaccgagagcgcgaatgaccgtagacacacaataaatcaagggaatagccccagaaggaagggtaggtacataactacggcgaaacctgatcgcccaagagaacacgtggaacaatggctacataaccaaccaaccaatcagcaaagaaacgaggaagcatttacaacaacaaacaacttgcatagtagccgtacaacaaaagactggggaccatccgagcaacgaccacagaggtaagcagcaataacacgcgaaacgctggaaatacgaaccatcaaagaaacacacaccaaaaatataggacagaagaaagagaaaccaaagacccatggaggctccaccagtaaacagaatagagaagcgggatgaacataaagacgtggacagagacagaaataagagacttacaacagtaggagcgtcgccaaatgaacacagacgatcttccaaca

SEQ ID NO: 689286 - DNA, 1100 bp, Homo sapiens
gagtccgagtggagagagcgatctgagtggttgtgtggtcgtcgtctcggaatccggtagcgctttgtccagcatgtgcttgagccaactgactgtaagagcaggattgcgatggaatttcaaaggagagcttctatctcactattctgacaaagatggtgatggcacatctcatgaatcatacataatggaagttgggaacgtgtgatatggagatctcattgtgcgccatgaaatccaccacggtaaagcaagcaagttaccacgtgacattgacttcatctcgaatggtaggattgcttgactgtgatcatatcgtgccacagatatgactttccccttggaattttccggcgggcacacttgtggtgtgcggcagacaaaatagatgagcatcgcaccggccaaggacctgagatggaaccaacatgtaaacctttgatagacgtatagctgtgtccgtgggagtgatatcgcgaactcacagcggcctgggcgctacatcggcctatgtgatatagtgtggctgcaagaaaaacttttctgccccagtgatcgatttgtacaaaacccctttggggactgcaagcatagtttattaacgaggacttgcaatacgacatgcgttgattcgtacccacctcgactccatggtgaatactgctaagaattattcgcattgcggtgcattggtcgcatagttgagaacttatgtaaaggatgttttgtgaccatatattggattgacacgtcgatagaggttgaaaagtacccttatgttaatcatgaaattggttgttaaataatccttccttgggttggcttaaagaattgggtcttaattattacgcgcattgttctacctttaatggttcatgtgtacacagctttcagttcttgtaacaacacgcgtttgtcctcccccttcacttgggttccacacaagacaaacattaattgcacttgttaacttaggtcacacttataaggggaactttcaatttccccttccccagtagcttttatctttcgcccattaatcctttaactggtccatttggtcccctaaagaacaccctgtaatcttctaagaaaaaaaa

SEQ ID NO: 689287 - DNA, 112 bp, Homo sapiens
gagtctcatgctcaccctccagagtagctggcactacagtgtgtgcaccatcactacccagctattttttttgtattattacgtagagatggggtttcaccatgttggccag

SEQ ID NO: 689288 - DNA, 167 bp, Homo sapiens
acacaaagctggctgtgctctaggagtggtatccctcccaggcagctgtgtctcccttctggcgggaccacggctcgggccaggcaactggatgtcttttcccttcagacacgtgcgtggcgcagaggaattcagtcaggtcttcctccgggctggttccgtgtacc

SEQ ID NO: 689289 - DNA, 387 bp, Homo sapiens
  misc_feature (42)..(42): n is a, c, g, or t
  misc_feature (77)..(77): n is a, c, g, or t
atgggatggcggccgggcaaaaacactcctccctttccagantgggcagccaggcaaaggggctcctcacatcccanacgataggcggccaggcaaaaacgctcctcacttcccaaacggggtggcggccgggcaaaggctgcaatttcggcattttgggaggccaaaacaggcggctgggaggtggaggttgtaacgaactgagatcacgcccctgccctccagcctgggccccattgagcccctcttttagtgatttttaaaagctctttacaaattgttgatgtgagccctctgtcagttttatgggttcatagatctgttccccctttgcaacttgccctgtcccttttttagttttttaataaacagaaatttttaatttga

SEQ ID NO: 689290 - DNA, 195 bp, Homo sapiens
tggctctagttacccagacagcgatcgcctggaggacatgccaaacatcctgacctaggctgataagctgctcacgcagcacgagtaacatcaagaacgagatcgatcatccttacgtagtgaggactaccagagagatgagggacttggtgcgagattgtcaccctatgggtcagacctgtattgcccatgttc

SEQ ID NO: 689291 - DNA, 169 bp, Homo sapiens
tgcctgtctggatggtgctgaatcactttgccaaagcatcatattcttggcgattttttcgtattcgtttgcttgaagaattgcttttgcactcagcaatttttttcatgtgctccagctatgctacattctatttccttgtaaattttttcataattttccatttctc

SEQ ID NO: 689292 - DNA, 147 bp, Homo sapiens
gtgcacattgaggatcggtggcgcacgctcgtgcctgctgttggtctgacggcgccgagctgaaggtctacgagggcagcggcacgcgttgcccgacaccgaccgcgaccgtctccacgccgagctgctcgccttcatcgactcctg

SEQ ID NO: 689293 - DNA, 756 bp, Homo sapiens
cgcagaatggcaagaacagccagactgataatacgatacggtcctccttgtgctgactcaccgacctcgactgccgcaccatggacgcccccaggcaggtggtcaactttgtggcctggtcccgccaagctgcctgcactcagtgttgttagatgatacaaaaggaattattatgactacaaaggagttggcataagttgttcttgaaattgatgtcacagtgtcatccagatttttgccaagattattaacaatacatgatgaatcttgtgctgtgtgaatttgctatgcttgttccagaacaactataatgtgttgatttttcttgccaatgtgcatgtgtgtggtgctgtgccatgttcatgttgtcttgtccctcttaacactctcatttgtgctctgaaaatgcatgtgaatgtgttgttgcttgacctattgttgtgttgatcatgtgatgcttgtgtacatgctaatggccgcatgaagaatgccaacgacatgtttctgggactataaaatatccgtatcaccctaaacttgggagttatacaataaattccatgatccaaatgcacctggaacctcaacccagatgcctcctcacttgtattatttgtgcaaatgatgacgtgtgcatggttgtggagtattgactttatacccgatgtcactttgagcagtactggtttgtgacatgtcctcaacttctgtcaagcagtggattttccaagttggtgtgatattgtgtgccgattc

SEQ ID NO: 689294 - DNA, 316 bp, Homo sapiens
  misc_feature (59)..(59): n is a, c, g, or t
  misc_feature (231)..(231): n is a, c, g, or t
agtgcgacggagactctctgaaaagtccagaggcccccagaccacactttgaaaataantggtataattattcccactgatatgatcaatggcactataaacaacttcttattatttttttttttttttttttctgaaagggattctggctcggtcgcccaggcgggagtgcaggggagcaatcccagcccacggcaacctccacctcccagattcaggcgattctccggnctcaacccccggaacagtggggactacgggggggagagtctcggtcgaacttgggcttccaaattttaagcgggagagtctccgt

SEQ ID NO: 689295 - DNA, 563 bp, Homo sapiens
  misc_feature (31)..(31): n is a, c, g, or t
  misc_feature (73)..(73): n is a, c, g, or t
cttccccttatgagagagaaactgacgcagntacgccacgactgggagcggcagaacaatgaattccaagtgntgttgggcatcaaaaccacttggagaaggaaatcaccacgtcccgccggctcctggagggagagagtgaagggccccgggaagaatcaaagtcgagcatgaaagtgtttgcaactccaaagatcaaggccataacccaggagcccatcaacggaagattagttttttgtcaagtgaatgaaatccaaaagcccgcatgagcccaatgaaagtttccgcctgttgtaaaatttattttcccccaaggaaagtccttgcccagaccccagtgagtgagttttaaaaaatacccttggaattatcagactcagaaacttttattttttttttttggaacagtttccccaggcttttcataaaggcttttaataaatggcccttttttaatcaaagggggggtttatgagggtaaagctttcctttcctactgcagccttcagattttcttctttttgcattttttttgtagccaataaaactccgccctagca

SEQ ID NO: 689296 - DNA, 436 bp, Homo sapiens
  misc_feature (1)..(1): n is a, c, g, or t
  misc_feature (117)..(117): n is a, c, g, or t
  misc_feature (143)..(143): n is a, c, g, or t
  misc_feature (145)..(145): n is a, c, g, or t
  misc_feature (153)..(153): n is a, c, g, or t
  misc_feature (158)..(158): n is a, c, g, or t
  misc_feature (282)..(282): n is a, c, g, or t
  misc_feature (314)..(314): n is a, c, g, or t
  misc_feature (327)..(327): n is a, c, g, or t
  misc_feature (436)..(436): n is a, c, g, or t
ncagcagctgtggctgggtgcatggggtctgcttctcggccagtgggagccgagttgcttgggtcagccatgacagcactgtatgcctggtagatgctgacaagaagatggccgtgnaaccctggcctctgagacattaccantnctggccgntaacnttcatcacagaaaatagtctagtggcagcgggccacgactgcttcccggtgctgtttacctatgacaaatgctgcggtgacattgaacttcggtggccggcttggaatgtacccaagcaagaantcccaagcgtggcaatgacaagccccgagaancgcttccaagaancttgggacaaagaagggccagctcttgaaggggggttgcaagccacttgggggcccggccttggaattcaattgcaacaagaacaagttgttaagccaaattcttgggn

SEQ ID NO: 689297 - DNA, 465 bp, Homo sapiens
gcacccaggcgcacttctggaataagactccagcactgggccaggcgccgtggctcacgcctgtaatcccagcactttgggaggccgagacgggcggatcacgaggtcaggagatcgagaccatcctggctaacatggtgaagccccgactctactaaaaatacaaaaaaattagccaggcgtggtggcgggcatctgtagtcccagctactcgggaggctgaggcaggagaatggcgtgaacccgggagacggagattgcagtgagctgagatcgcgccactgcactccaggctggtcgacagagcgagactccatctcaaaaaaaaaaaagttaaaacaatgaggctgggtgcggtggcttacacttgtaatcccagtatgttgagaggcagaggcaaaggcgggctgatcacctgacatcaggagttcgacagcagcctgggcaatgtggtaaaactctgtc

SEQ ID NO: 689298 - DNA, 461 bp, Homo sapiens
tggatcatgtgctccaggcgcaggtcaagctgctcgtcgtcgaacaacgcctcccatgcccgagacgccaacaccatcgcgaaggtgggcggagcaatggggtcgtcgcctcgataggccggggcgttatcccccaaagcagtggcaagctcccggattttctctgcggtaacaagatacgggtctgtcgtcgggtaggtgcgcccaacgtcatgagaactgatcgacatgtcgtcaggctatcccagacccccaccgccacagaatacctcggagcatcttaattgctcacacaggggaacgcatgagcgtacagctgtcggaggggcagactttcggcccgcgagccatcaacgttactcggactactctggtccgttacgcaggcgcatccggcgactttaaccccatccactacagtgatcgagctgcccgcgaggcccgcatggacggagttatcg

SEQ ID NO: 689299 - DNA, 797 bp, Homo sapiens
  misc_feature (38)..(38): n is a, c, g, or t
  misc_feature (40)..(41): n is a, c, g, or t
  misc_feature (43)..(43): n is a, c, g, or t
  misc_feature (47)..(48): n is a, c, g, or t
  misc_feature (53)..(53): n is a, c, g, or t
  misc_feature (76)..(77): n is a, c, g, or t
  misc_feature (79)..(81): n is a, c, g, or t
  misc_feature (84)..(86): n is a, c, g, or t
  misc_feature (90)..(91): n is a, c, g, or t
  misc_feature (93)..(97): n is a, c, g, or t
  misc_feature (129)..(130): n is a, c, g, or t
  misc_feature (133)..(133): n is a, c, g, or t
  misc_feature (139)..(140): n is a, c, g, or t
  misc_feature (159)..(159): n is a, c, g, or t
  misc_feature (196)..(196): n is a, c, g, or t
  misc_feature (201)..(202): n is a, c, g, or t
  misc_feature (206)..(208): n is a, c, g, or t
  misc_feature (211)..(211): n is a, c, g, or t
  misc_feature (303)..(303): n is a, c, g, or t
  misc_feature (586)..(586): n is a, c, g, or t
  misc_feature (761)..(761): n is a, c, g, or t
ccccaagccgctttcacaaactcctttcttaccgtagngnngncccnnccgcngcccgggcgagcgacacggctgnngnnnccnnncccnncnnnnncccccccccccccccccccccgcccccggagnnccnccggcnnccgaacccagggcaacgcnccccagtccccccacccccgaccccggaatcatgcangtagnngggnnngcnccccctgcggataagaaattgatgtgatttgaacctgatctgcgctctgaacaacaaatactgccccatgtgtacgtgcaggtccataaaanccggccgctgctgagcatcaggtctgacaaacacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggcccctggagaatggggatgggganaagagaaacaggggtgcgcttctgcgatgcccagcagccatgaccgtcatgcatcttgcaagtttctccgcaacaagatggatgtgcccagcaagtacaaggtggaggttctgtacgaggacgagccactgaaggaatactacaccctcatggacatcgcctacatctacccctngcggcggaacgggcctctccccctcaagtaccgtgt

SEQ ID NO: 689300 - DNA, 313 bp, Homo sapiens; identical to SEQ ID NO: 614636

SEQ ID NO: 689301 - DNA, 149 bp, Homo sapiens
ccgcagctgaaggagagtctaccgacgcttgatgacggttgcggcccacaacttgattcagaccactaacatcgacaatggagaacacacggagaaggccgaaggacattttcaccgagttagagcaaaatggcgccgctgcgggtaac

SEQ ID NO: 689302 - DNA, 535 bp, Homo sapiens
atcaagggcggtacgggtaaagtgaggccagtcatgtcatcgctcattcagagatgctcatctagactgccctgagactccagaactaaatccttatgtatgaaattacctacaaggaaggttatgatgatgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaagtaaggcttcagatcgtttttttcttctgaattctgtcaatttggtatttgatggtgcctgcagttctcttaatgcacttttaaagcttcacagttctgaaactggaaacgcataaaacttttaaaattattaatattctaatataacagattttcattatctttgtaagatttcat

SEQ ID NO: 689303 - DNA, 1093 bp, Homo sapiens
gcttcgctctccgccgtccgaggcccgcgcgctcgccatgtcccggccaccgccaccgtcgtggtctgccctcgcgtgctgggcaccatgtgcagtatggggcgccgcactggacagcgccctgcctagcgctcgcggcctgtgcgctgcctgttctggagcgcggacatacctgaactgtgactcgtgccttcatgtacatgcgacgtggccagtccgagaccatcctgggcggcctggggctcgggctgtgtgtgtggctgactgcagagtgaaaattgtcactcaagggccatacgccttgggactggagagaatcactagaaggccgtgacagtgtccggtcccagactaggagagctgtcattgaatgatgtgctgcacttgtccccaatgtggacctcttctagctacacgcagcatgaagtcacgggaccccggatggaagagacgtctgcatgctctgccaagcgagctgctaccaggagggcagagtacgtgggatgcttgggcctcttccaacatattgcttagctggtcagagttggcctgagatctgtaacccatctgcaacgcatgcaaatggcgtagcaatcccttgcccatctgtgttacccagggccatttgtacaaagcgccaaatccaacagcggcaagggtgcgaaaacggggaagctcttatccccttgccttcagtgcacatttagagacttgagggttcataatgaccttacaaacccgtcttgggcttggcggggcctgtcttgaactgtgacaagttcaacaagtattgcaggaccaagggacgggtcaaactcaggccttgtggggcccgacttcttttggggaaatagccttggccctgaagaccctacagcgaagatccggctatcttggcaacgggcatgcacccaactatcggagggcccattggccgcttgggtggcaggaagggccctgccggggcccggcctattggcgcccaagggccccccagttgtgacccttcgggttgccctcccggtgggaatgtacaaccattcaccgggtgcagggtgcccacggggcacgcgggccaccctggggattgtca

SEQ ID NO: 689304 - DNA, 281 bp, Homo sapiens
tatgtctgacccaccaagtatgcttaatccacaaattctttttttttttaagacaaggacttgctggtcgcccaggcgggaaggtggtgggcttggtcacagctcacgcatcctcgacctccggggcccaagcgatcctcccatctcagcctccagaatagctgggacaacaggcaggcactaccacacccacctgattttattttaattttctgtagagacagggtgtcactatgtggcccagactagtctcaaactccggggttcatgcgatcctccag

SEQ ID NO: 689305 - DNA, 137 bp, Homo sapiens
cctcccaaaatatatacaaatagtccccattccgtgggggcacctggacaatgaccccggttggagatgggcatggaggagtaggaagacccagccctatttaacttgggataaggaggacctggagtcctccaatc

SEQ ID NO: 689306 - DNA, 108 bp, Homo sapiens
agtctccatgcatgattttaaaaccttcccttcttgcaggctgcatatacttttcttataatccatgatggaaatcaaacgatggtatattttccatcatggattaaa

SEQ ID NO: 689307 - DNA, 331 bp, Homo sapiens
gagctcgctacctgtttgtccatgttgtgctgcccactgttgttatgtcccagtgttgtgctagtgtcccagtgttgtgctgtgtgtcccagtgttgtgcctggtcccagtgtatgtgcttggtcccagtgatacttgtgtgagtgagtgatgagtgggctcaaatgtgcaatgatcatgcgagtgcggacaacgaagaatgtatctttgacaatatgtcagagagtgtcatactctgtggcatggactgccaaacaccttgtgcctgatgaagtgactgacgttttgaagcaccaaggagtgaatgtgatgcttgtgagcagtgttgttg

SEQ ID NO: 689308 - DNA, 1477 bp, Homo sapiens
  misc_feature (1353)..(1353): n is a, c, g, or t
tgtcctccgccagcggaagccccgcggggtggattatacacgcttcttgcggttgttatctgccgtaggtgcccgctcgggtgcgcctgagtgaccacgttgtgtcccacccaccgagggaacccctggtcttgtggccccctagaggccgtcatatttttaaggggtgacaacagctgatataggaagaacacaggttgttgacccccacaaaaaaacgcaccgggcgttgggtgtaccgccggttgtcccccgggaatgttttccccccggcgaaattattctccgtttggacggcgcccacaccggcgcttctcccggggtttgtgggaaacaccaatttgccgcgccctgttttccgggttcgcagtctgtccaaccgcgattgtgtgccccccatgaggccccccactgttaatattttcccgcccgtttatatgggccccccctcacgggttcccccccggaatgttgtctcgcccgccgcaatgacccccaattaccgtggtgttgccccggggacacctgttggtggcgtaccacacacacgaggggcttgtggttggtctcggggccgtacccgctagaactgccctatttccgaggggccacccccaaattgggggccgccgttttttggtggacccgcagaaaattgaagagggggctcttatccgctcgcgaaagaagggtctttcactttcggaacccataatttgggtgaaaatctcttgtggggagagacacacccttatagtccgtgatatgtcggcatagctcccatatggccgcacacatgggcctagaagactttcttttgggcgttcacacacggaagagaaaaggagattttgagatccccccacagagccttgtttgtgtcacacaggtatacgttgcgcgcgcccctcgggtacgcacaaaggaggtcacacaccttggggggcatatacacacacagagaaaatttcctcgcacagatgtccccccacatttcggagagttttttggaattcggggccccaagattggcacagttgagtcgagagtatatataaaggggagatattgcctctgccacaccccctgcccttctgctcttcccacagagagaccaccgctcaccccttatacacacgtgcctataaaccacggctgctcgacacggggttttgccggcacggaccctccacggcacaagccccacggaagcccacgcacaccaccacgtcttcccacacaccacgctcacaaccacccacgggatttaaactcggattctgaaagagtctgcacgcccttaactccgtacccactgagtcaccacggcctttggagcaccttttaacttcnctgagaagaactggagctaagagaatgtaaaatggacacgttcttgaatggggttgagaaccctttctggggagccagatgaccctctctttgcaccatagataaaactccttatatgaatata

SEQ ID NO: 689309 - DNA, 936 bp, Homo sapiens
  misc_feature (935)..(935): n is a, c, g, or t
aaagatatctgctcctaaatagtgatgtggcctgtgtcagctcgtttcaatgtttctgtgagctccagcttgaccttatctgtgtggtaaagagaatatgagactatgtattggctctctttcagataatcagtctctataaatgtatgcgaactcagaatgttcccatgggttgatttgcaccggatagttctggtcccatcttcatgcaatcaacgtgtggttgcatctaaagatcagaatttactgaatgtgcatatcgttttagacgttagttagagatggttagtcacagaattcgtttcaattgctgagatttccaatatattgcaaccatcgtagaggaccattcttgagatataccactatgagcacatgatagcgtaatgcggagggtagcagagagtagatagaggtgaatttgacaggtacagtctgtcgtcggcaaaaagagctaatatggtctgagtttaaaaatataatttcaatgtcttttgcatggaaatacaggtccaatccagtagaagcagtaagggaggaaacatttccaaatatttcatgaggcactgtggaattgaatgtgtcaattaccgtaaacttgtaacctttcccgtcgacataacagtaggccttcactgttgtcatcctaagctaaaattatggacgagtgtgctatcactgtctggaagtaccctcacgacgcttgaagcacttggccagaaaggcgacgtggtcactccaaattgggggcatggcgcctcacatggattggccatggtatgtcctcaaaggctggagaaccagggaatttacaataacaaggcaaactggctgcggcccgcacacatatgaggggcgcttctacaaggtgccgacgcaggcacagctcacactagagcaaaacgcgaggtgcaactgtgagcgcacttatttgnc

SEQ ID NO: 689310 - DNA, 200 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (22)..(22): n is a, c, g, or t
  misc_feature (25)..(26): n is a, c, g, or t
  misc_feature (30)..(30): n is a, c, g, or t
  misc_feature (35)..(35): n is a, c, g, or t
  misc_feature (40)..(40): n is a, c, g, or t
  misc_feature (45)..(45): n is a, c, g, or t
  misc_feature (52)..(52): n is a, c, g, or t
  misc_feature (54)..(54): n is a, c, g, or t
  misc_feature (59)..(59): n is a, c, g, or t
  misc_feature (77)..(77): n is a, c, g, or t
  misc_feature (80)..(80): n is a, c, g, or t
  misc_feature (82)..(83): n is a, c, g, or t
  misc_feature (90)..(90): n is a, c, g, or t
  misc_feature (119)..(119): n is a, c, g, or t
  misc_feature (145)..(146): n is a, c, g, or t
  misc_feature (155)..(155): n is a, c, g, or t
  misc_feature (159)..(160): n is a, c, g, or t
  misc_feature (162)..(162): n is a, c, g, or t
  misc_feature (168)..(168): n is a, c, g, or t
  misc_feature (171)..(172): n is a, c, g, or t
  misc_feature (193)..(193): n is a, c, g, or t
tntancnacaggcttccacggnctnnacgncattnttggntgaantttcctnantatgntgcttcatccgcgaagcnaananngcaacantacatccaaacatcactttggcttcgaanccgaccgcctgataaagagcattttnnaaatgtggncttnncncatccnctnnatgtccccatctattgatganggtcttg

SEQ ID NO: 689311 - DNA, 464 bp, Homo sapiens
ttcgatgtgggactcagagtgggactatggctgcggagtggaggattacgacgcggcagatgacgtgcaggtctccaagacagctggagctgcgtgtggcttatctggaccccctggagctcagtgagggggaaggtgctttccttacctctaaagagcagtgcagtcgtgaactgctccgggcatgaggctgccaaccctgtcctatgctgtagcaaggactccactcccgtgggcgatggccactatgctgtcgctcagttctatcatcttcgattccaatggcacctacgtatgtgcaggctctctgccgacagtcgcggtcctcagccgtgaccagaagttcacgctgctggtccaaggctcgcctgaggtacagacagcgtgaacatagagcccaaggcagatggcagctggagggaaggagacgaagtcagactcatctgctctgaccgtgggcttcc

SEQ ID NO: 689312 - DNA, 297 bp, Homo sapiens
taattctgtaaaataaaactcaaatttaacaggtttatcaataacatcatcaaaccttaaaacaatatataaggatatgatcagtgaaaacaagcagtgaatggggagctgaaacactgattctagctctcaggactaaaattacctgttaaccttgggtgaacccattaaacctgagccctcagtttcctcaggtgtaaaactcaggatacacccgttcagcaaggattctgtgagagcatccacctacaacagtgattcccgcaggcccagggctggaaccgtgctaatctcaat

SEQ ID NO: 689313 - DNA, 129 bp, Homo sapiens
aagaagtcaccacagacccactggtgcattatctgtggtggagctgggcagtgtatgagtggagggcaggctaggtcccactgttgtcttgcatgtcctccccagcaactccgagtcttcttctcgaaa

SEQ ID NO: 689314 - DNA, 679 bp, Homo sapiens
agcgtgtgtgtgtgtatatatatataagtgtgtgtgtgtgtgtgtgtgtatgtatatatataatttttttttttggagatggagtctcactctgtccctaggctgcaagggcgtgttcttggctcactgcaacctctgcctccgtgggttcaagggattctcctgcctcagcctcccaagtagctgggattacaggcgcccgccaccacacctggataatttgggtgttttcagtagagacgggggtttcgccatgttggccaggctggtctcaaactcctgatgtcagatccgcccttctgggcctcccaaagtgcttagattacaggcgtgagccaccatgcctggcctatatgtctagattttatcattccctttgcgtggccttttttttttttttttttgggggaaagatgtaaaatgttccacggttcccagagagaatccagagggtgtttttttttacaaaggggtcccggggttctactgggggctcctaaaagaagggtttcccccgggatattcctatattaagaacggtttcacaggaggtggtcgcgctttatagaaattaacaaaggcggggtcaactttttcctaatttgcggaggagggggttccccactcgtgtgggccccaggggcgggagcgccagggggggcaccggggcccccccaaa

SEQ ID NO: 689315 - DNA, 715 bp, Homo sapiens
tcattctccagatttatgaacattttttcttgagcaattggtaaagtatacttttgtaaacaaaaattgaacacatttccttttgctctctatctgagtgccccagaattgggaatctattcatgagtattcactatgtttatggtaataaagctatttgcacaagtccaaaaaaaaaaaaaaaaaaaagaacaagaacaaaagtgtgtggcggcgcgcgacactgcggacaccacggagaaaaagactctttctgagaacaactggcgatggaggcgacgcagggcgaccccacagaggagagcaagcggaacaccggtcggcccacaagcgggagtcccacagggagaaaaacgcgggcccaaagcaaaacagcgcgcggtggaatctttgcccaccaaaacagaaaaaaccgcgcgcgggagagaacacaagggaagcggcttcaaggacacaacaaactccaagaagcgagggaacatcccagaggagacaccaaaacaaaggggggaactataactctcaaaacagcgagagaaggaaaaaaacaacagaaaaaaagatcgcaaagaaaaaacaacaaagcaatccagaaaagccccacaacacagaaggggcaccccaaacccaccacaagaaaaacacacacaccacacgagaccaacaaaccacacccaacacagaccaacaacacacacgccaacaaacaacaaga

SEQ ID NO: 689316 - DNA, 372 bp, Homo sapiens
cgcaatttgcaggatccagaagagcgtgtctttttatatccattcctgtgcatgtcattggtctctcccaccgatttcattactggtgccacggcatggtcatggatctgggtagtccggagaacaaagggagggaagacagcctggtagtgaataagatgcttaccacagctttctcatgggaaatacgtgatagaccctgttcatcgtttttcgtattcctgtacgaatcagaacggggagatagaaacatgaactgaaaagtctggcaatgacaagaggttccagggtcttaaaaagatactttatgtggttgaagatgaaatcattcctaaattaacctttttttaaaaaacaaaccaaggtatctcg

SEQ ID NO: 689317 - DNA, 353 bp, Homo sapiens
tagattcaacagcgaggggcctataatatcagcagtttcatacaaatcgggcagaagtaaaggcagatgtagctctgagccaaatataaacgctgagagcgacagcgagacaggtaccattcaaaggccagcctctaccgactaagcaaactctgaaaactctaaatctaacctaggccgggtgccgtggctcttgcctgtaatcccggtgctttgggagggccgatgcgggaagaatgcatgaggccagaagtttgagaccagcctgggcaagatagcgagaacctgtctcagcaaaaaataaaaaaattagccgggcatggtggtgtgtacctgcagtcccagttacttgg

SEQ ID NO: 689318 - DNA, 426 bp, Homo sapiens
tacggtggctcacgcctgtaatcccagaattttgggaggccgaggcgggtggataacgaggtcaggagatcgagatcatcctggccaacagggtgaaacctggtctctactaaaatacaaaaaattagccaggcgcagtggcacgcactggtagttccagctactccagaggctgaggcaggagaaccgcccgaacccgggaggcggaggttgcagtgagccaagatcacgccaccgcactccagcatgggcaacaaagcaaaactccgtctcaaaaaaacgaaaacaaaaactcgaccaccctccacctagaatattttagtttttttttcgagacggagtcttgctgtgttgcccagactggagtgcagtggagcaatctcagctcactgcacgccagcctgggccacgagtgatctccgtctc

SEQ ID NO: 689319 - DNA, 246 bp, Homo sapiens
  misc_feature (209)..(209): n is a, c, g, or t
gtggaatttcaccttatgaatgtgtgagtcaatactccttaataaactctccttcatatatacagctatcctattagtcagggttatctagagggacagaactaataggatagctgtatatatgaaggagagtttattaaggagtattgatcaagatataaggtaaatccaagtgaggggccatcttgcaaagcctgaagttttccaanagggaagcctcagtgtgaaggttccccaaaaaccttc

SEQ ID NO: 689320 - DNA, 119 bp, Homo sapiens
  misc_feature (117)..(117): n is a, c, g, or t
atgcttagagaggagcagtctctttggtaaactcaggcagttatgatgaacagaaaatcgccgactgatactgtaatagagcatagacctaaggccactccgtagctggcatcaatnca

SEQ ID NO: 689321 - DNA, 2504 bp, Homo sapiens
cggcttcaagaggcgcaggctgctgcggtcggtcgggaaagccccgtgggccgctggcacctcctccagtggtccccaggcgcagcagcaccgagggggcggccccaggcgcagtctgcatggtggaggcccgcctgtcggatcccccggggcgagccgctcccccgtgacgtgggggaggagcgccggggagggggcgggacagagctgggtccccctgctcctcctcgaccccgcaatggctatcagtccccacctggcacctggtgggtgtggcgtggggccaagaggagaaatagctgtagctgtagggggaggcgggggaggcttcaaacatccggccttcaagaggcgcaggcgggtgaattcggactgtgactctgtgttaccttccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagccaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctctagcccttctattctcccaaggagagagattcccatttctcctcggccattgtacctagctcttgtccctagctgcatttcagtggaccatggatagagggactgagggttagacggagaagactggcagggaggcacgcaggtactgtgaaaatccttccctttgccctcccccagtgggagagggggttgggttttcaatgtgagaacagcacaataaacttgatgtctagggcagtggcccccaaaaaaaaaa

SEQ ID NO: 689322 - DNA, 251 bp, Homo sapiens
tcaggtcactctagagatcccctaccgttcttataaccaacaaattaatagagataaaacataagaatgtgaattggtatttctggaggtacggattggtctctggaccactttactagaagtgcctagttatgctttttgcacattcatactcctcggccctaaatcagacttaacaagtcttctgtcgagcatcattagcaaccctcttagttgtcttaaacactgccttgcatcctatggtcatagaa

SEQ ID NO: 689323 - DNA, 157 bp, Homo sapiens
cagacacagactggacatgggacgccagaggcatgcagagggggcagacacaccagagactcggggcatgggcatggagctctgcccgctggcgtgcccccacctccaactactcgcccctgggacttgcacggcagagactgtggcggccagagca

SEQ ID NO: 689324 - DNA, 506 bp, Homo sapiens
  misc_feature (20)..(20): n is a, c, g, or t
  misc_feature (90)..(90): n is a, c, g, or t
  misc_feature (93)..(93): n is a, c, g, or t
  misc_feature (103)..(103): n is a, c, g, or t
  misc_feature (117)..(117): n is a, c, g, or t
  misc_feature (140)..(140): n is a, c, g, or t
  misc_feature (159)..(159): n is a, c, g, or t
  misc_feature (175)..(175): n is a, c, g, or t
  misc_feature (199)..(199): n is a, c, g, or t
  misc_feature (220)..(220): n is a, c, g, or t
  misc_feature (232)..(232): n is a, c, g, or t
  misc_feature (236)..(236): n is a, c, g, or t
  misc_feature (336)..(336): n is a, c, g, or t
  misc_feature (500)..(500): n is a, c, g, or t
tttaaattggtaagagaggngggacagagtggtagaagaaggggaagagaagtggtaatttaaagtgatttggtagagaaagtgcgtggnatnggtttttggntggttttggttggnaggaacccatttaagctccaggngaggggagagatgagatantgggatgggggtgggngtttttagaagggacccagggganattgggtggagaaatggggtngttgattttgcnaganaatgtgcttgctgttggtaggttggcctgagaatcccaggggcagcttcagacattgtggggactcagacccaccctctcagtctgcagctgtggcagtnagaggtttggcaatgtagccatggtcacctggacatggcccaggggcagggtccaaacaagaaccctggtgcctcccgcccctcctgctgagccatggtgccacctaagccatctagaaaggctcaactttttgggagacatctgcggcagggccactggaggnaggaga

SEQ ID NO: 689325 - DNA, 491 bp, Homo sapiens
tggcttgcgcatctactgtgtttcctcctgcactgttgtctatggttaatcacacaatagatctcttctactcatctcttcatagatacttcctttataatttacacaacatttagtaaaagacacattactaagttaagtacctgtgcttaatgtgtatacatcgtttacgcattattaactgtaatagtagcaccgtatcttgtatattcacttaaatcaaaaactgagctatgagacctggttccggggcgcaaagcggacaatatgcaaagcaggaagttgcagttgttggcgcgccaggatcttgtgtcccaaatgaaactactgagtacaaatgctgacagacaatacttacaagaggctcttcagcaccttcttctgtgaaaaaccagtcatgctaagatttaaaaaaggtgagaagagaaattaaacaagcctttaaatatactgagatcttggaggatagtatagaaaaagggtaattttct

SEQ ID NO: 689326 - DNA, 1003 bp, Homo sapiens
gatgccctgacaggagcgatagctgcagttgggtgacacggcgtcctggctttgccgcgtctgggtgttagtacgccgataattagagacgcacctatcgtgcgagcgtccatcatctgccatgccgcgctttatagtaatcgaagaactgaccgcagcggtaagtatcttcgggtagtcgccgcgcgcatcgatccacggctggcgtagttttgccagcccttcgctgcacgttacagtggccttctgtctgcgagtcaccgatacgggccggaggtgtctggttgaccggaatcgcttcgttcttcttcggtactgcggctgtgctttgctaccgccaggtttatcgtcgggctaatctggatctcacgcatcggctcagcgcgactgccggggctgtgtgccagtgatataagatgcgtttcgaagttgggaaaggcctgttgcccttccagggggtgtcggatctagctgtcgggcccgggcgcgtctgttcgcgagcggcggtcgaagcttgtgtgtcgccgcgaccgtacgtcttcattcctaagaaaagttgcatcgcttggtggtctcgtccggaccgatctggatgcatccagagactgcctcgcctgcacggggcgatgcgatgcgaacttaggtctctgtcccttctgcggtattccctgatcaggtcccgcgtattccgaatagacggactcagtcgggtccaggcacctccgtactttgagattagactcgaaattgggcgttcagatgtgtattaagcgtcacagcctgagttaaccaggtcgtttgatgcgggctggttgagagcggagaaacgcttgttttccgaaaaggggtccaggctcgcgttttgctaactccgtaacccgggatatcacgcctgcgctcacagagcctatcaatctggttgttccttagcaaaccggggcgaaagcgccctctataaacacaaggtggaggcgcccacattgtaaggaacctaccattgatt

SEQ ID NO: 689327 - DNA, 441 bp, Homo sapiens
tcgccccgggttgtttttaaaaaaaagaattttaaagtcccaccctttcaaatttaaacctttttgattttttaaaaaggggtttgtttttaaaaaaaatttcttttaaactttttccagaattggggaaaatgggtttttcaaaacttcaaacgtcaatccgtttttgcttagggtgggtctttgaaacccctttttgttccctcgtaaagggcccttttgttagaagtaacccattttttgcccgaggaaaaatagatctcccacagaaccattcccaaactaaagataaaaacctttggggctggggtgtatgttttattaagaaaatatactgtttaaaaaaaagggcctttccattttatagccggggggggggtaataaaaaaaccctggctttagtgcaacacttgtgtaaaaacctatgggggaacatatatg

SEQ ID NO: 689328 - DNA, 881 bp, Homo sapiens
  misc_feature (1)..(1): n is a, c, g, or t
nggttgctgaggtggtcccccgttgccgcggaggttgtgtttcgcgggggctggggcgccgtaagtgtgggccttcgtgcgtccccccgtcagtgtggcgctgggtgctctccaggagggcgcgtcccgccaatttcctctttgtggacgccgggggcaacaagcaactgttcgaccctcctgggtagtcatgcgtagtgtcagggaggacgggttctccgcgaaaggctagtcataggtggtgcgcccatctcgccctgtcacggtgtccgtgagacaagagatgtccccaccgtgttttgtcgacgaaagcaggtggaggccccactttccagcgcgatgagccgcacgctgcgccgcataggatgggatcggccggtcgtggtggcactcacacaagtcctcctcccgggctccacgcaatagagtgccacgcttgagttagtgctcgatctaaatgtgagtgcaaggttttgacctccgcgtctgtgttaacgagcagaagtttgttgccagaagcgcgcaagtggagacagatcgaagggaaccccctcgacttgttcaccacagatggcgtgtgcataattaggacttcttgcttccacgattaccatgagccccacgtcggcgtcttacaccccccccttttaaaagcctctcttctctcctccctccttgtggaaatagaaatgaacagacacatcacatcatctcagagcagtttcttacgctcgacatctgctcttgtgtcagtgaggcctgaaactccaccaccccctatgtatgagaaataaaagatttatcttctatcttctcaattgtccccctttttcttttggggtccacagaaagaaaaaaagggaaccaacccacatagacaa

SEQ ID NO: 689329 - DNA, 289 bp, Homo sapiens
ccagaggcaccaaggaggccagaggcaccaaggaggatccaggattattttattttatgtttacgatggggttttactcttgttgcgtaggctggagtgcaatggcaccatctcggctcaccgcaacctctgcctccagggttcaagcaattgtcctgcctcagcctcccaagttgctgagattacaagcgcctgccatcacactcggccaatttcgtatttttagtagagacgggtttcttccatgttgatcagactggtcttgaactccctccttggtgcgtctggg

SEQ ID NO: 689330 - DNA, 481 bp, Homo sapiens
  misc_feature (6)..(6): n is a, c, g, or t
  misc_feature (121)..(121): n is a, c, g, or t
  misc_feature (125)..(125): n is a, c, g, or t
  misc_feature (186)..(186): n is a, c, g, or t
  misc_feature (200)..(200): n is a, c, g, or t
  misc_feature (207)..(207): n is a, c, g, or t
  misc_feature (321)..(321): n is a, c, g, or t
  misc_feature (328)..(328): n is a, c, g, or t
  misc_feature (339)..(339): n is a, c, g, or t
  misc_feature (344)..(344): n is a, c, g, or t
  misc_feature (376)..(376): n is a, c, g, or t
  misc_feature (387)..(387): n is a, c, g, or t
  misc_feature (400)..(400): n is a, c, g, or t
  misc_feature (409)..(409): n is a, c, g, or t
  misc_feature (455)..(455): n is a, c, g, or t
tggcgntacctattcttagaagcctgttgaatatcagtcttgttaacaagtgacactgttgtacattctcctgctggttctcactggcacaagacagcttcatagacacatacatattgcncaanattctatgacaggtttccactggaaaaggtttccacctggtctctgctgtttctctacagntaggggcttaagtncctctgngtcactgttcattgttacccagtgtgcttcctcttgtgaagggccactgtatgcctatgccctttacttcattggcatagagctcgcgcctggcatcataatggcgcttggtcntagcgcnaagagctcatnttaantatggtcaggcaatatgcgtgcaggctactgngccccctctcncattttgggcaanccaaaactntggagaccgttttacaaaaaaattcattcaaaggaacatcaaaaantggagtatgttcgtttctttttttgt

SEQ ID NO: 689331 - DNA, 362 bp, Homo sapiens
  misc_feature (11)..(11): n is a, c, g, or t
  misc_feature (331)..(331): n is a, c, g, or t
gtacaggaganaatggcataggaagccgagaattagttccacagacccagttctgatgaattccagcccaaaagaaccaccctgacaatttttaggttctaaaagtctcaattattagacagtattgcacagctattgaaggaaaacaattcactcattctatagggcggcttagttgtcttgggcaaaagctgtataatggtaccacaaaaacagttacatggtggagttccaattacacagaaagaaatccattcagtaaatttccaaagttgcagactgtttaggcccacccaggattccaccagggctgggacagcccccaccaggnttattactgggatatgtgggacacagggctt

SEQ ID NO: 689332 - DNA, 1663 bp, Homo sapiens
  misc_feature (2)..(2): n is a, c, g, or t
  misc_feature (1181)..(1181): n is a, c, g, or t
  misc_feature (1326)..(1326): n is a, c, g, or t
  misc_feature (1401)..(1401): n is a, c, g, or t
tncggcggctgtccacggcgagtgtctgttgtgctgtcctatgtgcggtgtcttctgttggtcttcatgctgggtcttgttgtctcctgtctctatgtagtcgttctcttgttccggttctctgtgattgtcgtgtctgatgcaatgcacttgtgtcgtgcgttgttagcagatagctatgaccgtgttgtgtgtgaggtcaatccaccacccccacgtttgtttgttttttgtgggcccacgagagggtgcctctttttgatggttttgtactattccccgtgtgggcggcaatttgcctcccctttatcgtggcccgcttggcgaaagagggggggatccctccccattggtgtgttggtgctttttcttcctccttgaggagactcccttgttgccgcgtttacgtgtttattccctctgtgtgataatcccatccctctttggtgatttctcggagagaatatacaggggtgtttgtgagatgtaagtggagaaaccacccccacagagaggggggacacccgagattgttgtggttgtataacgccaccaatggtggggaaatttatagtaaaaattggagagagtgattacttcccccgccagcggttgatgttccacattgtgttggggaagtagtgtttttgaaggacctttatttgtgaaaagaaccctcccttttgttcccttttggtgatttcaccgcctttctttaaaaatttaggggttaaatctatataatgttccccccccccctctcttggcgttgcctttttcgtgttgtcccccctggcccccctccccccacgtggagttataaacggaaaatatttggattaaaaatgttgttttctcgctttgtggcccacatgtgccaatttccgtctaaatgtctttagaaaactataggatcctatatagttaattataggcccacttgtggtgtaaccctcgaaacactctggctaaaacgcgtttttgtctacacccacgctgggttttccacagattttataaaaggtcgggctatagttggtgtttataagaagacacacctcgtttcacaaggggagtataaggcccctccttctgggtgacactctgtgggctctatattttgacaggagaatccacgcttggtatgggagagccacagtgagaaagtaggatttcctatngggagagtaccacttgttctgcaagatgatcccacccactctgtgtctcgagagaattcactataaataaagttgtttatatatccacgcgttttctaaacccgctctgtgggctggtaacacacacaggcacgacccacgaganaatgccacatctggttacacacatataaatgaggagaaaaagccttatttatatggctgagatggaggcacatgnctttttataaatcccttttataaaaccaccgtcacccactatttaaacttgcacatttgaggcttgtgtgttttctttgttaaatgtgtagagttttacctctttctcgagaattgccacgctgtgtaacttgggcttaaactccagagaccacgcttttctttctggagttcctctaatttgaatttaatttaaccctaagttatattttaatattgccaatattaccataagtgggtaaaaagtcaaattcctcttttga

SEQ ID NO: 689333 - DNA, 861 bp, Homo sapiens
tgggggtgtggctaatgacatgtgtgagctctagatggtgtgagaccaccccaaagccaagaaatggctacagccgtgtgaaccagaggaccagtgatctttggtgaagaagagggaattctgatggtgaaactggaagatgatttcacctgtcggccagagtctgtcttacagagggatgaccctggtgcttggaaacctcccacgcagaacttcctgacgcttcctgctaccaggaggcagcaatgccctagatgaaggctctcatcagactccgagaactttgtcaaccatgtggcttgagaccatgagaggcggacaaatggagcatgatcctagagctgcttgtgctggaacaatttcttacctgtcactacctggagaactacatgagcttgtggttgcgtggtgccaaacgagccagaacatgtgggtgaggaggcagtgaccgctggtggatgggtatgccgaaatcaagccagtgatgaccaacttgcgtgtggggttgacttgtcccaatgttcacggccagtgaaggtcctgtccagagtgatgactgtgtgcaattttaagagaagttggaaagaccttgaagattcaaccgttaactgaaggcttgtcaggtgattactttgttggcaaaggtttcgaaacccccactgaaggccaagactttccttgatgtgacacaccaacgactacgaagccacaagacatctttggggggtgcagcctggtcaagtatgcatatagattcccacacccatggacaagcatcgagcttaccatgaatccttggagctgaagagccgatgtcccagttgctcggaggaagccagagcttacctgcagatgatgatg

SEQ ID NO: 689334 - DNA, 416 bp, Homo sapiens
cgtcgacaatgtgaatttggaaaaacatctttgaattatttgggtcatatagtagggggtggtgaattgaagatagatccctctaaggtggaaatcattgtgaactggcctaaacccaaatctgctacagaagtgagaagcttctttggagcagcgcaatattggaggaagttcatttctagctttttcttaattgcagctcccttacatgctttaacaggattgaacaaggtgtttcagtggggaggcaaacagaaaaaaaccttcgacaccttgaaagaaaatattagtacaacacctgtactagcactatctgatcttcaaagaccattcaagatccaaacggatgccaatgactatgccatgggagcagtgttgacacagcatgataaacccatatgttataatgtcgacgc

SEQ ID NO: 689335 - DNA, 348 bp, Homo sapiens
cgtgccattgtgcaaattcatcacatgctcagggggaggtcataaacaggcactcttgtacatagacaaacatctgctaacactgagttttcaaaagcagcacgtttttaaagataccgaacagctcggacatcttatcttgacaaactctattttatttctattattttttgagatggagtcctgctccattgaccaggctggagtgcagtggcacgatcttggcccaccacaaaccccggctcctgggctcaagaaattatcttggctcaggctccagagtagttgggattacaggcgtgtcccaccatggcacgtggatccacaatggcacgtggctgggtaccg

SEQ ID NO: 689336 - DNA, 883 bp, Homo sapiens
accctttcctgccccacttagcgtggccgcgagcctcggtgagccggccgtattcccgtctctcgcttatgtggggcacatggcgcaggtatcggcccggcgactccaagccttctggtgcgcgggcgcgtctgggatacgggcccgggaggcgccgcctcgtcgtgtccgcgccggtgcctctcagtgaacagcgaaccggagaagcaggcgccggagagttgggctcagtgcagagctcgggccggggcccatgcccgtgcgcccctgcaggccggcgccatggcctccgggagtgtggccgagtgcctgcagcaggaggaccacctggcccggtgtgcctgcagtacttcgcagagcccatgatgctcgactgccggccataacatctgtgtgcgcgtgcctcgcccgtgctgggggcaccggtagagactaacgtgtcgtgcccgcagatgccgggaagaaccttcccgcagaaggcaacatgcggcccaaccgggtacctggccgaacgtgacccaactggtaaaagcaagttgcggcaaccgagcaggcctgtcggggcccgggcggcgaaatggggctgtttggaaagaaagaaaccggtgagcccctgaaagctgtaacggccgagggaggaccaggatgccccatttggcgtgtgtgtgcgaaccggtcccggggagcaccgggccaccgttgtgttggccgtacgaagaaggccggtggacgggcttcaacgggcatttcagagcagctcgggccatttaccaagagtggcggtttcaaagaaacttcggccccgtgggacactgcgaggggactttgagcctacccatggaagggacaatgtgtggctccaccagttttcctaaagccattc

SEQ ID NO: 689337 - DNA, 289 bp, Homo sapiens
  misc_feature (9)..(9): n is a, c, g, or t
caggtctgncacatgctaaacaggaagatggaacatcgagataaaacttccccacagaatgtggcatgtgacacttccctgagcagtgaatggacaggtgagcagttccacaccagcgcagaggcagagagcccgatgtcccattctgctccgtgccttgctagaagattggaaaaaggtcaaaccacatgcctgtgatgaaagtgcgaactgtttagaaatactggtagtagaaccaggagtaagaaaagctttaccagcttttactacaaatggatgaaagacatca

SEQ ID NO: 689338 - DNA, 313 bp, Homo sapiens
cacagatgtatggtaagttctcacttaatgttcaaaatagggtgttgaaaactgcatctttaaccgaaacaatgctgatatatgccatttaaacaacagacctagcagcacccttgtgacacaatggccaggctaggctggaactcctggccttaagtgatctaccaccttggcataccaatgtgctgacattacaggtgtgagccaccatgcctatcctggctaatgtgtgttttttaaaatttgtttttacagatggggacttgccatgttgcctgtgctgggcttgaacacttgggctcaagtgatctac

SEQ ID NO: 689339 - DNA, 282 bp, Homo sapiens
ggccgccctatttttattatttatttaagtaaagatggggtttaaacatatgggtcacgtcacgtggggtcttgaactccgtggaccttggtgatccaccccgcctgggcctcccaaaggtgctgggattacaggtgtgagccaccggtgcccggccaagtaaaagtgtttttaaaaagggtaatggtggattatctcataaaaaataagggggtcacagtctatattaaaactgtttaaagcacacatcttatggaataaagagatgagaagcttaagttg

SEQ ID NO: 689340 - DNA, 231 bp, Homo sapiens
  misc_feature (6)..(6): n is a, c, g, or t
  misc_feature (18)..(18): n is a, c, g, or t
  misc_feature (38)..(38): n is a, c, g, or t
  misc_feature (72)..(73): n is a, c, g, or t
  misc_feature (103)..(105): n is a, c, g, or t
  misc_feature (110)..(110): n is a, c, g, or t
  misc_feature (149)..(149): n is a, c, g, or t
  misc_feature (155)..(155): n is a, c, g, or t
  misc_feature (164)..(164): n is a, c, g, or t
  misc_feature (169)..(169): n is a, c, g, or t
  misc_feature (183)..(183): n is a, c, g, or t
  misc_feature (187)..(187): n is a, c, g, or t
  misc_feature (193)..(193): n is a, c, g, or t
  misc_feature (203)..(203): n is a, c, g, or t
ccctcnctgccccctcanagctgacattctggggtggncctttcattttgccacgtactaacgttctgcacnnaagacaggctagactcttgtctagattgtnnnaaagnaacttttcaaattggttacattaattttagtttattttnacaagnaaaaatggnttttnatttagattctttntgtnccaggntgttgatctnaaaatagttgcatttaaagagttttttt

SEQ ID NO: 689341 - DNA, 445 bp, Homo sapiens
ccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccagcatggtgaaaccttgtctctactaaaaatgcaaaaattagctgggcgtggtggtgggcacctgtaatcccagctacttgggtggctgaggcacaagaatcgcttcaacctggaagccgaaggttgcagtgggctgagattgtgccactgcactccagcctg

SEQ ID NO: 689342 - DNA, 516 bp, Homo sapiens
  misc_feature (44)..(44): n is a, c, g, or t
  misc_feature (57)..(57): n is a, c, g, or t
  misc_feature (77)..(77): n is a, c, g, or t
  misc_feature (89)..(89): n is a, c, g, or t
  misc_feature (141)..(141): n is a, c, g, or t
  misc_feature (183)..(183): n is a, c, g, or t
  misc_feature (191)..(191): n is a, c, g, or t
  misc_feature (322)..(322): n is a, c, g, or t
  misc_feature (345)..(345): n is a, c, g, or t
  misc_feature (369)..(369): n is a, c, g, or t
  misc_feature (379)..(379): n is a, c, g, or t
  misc_feature (408)..(408): n is a, c, g, or t
  misc_feature (433)..(433): n is a, c, g, or t
  misc_feature (497)..(497): n is a, c, g, or t
  misc_feature (509)..(509): n is a, c, g, or t
  misc_feature (512)..(512): n is a, c, g, or t
cccttgcgaagatctggggcctcccgggaggagagagggctttntccttgaaacccnggacgccaggggcgctctcncaagtgggggtnctctgggacttggaacgcctcggatgggtggtgtccgggcgtcctttctccncttcttcccacttcggctggtcccgtttcctcttgcgctcantgcggacntgtctcggcgcccgttgccctctcatcgccccacgcaggatctcggcctggtcaccgggcagtgtgattcttcccgactgccgttgggacagcgaggcacacacagggctttggtctcgttggaggtactntggtctgtttgagttgctcttgntctcccgcttctcccaggcgaccnggaggtagcntttcccaggaggcacggtctccccctagngggatgggcaaatttatgttagatntgatgagaatgaccaatgaaagcatgaggaaatggttctgagtttcacttgagcagtggcgggnggggatgaacangtngcaa

SEQ ID NO: 689343 - DNA, 683 bp, Homo sapiens
  misc_feature (39)..(39): n is a, c, g, or t
  misc_feature (72)..(74): n is a, c, g, or t
  misc_feature (76)..(76): n is a, c, g, or t
  misc_feature (118)..(118): n is a, c, g, or t
  misc_feature (150)..(150): n is a, c, g, or t
  misc_feature (165)..(169): n is a, c, g, or t
  misc_feature (177)..(177): n is a, c, g, or t
  misc_feature (191)..(191): n is a, c, g, or t
  misc_feature (193)..(193): n is a, c, g, or t
  misc_feature (286)..(286): n is a, c, g, or t
  misc_feature (314)..(317): n is a, c, g, or t
  misc_feature (322)..(322): n is a, c, g, or t
  misc_feature (327)..(327): n is a, c, g, or t
  misc_feature (353)..(353): n is a, c, g, or t
  misc_feature (358)..(358): n is a, c, g, or t
  misc_feature (362)..(362): n is a, c, g, or t
  misc_feature (365)..(365): n is a, c, g, or t
  misc_feature (378)..(378): n is a, c, g, or t
  misc_feature (381)..(381): n is a, c, g, or t
  misc_feature (388)..(388): n is a, c, g, or t
  misc_feature (390)..(390): n is a, c, g, or t
  misc_feature (406)..(408): n is a, c, g, or t
  misc_feature (413)..(413): n is a, c, g, or t
  misc_feature (423)..(423): n is a, c, g, or t
  misc_feature (432)..(432): n is a, c, g, or t
  misc_feature (438)..(438): n is a, c, g, or t
  misc_feature (498)..(498): n is a, c, g, or t
  misc_feature (514)..(514): n is a, c, g, or t
  misc_feature (544)..(544): n is a, c, g, or t
  misc_feature (582)..(582): n is a, c, g, or t
  misc_feature (598)..(598): n is a, c, g, or t
  misc_feature (623)..(623): n is a, c, g, or t
  misc_feature (625)..(625): n is a, c, g, or t
  misc_feature (627)..(627): n is a, c, g, or t
tttaattaactcatcaacctctcatggcaagaatttganaaagtaaatttatactcaggttctaattttaannngnaaggaagaagttacagctcagtgcaccatgaagttgagaaanaaatggagaaacctcagccccacctctctggnacaggaaagatgatnnnnnagggagcncaggtcagcgtggnangagggtcatggtggacatgggggtggggtggtctccccacctcctcacattatgcctacacgaacacagacacatgcaggtgcctttgcaganacaaagtcagggttcttcaagtcacagnnnncaggncaggnacaactcttgcctctcagtgccacanaaggnagcngtntcacactttacangcngtgagananacatcagagccctggnnnctgtnactgcttgcngcctgagtnttactncctccttttctatctgagctcttcctcctccacatcacggcagcgaccacagctccagtnatcacagctccaaggngaactaggtcagctatgatgcccacgatgnggatggtgggctgggaagatagctcccatcttatgttnttgtgcttgggcagancctcatgctgcacatggcaggggtntntnttctcctctccagaaggcaccaccacagccgcccacttctggtaggttccatcccc

SEQ ID NO: 689344 - DNA, 355 bp, Homo sapiens
ccaatctactttttatctctatgtgtttgtctcctctgtacacttcatataaatgaaatcatacgatatgtgctcctttgttgctggcttctttaacttatgttttcaaggctcatctatgttgtcacatgtttctagtactttctttttttgctgttgctgaataatattccatagaaaggaatggataaccacattttatttatccattcatcacttgatagacattggatatctctactatttggctgctatgagcatttgcgcacatgattttgtgtagacatatataagtatatggtgtataaaatgtgtgtacatcgagtgtatattttatacatatgtatatatggga

SEQ ID NO: 689345 - DNA, 1194 bp, Homo sapiens
tccctgtggaccaaatattttttttggaaaccccacttggtggcaaccacggggctaggtgcgggaaactcagcgagtggggctccagcccaagctcacgccctcgaggggatctacttctctaaaagccggttacctaagaccaaacttttgccaacaaaatttctctctcccgtgctcgggggcggggatcggaccaggggatgggaggcaggtatgtgtggctggggacaaggtgaggcacgctatggactagagtagggcctatctaccctgcagactttgtgcccctcacaggcacctgggggagagtggcaggcagggtccgctcagggtggttctacccacactgctgtttgttggtgtcacccggggccccgagaaccacgcccttccagtaggacgggatgtccttgccccccggtgctcaaatgcggagacagaagctgaaaccgcccggggccctgtagtcgtgaagaaggtgtggaaagatctccaatccagcccccgcgcgtgacaactggtcttgggggcaactggcccacctggcccgtctggttggaaacttcagccgagcgaggttctccgtggcttcgggacgattaactctaacaggggtggagcttcgtagaaagggccaacccgagggtactgtctaggggcccgtagtaacccaagtctcttccacccaatgataatgggcccgggatgaaattctgtgtgctccaaggagagtctcccctccccacaagaatgaagccctctacaagactcggcagggtacaatggacccttggttggccttggccggaccacccatcttccaaaaggggaaggaaggccgaaagaacatttccttaaggaacggctccaccactccggggggtagaaacttcccacccccaagtggttcctcccacagaggacggtttcctacacagccgcttacagagggtgtgtcaccccacgaagtggtgcccaggtgtaaaccagcaggctttccaagggtccttcttcctccccacgggtgttttaccgccagaaggggtttgtcggcgcccgaggtgttcctcaggagaggttatacactggtcggtccagggatggttggggtccacacctccagggcggcgcccctgtgggacaccagcccctctgttgtgcactgtggcgcccaggggtgggccgtccaca

SEQ ID NO: 689346 - DNA, 129 bp, Homo sapiens
ccgttgtcatgcccactttagatgtatctaagttctcctgactgtctacccaggagagtgtggaggtcttggccctgtgccctgtcctaccaattaacgtagaataaaaacataccccactgacaacgg

SEQ ID NO: 689347 - DNA, 125 bp, Homo sapiens
gggatccagcttatcctgttgggcaaggtgctgggagtgaaggcaggtaagccatgtcaagggcctgggatccagttttccccttgcttcccaggcccttgacatggcttacctggggtaccgag

SEQ ID NO: 689348 - DNA, 98 bp, Homo sapiens
tgaaggagcggggactgttccgtggcattgaggacaaccccatggtggtgccactttgcaaccggtcgaaggacgtggtagagcctctgctgcggccg

SEQ ID NO: 689349 - DNA, 115 bp, Homo sapiens
ggccacaccaccctttgttataagagggcttctgcctaggctttggccgggccatccctcatgcctgtgtggggcccctgcagcagaggggccggggcaggtggtcttccaggcc

SEQ ID NO: 689350 - DNA, 843 bp, Homo sapiens
  misc_feature (220)..(220): n is a, c, g, or t
  misc_feature (237)..(237): n is a, c, g, or t
  misc_feature (242)..(244): n is a, c, g, or t
  misc_feature (251)..(251): n is a, c, g, or t
  misc_feature (258)..(260): n is a, c, g, or t
  misc_feature (280)..(280): n is a, c, g, or t
  misc_feature (282)..(282): n is a, c, g, or t
  misc_feature (311)..(311): n is a, c, g, or t
  misc_feature (316)..(316): n is a, c, g, or t
  misc_feature (330)..(330): n is a, c, g, or t
  misc_feature (340)..(340): n is a, c, g, or t
  misc_feature (347)..(347): n is a, c, g, or t
  misc_feature (405)..(405): n is a, c, g, or t
  misc_feature (841)..(841): n is a, c, g, or t
ccctctctcttgctggccgcacgccccggccccgcgcacctccgcccggctccgcagccgctacccgcgcttcgttgccctgtgggactccgagcgagcccggaggaaccctcctcttcttctgggggcgacttttgtttgcttgcctgtttctttctggtgacttttgcagctttccaatatccgtcttcggagcgcacgggaatccgccgagctctgngtgcaggcccttttttnttttnnngttcacnttttttnnnattttacgccagggcttttntnatttcctcccccgcccgctgacggtcctngagtngctcggggctttangccggttatncaacgtntaccgctcggggctgccggctgcacctccgccgcgcctcgccgctcactgcgctaganccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctaaccgccgagtatcgcgaggagggtgccgcagtggcagccgcgtccgcggcganga

SEQ ID NO: 689351 - DNA, 305 bp, Homo sapiens
tgaggagtactgaacagagctcgccttctacttctggatgatggtgacgctcgactcctgctgagaacgacggagcgacgcctgctgatgtcatgcggaccttcagcgcgcgtccgatcatagacgagctcttccaggcaggtctcacccggagcccggatactacactactgccttgagctgcccaccggggcctcacttcttctttccaagtcccgcatccgtccgcagcttgatgccccttctctccgtacgaggcccataacttccacgccatgtgtcagcccttccttgagatgatacac

SEQ ID NO: 689352 - DNA, 103 bp, Homo sapiens
tgaagcatcactggtgagcctgccagaggtccaagggtgaaggggttggcactgaagaaatccctgacatcatattggcgctgctgacgggcgtactgccccc

SEQ ID NO: 689353 - DNA, 2136 bp, Homo sapiens
gagcgggggctggcagcgagcaggatggcggcggcggcggctgcaggcgaggcgcgccgggctgctggctgtacgcgccggcatgggcgcgcctcctggtgttctcgcactgcgcttgcaggtctttctcgcgtgccctgcaacctggctgggcttgtccagccgctctgactgctgcgctgcgacgacactgcacacgcacgcgcccatgcgccctcagacaactcactctgctctacacacacttgaccacggaacctccgctttccacctgaagggcaacgcggccttgtaacccaggcggctggaacattggccgtgaaagcggctctggcgacacacggccgttcccttctgcgcggcttgcaaacgccacgcacacgcgctgcggaacttgccccaacccttctccgttttcctgggcccagccttatggcccgttgcgcgcacgtcgcaacctggcgctggcacctgctgcgatgcggcccatccatcgctggccgccgacataccatgttcccccgggcaacgctctttcccttccgcttcccattctcttcaccacgtgaaacaaccctcgttgggacgttggcgaaagccggccgcgttggggcagcctttgcctgtgcctgcacaaccgggtctgcacctgcaaacgggacgccaagctttacaatttggccggaaagccgcaacagtttcctgctaatctgcgcctcatcgttacctgttatcctcctcaagggacgctctcccaatcatttcccactttggcgtcgccccttatatagtcccccgcgaacaagcggcgggccgaatgttccgctttcctgcaacaccggctggcccaccacactgtggtcacacagccggctccaccctatttccactacttgtgcgccaatacctccccgagtggttggacgggtagcctcattttggcgcgtctcctatagcccgaagcccactcaacggggggggccctccttttggatctcgtcctcccccgttgtgctggctcccaccatttggtgactcacggtacaaaccccccgttatccccccgcccttgtgccggacgactttacacgctttcggtcaaacactttcccaagcgagtgcccgcgcatttaaacgcagcggcgggtgacgatacaccacttgtgcgccctcacaccgaaacaactgcgtggccggtctacttttgggcgccaattcgggagctttactagcagaaatcccacgcccgcgacagagagcgtcgcgttttccccaagttttggtcactcacccgctaagcggccgaaaaccgtgcccccgccccctgttcgggtccgggcccccccattatggtcggcgccgcgcacaacgctacgggcggccaaacagaacgcccccgacacgagcgaccaccccgggtgctgcgcagctcggagacgacacttttttgagcagccgccacccctctgcgcacgccgtcccacctccaggggatcgcagtgacgtcgctccacccctaaacatgctgatggccgccactccctactgtggcgcatacctccgacaagtacagtctattcctcagcgggcacgcacccgttttatggcgcacgttgggcccgtgataatttccgacgccaacccatgtgagcacgtcagctcatcaatcatcaacgcgccgcgctctcgcagtgtttgtgggtgacgaaacatacttttaaacgcccacgcatgcggcacggatggcggacattccagtcttgggagaacgagcagagccgcagacaaagtgcgggttcggggtaaaccgacatcaacagtactttccccgaacacagactatatatggacccgcccccccctacttgtcgaacaacagtcatctgtgcgccccacccttttgtgatcactccccctactttcttctccgcgacagtcgctgccgacgcgattttcccccccgaccttttgcgtcgtatacacatctccatacaaagccagccgtccctcgcgattatagatatcacacgctgcgagctcaaaacaaacagcatatatcatgctagccgccacccatttatattaagtgacggcaatattactttgcagcagactaccacagtaagacccccgact

SEQ ID NO: 689354 - DNA, 146 bp, Homo sapiens
atgcaagaatggactgtctagcaaggagaaggaggggtctcgaggagaagaggatacaggccaagaggaaggtggctcccgccgggagcctcaagtcaaccagcaagaagtgcaacagctcatggacatgggcttcacaagggacc

SEQ ID NO: 689355 - DNA, 351 bp, Homo sapiens
ggtgagattcggagagcagactatgcaacgctttatcgttacattactgcagcacaatctactgattgtgactgtcaaagagagatgagtgaacacgtgtatgcaatacacagagttgtattctcttacactgatctttacgaaacagtgcaatatgtcactatacctcgaagtctcagttagaggcttattatgagagcaaactatctgttactgtgctctaaaggatctgttcacggctttgagaacttgccgtgacagcattatttgagttcactgtaatgacactcacttgatctacatggtcgctcaacctttgattcatcccacgtggttacacactgttttggc

SEQ ID NO: 689356 - DNA, 398 bp, Homo sapiens
aggttcaaaaaaacacctgtgtacacagtcccatgcgtttcttcgaagagaatcaagggtgcccagatggctagcacattgaacagtaaatgaggcaatgataggtgaattaaaggataaagcgatagcctgctcatttgcagcttgaacaatgactctggcgccaacgataggtcttcccttagggcaaaaataaaacttaacaggtaaatagcggttagaaataccacaaggcctgtggtcaacgcagctggtggatgaccaccgggaaaaacatacgacttccaattcatagcacgaccaaatagcacaacctaacaactagagtgaattgctgttctcagtgcttccaactaagcttttcccatccccctattcttcttgtatcgatgcaatta

SEQ ID NO: 689357 - DNA, 224 bp, Homo sapiens
ctttctacgtctcatcactggagcctcgggtatagccctaaaaagaccaaaaaaacacaaaaaacaaaaaccaaaaaaaagcaccccccaaaacccttccaatatacagaatgaggaagcggacccaagtcaaagagaagaaaaacaattagctaaagataaagaaaagcttaagaatgtgtgtggcctatctggatcctttggactcatagtcagtgatgaga

SEQ ID NO: 689358 - DNA, 277 bp, Homo sapiens
aataagcagtctgaaggctacatactatatgattccaaatatatgacattctagaaaagacaaaccatgcagactataaaatgatcagtgattgctagatgctgggggagggagggatgaataggtggagagcagggtaattactcttgtatgatactcaacagtcagtataagacattatgcatttgttgaaacacatagaatatacagcacaaggagtggaccctaacataaactgtggactttgggtgatttaaaacagggggtggcaggagcc

SEQ ID NO: 689359 - DNA, 411 bp, Homo sapiens
ttacctctatgggtgacgggcggatgatgtgcagtgcatatcatggccattattcaatcaagcactcatattcttgatttactgctaaatcctccattaggttattagttacataaaaacttacgtatggtgggtattcttatgtaggaaatgtagcccatttctttccaacccataagctacaccttgacctaacgtttttatgtgttatgatagtgcttactattgttcctttttagggtttgctgaagatggcggtatataggctgaattggcaagggttggtaaggtctatcggggtttatcgattatagaacaggctcctctaggtggatgagagagggtccaggcgcctggaccctctctgggtcgaatcggagctgtagctgctggcttatggcagagccacag

SEQ ID NO: 689360 - DNA, 544 bp, Homo sapiens
ccagcaaaatttcgatcaagaaaagggcaagacaccatgagatacgaatccaaaagacagccagctctagcaaagtcatgaaagatgctaataatcttgcaagtgaggttaaaatacagaggctgacctgaagaaacttcatgaaagcccgtgactgatcctgaaggagtctctgatcatgaactcatagtcgcgttgaatgactacaggcctaagccgttgccgagtgtgcttaccagttacgaaggaagaagtatgagaagagtaaaggccagtaccacactcataccctgatagatctggagctagtgttctcctataaagaggccacaggtttcacggagtatagtgaatatcacaagagtaccagtatgcacaagagtgacacggaggaatacacaccgcatgtctggacctttgagacaccaaatgtacatcagctgacagatagagtctgctagctaggatgcaggagtgggaccggatatatctggaacgagtaatggaagcagtccagttcctagggcagcaaaccggaactggc

SEQ ID NO: 689361 - DNA, 151 bp, Homo sapiens
cacgggtctttctccaacacactccccatccccaagaaaggcacgggtggagaccaaaatggtgacagcgagctcccagtcggggtcaggcacctacgatgcaaggatccgggatgccaaccttccctcccaggtgtggtcctccacccgg

SEQ ID NO: 689362 - DNA, 270 bp, Homo sapiens
  misc_feature (20)..(20): n is a, c, g, or t
  misc_feature (45)..(45): n is a, c, g, or t
  misc_feature (206)..(206): n is a, c, g, or t
agactgagaaaaatagaggncctaaataaataaaatcagagattnaaaggaggcccaggcatggtggctcacagtactttgggaggccaaagcaggcagatcatttgaggtcaggagctcaagaccagcctgaccaagagctaaaactctgtcaaatgtaatcccagctagccaggaggctgaggcaggagaatcacttgaacccnggaggtggaggttgtagtgagccaagataactccagcctaggtgacagagcaagactctgtctc

SEQ ID NO: 689363 - DNA, 741 bp, Homo sapiens
ggaggcgaggtcgctcgggcagctgttgcgggggccatggcggggaccgcgctcaagaggctgagtggccgagatacaaacaagttaacactgaatcctccggaaggaatgtagcaggccccatgaatgaagagaaccttatttggaatgggaggcattgatcatgggcccagaagacatctggttagagttgggttgttattcatacctgccatacctgagtttcccacttgtattacccgttaatggtcaccgccagaagtatgagatttacctgtgagatgtttcatcccaacatctaaccctgatgggagagtctgcatttccatcctcgtacgcgcaggcgatgaccccgatgggctagcgagagcagcgcggagcggtggagtcctgtgcagaagtgtggagaagatcctgctgtcagtggtgagcatgcgggcagagcccaattgacgacagtggagctaacgtgcgatgcgtccaaagatgtggcgcgatgaccggagagcagttctattaacattgcgaagagatcgtccagaaagtctctgggactggtcagacctggctcgtgacaggcgcgcaccatcacgactaagcacgatcagcattatcccggcacacttagtgacagtgatggtctgtgctggtacaaacaaggcagacttgcagaaccatggaactttttgattaacacttcttattaaaaggggcctccggaacgaagtcaaagtcatttgc

SEQ ID NO: 689364 - DNA, 735 bp, Homo sapiens
actacaggacccctggtggtctgtgctgggattacaggcgtgagccaccggcccggcctacaaagtcatttttaagggaagaagaaaaaaaccctctcctttcttgaaatctagattctatttaagtgatactatttgtctatgaaaaatacaatgagctatggtgaagtgatttgtgtaaatgatctcattcaggaggcactgaagggacagacacttgtcattgccaagtaagtcacatttaaattccctcaagccttgagaaataatgtgagggaaagtgcaaaaatagcacagtcattcctttggactaagtcaactcctaggcctcctgagagcactgtagctgtgtgttcatctatatgcaaagagaaataaaaagaatcaactatatttgtcacagggtactttcctatataccagcgtacacctctatcaatacattttatgctgagactttcggtaaggaaagactgaccatacacactgcctcatgcacagatatagacacatattgaagatactttctttcccctgcaatgcagaaaattgcatgagcacacacaaccacactaaaccaaccagaatgaaactagaggcagctgtatctgattgaaactggtgagaattgagattgacagagttacagggctaggaggttaatgagtccatactcctgcctccagtcagaactgtcctaagccattccaagtaaatgacagctcagcctctgga

SEQ ID NO: 689365 - DNA, 350 bp, Homo sapiens
gtgtggcagtgacactgagctctactcagtaggcttatgtcagtgtcctcaagctcactgcattggtgcagtcttctattgcatcatctagtttccataagcttggacactaaccgtaacccgattacagtagagtttagcatttgttttctattgttggggtctatccccaggacttctgtgtacggttcatctgctagtttgtactttccttccttaaatgctttattcccatcttctttctttgctttgagtgctttggcatttctgcaggcaatgcaggacttctcgtggtcaggagccatcctgagagcctgtacgaaaaactgacctgccttctcaatacaatc

SEQ ID NO: 689366 - DNA, 385 bp, Homo sapiens
  misc_feature (83)..(83): n is a, c, g, or t
  misc_feature (128)..(128): n is a, c, g, or t
  misc_feature (182)..(183): n is a, c, g, or t
  misc_feature (229)..(229): n is a, c, g, or t
  misc_feature (297)..(297): n is a, c, g, or t
aggagtacctggatgagtattaccggctggactacgaggacatcatcgacgacctgccctgtcgcttcaagtaccgcacagtnggtgccctgctgactttgcgcctcagccactgagcgagatcctcngctgctgacgcataaggagcctcaaccggctggctgctccctaaacgaacgacnnctgcatgtacagcgtcagcagcaggcaggaaagctgcgggacaagncggcgcgtacacgccacgaaggcccagaactcatggcaaaaagcggcaggctcttcaacgtcactctngccgagcaagaggcagagacacctgcggaagccacagggaagccacagagagatgaagccggcccacagaggcagctgccagcccttg

SEQ ID NO: 689367 - DNA, 388 bp, Homo sapiens
  misc_feature (338)..(338): n is a, c, g, or t
  misc_feature (354)..(354): n is a, c, g, or t
  misc_feature (375)..(375): n is a, c, g, or t
caggctggagcgtagtcattagatcttggctcactgcaacctctgcttcctgggttcaagcgattctcctgcctcagcctcccaagtagctgggattataggtgtgagccaccacgcctggctaatttttgtattttcagtagagatggggcttcatcatgttggccaggtggtcctgaactcctgacctcaagtaatctgcctgccttggccttccaaaatgcttggggattacagggcgtgacaacttgcgcctggggtccctattttctttttacaacagaccttggggaaatatttttctttccccccaaggagggtttgagggcccatgggantgcattaggggggcangttgggggtgggtggtgctcngttaggcccttta

SEQ ID NO: 689368 - DNA, 655 bp, Homo sapiens
  misc_feature (13)..(13): n is a, c, g, or t
  misc_feature (64)..(64): n is a, c, g, or t
  misc_feature (91)..(91): n is a, c, g, or t
  misc_feature (163)..(164): n is a, c, g, or t
  misc_feature (185)..(185): n is a, c, g, or t
  misc_feature (197)..(198): n is a, c, g, or t
  misc_feature (228)..(228): n is a, c, g, or t
  misc_feature (234)..(235): n is a, c, g, or t
  misc_feature (237)..(237): n is a, c, g, or t
  misc_feature (244)..(244): n is a, c, g, or t
  misc_feature (247)..(249): n is a, c, g, or t
  misc_feature (257)..(257): n is a, c, g, or t
  misc_feature (266)..(267): n is a, c, g, or t
  misc_feature (306)..(306): n is a, c, g, or t
  misc_feature (310)..(310): n is a, c, g, or t
  misc_feature (339)..(339): n is a, c, g, or t
  misc_feature (364)..(364): n is a, c, g, or t
  misc_feature (366)..(366): n is a, c, g, or t
  misc_feature (383)..(383): n is a, c, g, or t
  misc_feature (389)..(390): n is a, c, g, or t
  misc_feature (414)..(414): n is a, c, g, or t
  misc_feature (439)..(439): n is a, c, g, or t
  misc_feature (442)..(443): n is a, c, g, or t
  misc_feature (458)..(458): n is a, c, g, or t
  misc_feature (468)..(468): n is a, c, g, or t
  misc_feature (475)..(475): n is a, c, g, or t
  misc_feature (505)..(505): n is a, c, g, or t
  misc_feature (507)..(507): n is a, c, g, or t
  misc_feature (509)..(509): n is a, c, g, or t
  misc_feature (520)..(520): n is a, c, g, or t
aggtggcacgggnggggggtttcagattcaaccatgcccatgtgcaagggcgctggtccctggngaggggacataatcagagaagtgacgnggccatgccgaggtatacgtgtgtgcagaaatggacacatagggttcaggagcatcagtaactgactattgnnatcatggtcttcttggaaggnataaatgtaaanntgttgctcagccccacagagttggggtgtntccacnngntgagggnttnnnggtgtggngtcttcagnngttctgccctgcagaggctgaaggtggcatcccataggntttntagagcaggtcgagaagctccctcttttnatcttttgggaggtaactagttttngncgctttgttgttcagcntttttnnctcctcttcagttaagcccatgtnccgtttggtcatctggtaatcagtnttnngggtggacttgttgntgagcgggtnatctgtnttgagcgagttgttagcctggtcatttttntncngattgtttgcntgctccgtgtccggcttccaggcaccagtgaggtagctggaccaggggcagatctcgaagtgcatgttttcctgccagaagcctgttataaagggcctggtcttccagggtgtggtagccgtgtcccagccgctc

SEQ ID NO: 689369 - DNA, 448 bp, Homo sapiens
  misc_feature (42)..(42): n is a, c, g, or t
  misc_feature (72)..(72): n is a, c, g, or t
  misc_feature (77)..(77): n is a, c, g, or t
  misc_feature (133)..(133): n is a, c, g, or t
ctcctcaaaattccatactcaggccaccctggacccctactnagccccttcctgtttggccccttccctacnccccngggggcttggttccccatgcctttccttcctctttcccttaagctttccttccctncctctccctttgtcaaccttgcagcctcatgatctggcttccctctgtcacagaatcaaagggagcattatggaggggggtttccccaaacacccacatgttctcacttataagtgggacctagatgataagaagacatggacacatagaggggaacaacacacactggggcctgttggaaggtggagagtaggaggagggagaggatcagaaaaaatgactaatgggtactgggcttcatacctgtggatgaaataatctgacagcaaacccccatgacacgagttcacctatacaacaaatctgcacatgtac

SEQ ID NO: 689370 - DNA, 88 bp, Homo sapiens
aacaaaggggcagctgcgccacctcctccaagacaccttcctgaggacgctggcccagtgcaggccaacatccacccctacctccata

SEQ ID NO: 689371 - DNA, 705 bp, Homo sapiens
  misc_feature (117)..(117): n is a, c, g, or t
atctctcagtagtagaaaggagcagaagatgggggagagaagaatcatatcgtaatgcttcatgctactgtgcgcttatatgtacgatcctgtttgttatatgttgctctctttcanttggttggctcactcctccgtaacgtgcttttcgcgtatgtttaggtttttttgatgtttccttactttcttttctgtttctcttgttttctctctttttctcctatctatcgacacttgctttggagtcctccgtgtcttttttctgctggcgtctgtgtgtctgagtctcttctgatttctctccatctgctcatatgtggttagcgttcctgctatttctccattatcttgtgcgttgttttgactctccttggtcctctttacctgttgtcttgctccagtatctatccgctttcttactcccgtatgtaatactttgagatcgtatttggtcacagttttctcgcggtgcttgagtatgttttcctcttgatactcttgaggcttgaggagaaagctccttgtatggccatcatctgattgcggtccatgaatgtccgagagcttgaagaaggagcaggaacacaagtgcacacctggaacggatgaagcagacgctggatcagtacggtgcgcgagctccaggcccgccatgaggaggcagtacaggccgccctccgtggcgggaagaagcaggtgcagaag

SEQ ID NO: 689372 - DNA, 153 bp, Homo sapiens
cggcacgaggctgtctgcatcatttcgttactcaggcatttatgatgtggaggtcattaattttcagcttcgaaggtggagggaacatttctgcttttcaggcaccagctgtaaggggaaccaccagtgaactaaaggcaagtctctaaaaaa

SEQ ID NO: 689373 - DNA, 131 bp, Homo sapiens
tatctaagggatacctaagataaacagtatatctatgagatacatacaaggctagatgaaatcaccccatgtgtctgccttacttccatggccttattcccaagagctcgtcatatgtcaaaatcctacct

SEQ ID NO: 689374 - DNA, 103 bp, Homo sapiens
tttttcgcattttatatgtgttcgatctttgcagccacgacccatgttactgtcgactgcgaactcatgagtcattttttcagagaacccgtcctgaagacat

SEQ ID NO: 689375 - DNA, 473 bp, Homo sapiens
agtcatcttagcatgatggggaaaggcaccccaaactctgttaagattcttataaaggaacggttgatttttttgccaaactatgctttggccaaggggaaataaccacctggccacccttttctgcccccctacaggacactaagggttgttacagataaaggcacgatgcgtttatgctgggagaactaacaacacctgatttctctggtataaaaaatattgccaaatttgattcactttatgaaaagaaaatgtttttttgctgtaaacccattgagaacatagctgccatccgtgcaagatgagggtaaggccacctctgatactaagaatggcgccccactattgcaaggatgtcacacctgctgcgcgtgggcacacgctgcgtgatacatctttgagaccacggatgggtaccggccattaaagtccagtcttttaatgaggatttgatctacctcggttggcta

SEQ ID NO: 689376 - DNA, 893 bp, Homo sapiens
gcgggaggcactggcctccagagccccgtggccaaggcgggcctcgcgggcgggactggagccgggatccgggtgcctcagctgttcgggctggatgacgaggccaggtctccagctgtgggtggtagcgtgtccgccaccagctgccgaaggccagacgccaggtccggtggattggtgacagcaggacatgacatggtccggtgtgacggcgaggacagaggaggcgcgtgcggtacttcctgaacaccttaggctgggtggttggctgcggcaagaagcgggtctgtttctttacttcctccacaggagtcggtacactatggctgaacctctgggctcccagaacccacaacatgaaagaaatggtgctacccagctcaaagaccttgggcctttgaatccggacataaaacctctagcttggaaatgaatatgctgcactttatcaaccgactgcaacgtacctgagtcagtgaatcggctctggaaggtgaggctagaggaacggcagacctcatccgaagcccagagatcgaaagacaccatcggaacagcagacgcccgtgagagccagccggcacggcgattccatcttgatggccaccccctgcggtggacggttgacactagcacgacatcaatccctggagcgtgagctcgctccagcgggatgacggcggtccccgagcaagctccgtcttctgcttttgcatccgttctgtcgtcttgtatctgagcttgctgtctgtccgtatctgagaggattcaaagccttcacgactctgttccccgtcgctctgcattaatttggccaagcctgggcggttgaggtgggggacggctgaagctcgccggtgggtggtttcccgttgttcgtgggggcggccttg

SEQ ID NO: 689377 - DNA, 103 bp, Homo sapiens
tcgaagaaattagcttttattggaaactactttaccccacgtgtttcttttaagaattctatgctatgggataacctgcttatccactggcccaataccaaaa

SEQ ID NO: 689378 - DNA, 763 bp, Homo sapiens
ggtaagaagtgcctttgcctcccaccgtgattctgaggcctccccagccatgtggaactgtaagtccaattaaacctctttttctttccagtctcgggtatgtctttatcagcagcgtgaaaacggactaatatactagatagggtagcagtagagtggagcactgctgaaagagacacccgaaggtgtggaagcagacgtttgtgaagtgggtaacagggagagggttggaacagttggagggctcagaagaagacaggaaaatgtgggaagagttcggaacttccgtagaaccttattgaatggcttgccgaaaatgctgatatacaatatgaagcagaaaggtccaggctgaggtggtctcagatggagatgaggaacttgctgggaactggagcaaaggtgactcttgttatgctttagcaaagagactggtgacattttggccccgccctagagattgtggaattttgaacttgacagtcatgatttagggtatctggtggaagaaatttctaagcagcaaagcacgcaagaggtgacttggatactataaaaaggcattcagttttcataagggaaaacaggcatacaagttcagaaaatctgcagccgatgatgcagtagaaagaaaaccattttttgagaaacattcaagccagctggcgaaaattcgcagaagtagcagaagctaatgttaattcccagacctagggaaattttgcgggcaggtcgagaacctccgacgagccctcccatccaa

SEQ ID NO: 689379 - DNA, 112 bp, Homo sapiens
aaggaactctagatgttacaaatggctctcacaaactatagggtgacacgtaatgagctggctgcccacagactcacaaccaagcaggcagaagaggcgacagactgactcg

SEQ ID NO: 689380 - DNA, 257 bp, Homo sapiens
gggtattcaattgctttatatttatttctgggaaaataaattttaaaccttgactgacttttcagggttaattagtcatgttgaggagaaacaaattctcaaattccttttttgcattacaataactttgaaactcacaagccgtgtgtcccaactcaaatagttaacttcattttcaacccataccaagggtttcagtaatttttttttaagcaaaagcaaaccattgccgatcacatgatttaagacttccgttt

SEQ ID NO: 689381 - DNA, 1010 bp, Homo sapiens
  misc_feature (14)..(14): n is a, c, g, or t
  misc_feature (20)..(20): n is a, c, g, or t
  misc_feature (22)..(25): n is a, c, g, or t
  misc_feature (27)..(27): n is a, c, g, or t
  misc_feature (30)..(31): n is a, c, g, or t
  misc_feature (33)..(35): n is a, c, g, or t
gcgagcgtacccgnaggcgngnnnngntgnnannngggccgagcggatcgcgggctcgggctgcggggctccggctgcgggcgctgggcctgcgaggcgcggagcttgggagcggagcccaggccgtgccgcgcggcgccatgaagggcaaggaggagaaggagggcggcgcacggctgggcgctggcggcggaagccccgagaagagccctgagctgcgcaggagctcaaggagcagggcaatcgtcttgttcgtgggcctgaaagtaccctggagtgctggctggcctgctacgtgccgcgcgatcaccctggaacccgctggtggccgtgtattacaccaacctgggccttgtgctacctgaagatgcagcagcacgagcaggccctggccgactgcctggctgcgccctggagctggacgggcagtctgtgaagggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgataagggcagctggaagagttgccagcgaaaccacgagggttattaggtacgacaggcagggttcgtggccatgagtggccttgattgataggcaagcacaaactagtaatttgggagcatttgcagggagttttttctccaggtttgtttagagagaggtatagaagcggaatcccgattactatttttggaagattagttttagataatagagtagggagataagcacgggaataataagagagagagttagggccgtaacgtggtaattagcggaggggggcgctacagagagattcgaggagtaagggggaggacacagtgggtggtggctg

SEQ ID NO: 689382 - DNA, 1053 bp, Homo sapiens
aagaccttagggctagtgtatgaggcctggtgttttgcgcggtgctcgtgtgctgcgtgtgtgctccgtgtctgctgtggctgcatgtgtgcctgctgatggctgctgtgatgcttgtgtgatgctgtgatgcccatgtgcctgtgcctgctgctgtgctgccatgaatgtgtgcaatggatgtgatgaagtgatgtgtgctgtgtgcactggctttggtgctgcattggcggcggaagccccgagaagagccctgagctgcgcaggagctcaaggagcagggcaatcgtcttgttcgtgggcctgaaagtaccctggagtgctggctggcctgctacgtgccgcgcgatcaccctggaacccgctggtggccgtgtattacaccaacctgggccttgtgctacctgaagatgcagcagcacgagcaggccctggccgactgcctggctgcgccctggagctggacgggcagtctgtgaagggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgataagggcagctggaagagttgccagcgaaaccacgagggttattaggtacgacaggcagggttcgtggccatgagtggccttgattgataggcaagcacaaactagtaatttgggagcatttgcagggagttttttctccaggtttgtttagagagaggtatagaagcggaatcccgattactatttttggaagattagttttagataatagagtagggagataagcacgggaataataagagagagagttagggccgtaacgtggtaattagcggaggggggcgctacagagagattcgaggagtaagggggaggacacagtgggtggtggctg

SEQ ID NO: 689383 - DNA, 838 bp, Homo sapiens
gagactctaaggaaaaatatcactgccccaatctttgttttctttctgtaactttcttttttaagttctataaccaatatttaattctttgttgtgttcctctaggaattccactctggctgagagaaagggtgccctaggtgagaggtatcctaaggcactttcatagaacctagagctctattaacccatttggaaaaccactattttaggaaaagccttgtatttatcaaatctaaaaagaaagaaaatatcttaaaagcacgtattgaaactaagttttctgagaagaaatacatatacaaggaacttccctatcagcattagaacaaaggccaacttaagtccctaaaacggtaacaaaataagcacgtgaattatgtatacgaatggacaagaagcacatgaaaagatccttaacatcatcagtcattagagaaatgcaaatcaaaaccacaatgagataccatttcacacccagtaggatggttatagtaaaaaagacaataataagtgatggcaaggatacggaaaagctggaactctcatacactgctgatgggaatgtaacagtggtacagtgcgcagctggaaacaggttgggcagtaccttcaaaaagctttacattgattttaccatattgaatccagcaatccatccctaggtattttttccaggaaaccggaacctgtggttcctaaaactgatcgagtggtcggggttttcgtattggcaacgggtgaacatcccgcaccatgtagtggtaaccctggtttcccttatttcgcgcagaaaagaaaccgtgaagtgccaacgatcgacaggctgaacaagaga

SEQ ID NO: 689384 - DNA, 167 bp, Homo sapiens
tcatcgaaaccctaccaagaacaaacctggtcatcaaacccttaggtgaacctgcggaaagcaatataagaaggccccccaaataaccgcgttaattggctgtagtggtctacttgtatagggtttcgatgaccagggtttgatgaagggtttgatgcggggatcct

SEQ ID NO: 689385 - DNA, 208 bp, Homo sapiens
taaaatatagagatggggtcttgctgctatattgcccaggctggtctcaaactcctcggctcaaggaatcctcccaccttgacctctcaaagtgctgcaattacaagcatgagccaccgtgccaggccttatgtgcattcctaagtaacataataataaaaataacttcagctagggtaccaagacgtcgacgcggccgcgaatttag

SEQ ID NO: 689386 - DNA, 482 bp, Homo sapiens
acccacagatcttccgagacagggacggatatccaggttgcctttatcccatgttgccatttgaaccaggaatcctttactttagaactgccaagggacgtcgcccccaggatcggctatcctaaaaccagcctggtgcactccaccttctttccagccctgcagggctgcccaagaccaaaaatgaagtgccagcgacccccactcctccatcttcctcaccgacacggccaagcagatcaaaaccaaggtcactaagcatgcgttttctggagggagagaaaccatcgaggagcacaggcagttaggggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgaatcgcagagcaccaggcccg

SEQ ID NO: 689387 - DNA, 159 bp, Homo sapiens
tcatcgaaaccctaccaagaacaaacctggtcatcaaacccttaggtgaacctgcggaaagcaatataagaaggccccccaaataaccgcgttaattggctgtagtgtctacttggggtttaggtttcgatgacaggtttacgatgggtccgagctcga

SEQ ID NO: 689388 - DNA, 167 bp, Homo sapiens
  misc_feature (167)..(167): n is a, c, g, or t
tcatcgaaaccctaccaagaacaaacctggtcatcaaacccttaggtgaacctgcggaaagcaatataagaaggccccccaaataaccgcgttaattggcagggtttgatgacagggtggatgtagggagtccgtctagagtcgaccgcagcagcaggtgcacgccn

SEQ ID NO: 689389 - DNA, 347 bp, Homo sapiens
cgtcgacgtacactagagggtagcttttaaaagttgtcagcaaacactttgatatacttcccttcaaaaatgaaatacaatgtccccattttcttgagtgagggctgggttggttggttggttggttggttggttggttggttggttggttggttggtttgagaccaggtctcactgtatgtctctacctggccttaaattcacagtaatctgcctgcctctgcctccaagttctgagtggcggctcactgtttaagaacagaatgtggaaaggttggtaatatagcttagtagtagagtgcttgtccagcatgtgtgagaccctgggtttgatcactgacaccaca

SEQ ID NO: 689390 - DNA, 321 bp, Homo sapiens
atctatatactcccgaacacttatataccatggtctcagatttacatttccgtcaaaaggcagtacagagtgagaaaacaacaacaacaacaacaacaacaacaacaaaaccacccctaaacaagcaagcctagtaagtagcctagtctcatgattaatgaattccctaatgctggcatatagcccacatactgagaggccggaactgtaacaaggtgctctttactagtgtagtaaggggaaaatgtataaggaaaattaatttttcataatcaggtaaatataatttgttaatagcaaaccaagaaattccggagagaa

SEQ ID NO: 689391 - DNA, 381 bp, Homo sapiens
acggcacctgtctacggcagatggagacaggactacatgcagctcccacttggatgaacagaacagcatgtggagactcacactgtgaatttttgctccaagaaccaccacaggaacataccgggaaaaccaaaagaattcaagaccctttgaaacaagtggtttgccactgcaaattctgtgaaacagccaaaaactgtgagttcccaaagtgtgagagggaaaaatgtctgcctccaaacacacatcccctctgggaacctgaaaattcagatcacgggagaaggatttcaccttacctagagctgaaatggatttcaggagccaagcaaaatataatagtaccgagaaaagaagcaccgggccgttaggccgatctga

SEQ ID NO: 689392 - DNA, 393 bp, Homo sapiens
aactcaaaccaggaaggcactacaagtcgcatcataatcctctctgaaggacttcaaggtctacggccactaagagcaaggttgatgacagctagcaagcctcgctaaccaggcctgaccccccactattaaccagcggggagaactcggtgtggtagtaaccaggttctcctgatcaaatagcactgtagagtaacagggctcaacatactagtgacaggcctatactccctaaacaaattaaccagaacacaatggggctcaggcacccaccacagttaacaacataaaaccctcattcacacgagaaaacaccctcatgttcatacacctatcccccattctcctcctatccctcaaccccgacatcattaccgggttttcctcttaaaa

SEQ ID NO: 689393 - DNA, 449 bp, Homo sapiens
aatcgggaaaccatttcggcccggggttcacttgtttccgcccctgttggaggagttggccctgaacgagttggtgacgctaacgtgcctggcacggggttttagccccaaggacgtgttggttcgttggttgcaggggtcacaggagttgccccgcgaaaagttccttatttgggcatcccggcaggagcccagccagggcccccccccctttgttgtgaccagcatattgggggtggcaaccaaggattggaaaaagggggaccccttttcctgcatggtgggccacggggccctgccgttggcttttacacaaaagaccattgaccggttggggggtaaacccccccatgtcaatgtttttgtttttatgggggaggtggggggcccctgtttttgagccgcccgcctgtccccccccctgaataaattccatgttcccccaagca

SEQ ID NO: 689394 - DNA, 458 bp, Homo sapiens
gcagatttgaccgagctctgtggagcgcgaacaatgtccgcagggctccaggttcagagagggactcgcttctccgccttcgcccgcgtccaggcaccagcgagctgcactctgcactcgctctccctggtccacccctacactgcccggacccgaggggactggccctgcgggcgccgccaaggcgactgagagcgcggcgcgcgtcccgagcgcctggactccgcgcagccgggcgccgcgcacccgggtgccggggtgggagccgggccgcagacccaagtgcgcccgaagccgccgtccgccgcctggcacgccgtctgccgcctgctgggcgatgtgtgcgcgagcccgtggggcttgcgcgcgccctgcggcgtgtgtactcacaaaggtgtgtctgctaaccccacagcccgggctgcgttccaccccgagctggagaaaccccggcctgg

SEQ ID NO: 689395 - DNA, 709 bp, Homo sapiens
ctccaacatctatatatcttctctttaataattttgtacatctatttattaatcagtagagcaagtgagtgctatggcacatgaatggaggttggagaccagcttttgagagttggtgatcttcttccatcacatggaagccaagggtcaaactcaagtcattgggcttagggacaagtgtccttacccactgagccatctcattggcctgtgtatactggattttgaaggatgaatcagaataataaggggaacatatgaggaaagggagcagaagacggtgttttagatgaaggaaactgtatgtgcaaagatgggttaggcatacagtaactcaataaatgcaaaaaacataaggatttctgtgtctatagaatctgacactacaaataacaagttggcttgcaccagtagatgcaaagaagacagcgtaaagtttcagacaaaataataacaaagcaatatttataatttgggaaaatgacagtgaggtggtgtggagaataatttgaagaggagagggagacaaatgccaatggtcctggtgagatataatgattatacatgtcaataaaaattaagagattaaaacaaatatctaggggatggcatcaaagaaatcgctaatgaaaagaatgtgaagggtaggatgaagccccagtcagcagaatggttactcaagcagcataaacaggagcctggacagatg

SEQ ID NO: 689396 - DNA, 84 bp, Homo sapiens
gcccaaaagaacccgacagctttctatctctgtgccagtgagaaccaagccgggacagaagctaactatggctacaccttcggt

SEQ ID NO: 689397 - DNA, 224 bp, Homo sapiens
  misc_feature (3)..(3): n is a, c, g, or t
tantccgtacacacacacacacacaccacagagagagagagagagagagagagagaaataaagagatgagagagagaaaaatagagagagagagagatagagagtcctttctcatgagggatgcccagtatgctcctatcccagtctgtgtgatctcttcccagatactgcgtgttagcgcgtgtgtgacagagggtttcaagtatgatgtcacccccagccca

SEQ ID NO: 689398 - DNA, 140 bp, Homo sapiens
tcatcttattgcgttttgctttattgcactttgcaaataatgcattttttacaaatggaaggtttatagcaactctgcgttgagccagtctattgtaccaggtccaaaaacttctctcgtgccgcttcgggcgcgttggg

SEQ ID NO: 689399 - DNA, 414 bp, Homo sapiens
  misc_feature (78)..(78): n is a, c, g, or t
  misc_feature (134)..(134): n is a, c, g, or t
  misc_feature (335)..(335): n is a, c, g, or t
agcattgcttgaaccccaggaaacaaaggttgcagtaagctgaaattgggccactgcattccaacctgggtaatgaantcggagtgaaactctgtttcaaaaaaaaaaaaggccagttgggcttggtggctcanacctgtaaaatcccagcactttgggaggccgaggcaggtggatctcttgagcccaggagttcgagaccagcctgggcaaagtgcaaagccctgtctctaaaaaaataaaaataaaaataaaaatacaaaaattagctgggcgtggtggcatgtgcctatagtcccagctacttggggggctgcggcaggaggatcattgancctgggaggttgaggctatgatgagccaagatcacaccagtgcactccagcctgggtgacagagtaagaccctgcctca

SEQ ID NO: 689400 - DNA, 114 bp, Homo sapiens
  misc_feature (14)..(14): n is a, c, g, or t
ttaccagccttgtntcggccacctcaaggataatcactaaattctgccgaaaggactgaggaacggtgcctggaaaagggcaagaatatcacggcatgggcatgagtagcttga

SEQ ID NO: 689401 - DNA, 373 bp, Homo sapiens
  misc_feature (219)..(219): n is a, c, g, or t
gcggccgcctactactactaaattcgcggccgcgtcgaccttgtgagtacacttgaaactatacttcaaggctacactaacaaaaacagcatggcgctggtgacatggcacattgacaaaaacagacacacagaccaatggaacagaagagagagcccagaaataaagccacacatttacagccatctgatctttgacaaagtggacaaaaacaagcantggagaaaggactccctattcaataaatggtgctggaataactggttagccatacacagaagattgaaactagacccctttgttgtaccaaaatcaactcatgatagattaaagacttacatgtgaaacctaaaactgtgtcgacgcggccgcg

SEQ ID NO: 689402 - DNA, 165 bp, Homo sapiens
  misc_feature (45)..(45): n is a, c, g, or t
tgcgtgctgctgcggtcgctctcgacggctcccggcggggtctcnttcctgaccacttccgacgggtggtccctggggctccaccctcgacgggtgactggtcttacccacgtccgggttcttcccgacacgactcggcactcccaccctctgacgacgggacgc

SEQ ID NO: 689403 - DNA, 1117 bp, Homo sapiens
catatacgatggtgtatggaaagccacctctggtgatcctgacaattattcgcgcaattacttgtgttacttggtcccccctaaagaatcccataatgctgtggcgaagtggagcacgaatcatttctgttagttacttagcgtctgtaacaatgatctggctgtggtgagccaaagtgacattagtaaatgacctgcattcttctccacatgattcctccggtcttgagatctggacggtcccatgcaacgtggatctgccttggcccgctggattcatcgtgtgctctccgattgctggaaggtgtctcccctgccttacccttaaaatgaagctgcattgacatcatgccacgtccacgtcatcgtcccttggtgcgccggctcgcatgcctcgttattaggccggcgtgactgtcgcgaggtttgggtgtgcgagcgaggctctggctgtgcctgtttgtccacggaggctacgtctctctcttgtcgcaggtcgcgtgcacgccgcactgtgacctcggtgctctacgtcccatctgacacgctaaccgatggttgttgcttcgcttgtaatgctctcgagggcacgttttgctggtctcgactctgttaagtacagtagttcctgccgctgcctatagtgtgtctttcagtctgcccacgtacatcacggttgattggctgcctggagtcatgactaggttgctccatttgtctctattttcttacgattgactcgcgtgtgtcttgtaccttatgtctactaagttgagatgattcctaaacagagccttccttcgcaaccctgtctgagccatgggaaacgctttcgctaataatgggaccacgtagaactgcactaatttggggaccccccacaacgggtctttgggacgtccgtaccggattgcggttacatcagcctctatggtatatgggtagccgcaaatgtgccccatttgtcccatgggcgtccggggccagaacaaatggggtccaagccccagtttccccagggctccaatgtaaatgagacccccaccaacaaggggcctatccgcaaatataccccacacaaaaaaacacgggtgaaaataagtgagaggaatttaac

SEQ ID NO: 689404 - DNA, 585 bp, Homo sapiens
  misc_feature (499)..(499): n is a, c, g, or t
cgactctgtggatcccctgcctgctgtcgctaggacagctctcctggcttgctagattaatggccagcgtgtctcaagactcgaatcacggggctgtgaccgagaactctttggcggagggcatttcatagaccttaaggactctcagtgaaatgagacactatcaaaggctgcctgattatgtggagccgatttgcgcattgaatatcagaggaaaagaattatgtgcggcagtgttaggacagcaccagtaccgagctctgtcagagagcatgctcaccacaagagagtttttgaaggaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaanacctggattagataatgaaaccttccacatttatcaaccgcagctaacagttgccagaaaactcttatcccaggtgtgtgctatag

SEQ ID NO: 689405 - DNA, 477 bp, Homo sapiens
  misc_feature (269)..(269): n is a, c, g, or t
  misc_feature (327)..(327): n is a, c, g, or t
  misc_feature (450)..(450): n is a, c, g, or t
taaatggagtctcactctgtcgcccaggctggagtgcagtggcgcgatctcggctcactgcaacctccgcctctcgggttcaagtgattttcctgcctcagcctcccgagtagctgggattacaggcacccatcaccatgcctggctcatttttgtatttttagtagagacaaggtttcaccatgttggccaggctggtcttgaactcctgagctcaggtgatccactcgcctcgtcctcccaaagtgctgggattataggcgtgacanccgcacccggcccttaattattatcttaagttttaaagattattatttttaacctctngaaattctccctctggggccaacacacaaatacttttgaggaagttatctggaattcttacctgttaaacttgaggaggcattactgatttcagggaatgctttttcccattaaaaaaagganaacaaaacaaaaaaccgggggcagatt

SEQ ID NO: 689406 - DNA, 784 bp, Homo sapiens
gctctccccctcaagtaccgtgtcagccagcctgcaagcggctcaccctagccacggtgcccacccgcgcctccgaggggcaccaacaacagcaggggcgtgcgagtgtgagtcagtcagcgacaattgtccacagcctgacaaacactaccaggacacacctccatccatcaccattgcccatgcaccaagcatccacactaacaatgacatcatccactagatacaacaaaataaccacatccagaaacatcataaacatcacactcacaccaccaaattactacagctatacgacaaaccactatctgagcgaacaacctatcacaattgaacaaactgacaagtctaagagaattacgatactgcacactaccaccacaacatacgacaattcgcattctacaacacacacacaccaatatgcaacgcatgtactgagacgctgactccacaaccgagccacacacactgcacaacgtctgtccttcacccacaccctatcagcaatcattgcggaatcagtaccccttcacatgcataccacaacacattgcatacaacacaattatacactaatcctcacacacaacccccaatgatcaacctacccataccacaaactctcaagcagtattggccccaaacaatcaacataatcaatagcagtatacataactattcgtaccatgaccccatacgactttcctttatccgtcatcacactatagataccaccaaacaatacatattcacacaccaataaccttactaactcacacat

SEQ ID NO: 689407 - DNA, 800 bp, Homo sapiens
ataaagcataaacaaaggaaacgcaacaaaagacttcatctcgcagaaatgcacaggcaacacgataaagtaagagggggcacatttcactcccaagtttaaacggtcaaggccaaaggtaaagccataatggcccgctctgaaagatcctttccaaaaaacaatcgaaggactggttggatggcggaggtgggggaaacggatactaaagccctatactacaagttcacaatctaacaggcatgtcatatacagaaaaccaaagccagggaccatatgtcactacattcttcttagatcacatctagcacctagtaaatagcttgcctgtaccctggcttagctccatagacagcccacacggcacttggggctaggggtcagggacttgctgtcacaggttctctggttccctaaatgccccctacctctcagttctcctccctgtatgttggtcggttggtggatctctcatagacgtcgagcctggaagtgcatgcctagctttggagcttgggccggtcgttcttaccatacatgcgttgacgtgggaaaatcgtatgggcggaaaaacaaaaaaaaaaaacaaaaaaaaaaaaaaaaaaaaaaaacaaaaaaaaaaaaaaaaaaaaaaaaaaaaaacaagatcgcccaccggctcacaagcgaaaaagagagaaaggaaaacgagacgacaaaaaaaagaaggagggaagtacgaataaaagaagagttaacgaaaagcaagggacataaaaagaaacacttagaataacactataacgagaagaaacgagtgg

SEQ ID NO: 689408 - DNA, 109 bp, Homo sapiens
tggacagcacagaggaggtggacagcacagagggggacagcacagaggaggtggacagcacagaggaggcacagaggaggtatgaggaggcatcacacccctcctctgt

SEQ ID NO: 689409 - DNA, 154 bp, Homo sapiens
cacgagggcggggcgcggggtgggcgcggccgaactggtccctgagccggccggcgacaccggacctcccgcgcgccccgcacccgaccggatcagccggccggtaacgtaacacgccctatgctcgcttgctcgccggcctcagggcaggcat

SEQ ID NO: 689410 - DNA, 776 bp, Homo sapiens
  misc_feature (12)..(12): n is a, c, g, or t
  misc_feature (17)..(17): n is a, c, g, or t
  misc_feature (44)..(44): n is a, c, g, or t
  misc_feature (49)..(49): n is a, c, g, or t
  misc_feature (52)..(52): n is a, c, g, or t
  misc_feature (60)..(60): n is a, c, g, or t
  misc_feature (99)..(99): n is a, c, g, or t
  misc_feature (105)..(105): n is a, c, g, or t
  misc_feature (109)..(109): n is a, c, g, or t
  misc_feature (116)..(116): n is a, c, g, or t
  misc_feature (120)..(120): n is a, c, g, or t
  misc_feature (132)..(132): n is a, c, g, or t
  misc_feature (134)..(134): n is a, c, g, or t
  misc_feature (140)..(140): n is a, c, g, or t
  misc_feature (158)..(158): n is a, c, g, or t
  misc_feature (163)..(163): n is a, c, g, or t
  misc_feature (186)..(186): n is a, c, g, or t
  misc_feature (201)..(201): n is a, c, g, or t
  misc_feature (227)..(227): n is a, c, g, or t
  misc_feature (236)..(236): n is a, c, g, or t
  misc_feature (240)..(240): n is a, c, g, or t
  misc_feature (249)..(249): n is a, c, g, or t
  misc_feature (251)..(251): n is a, c, g, or t
  misc_feature (254)..(254): n is a, c, g, or t
  misc_feature (262)..(262): n is a, c, g, or t
  misc_feature (264)..(264): n is a, c, g, or t
  misc_feature (282)..(282): n is a, c, g, or t
  misc_feature (302)..(302): n is a, c, g, or t
  misc_feature (313)..(313): n is a, c, g, or t
  misc_feature (321)..(321): n is a, c, g, or t
  misc_feature (340)..(340): n is a, c, g, or t
  misc_feature (356)..(356): n is a, c, g, or t
  misc_feature (369)..(369): n is a, c, g, or t
  misc_feature (380)..(380): n is a, c, g, or t
  misc_feature (382)..(382): n is a, c, g, or t
  misc_feature (392)..(392): n is a, c, g, or t
  misc_feature (410)..(410): n is a, c, g, or t
  misc_feature (412)..(412): n is a, c, g, or t
  misc_feature (414)..(414): n is a, c, g, or t
  misc_feature (422)..(422): n is a, c, g, or t
  misc_feature (469)..(469): n is a, c, g, or t
  misc_feature (513)..(513): n is a, c, g, or t
  misc_feature (520)..(520): n is a, c, g, or t
  misc_feature (523)..(523): n is a, c, g, or t
  misc_feature (525)..(525): n is a, c, g, or t
  misc_feature (535)..(535): n is a, c, g, or t
  misc_feature (564)..(564): n is a, c, g, or t
  misc_feature (608)..(608): n is a, c, g, or t
  misc_feature (630)..(630): n is a, c, g, or t
  misc_feature (651)..(651): n is a, c, g, or t
  misc_feature (659)..(659): n is a, c, g, or t
  misc_feature (661)..(661): n is a, c, g, or t
  misc_feature (670)..(670): n is a, c, g, or t
  misc_feature (705)..(705): n is a, c, g, or t
  misc_feature (707)..(707): n is a, c, g, or t
  misc_feature (769)..(769): n is a, c, g, or t
tacattgtaaanaccanaattatttgtctgaggcttgcaaaccnctggnaanaagcacanaacgcagggctctccttcatgctgccctgggccccaacncgccangcangcagganaaanctggcaaaagantnaaaaanctttgggagcagcgccanggaancagcaggccctgctccttcccangcccaaacccgccancacgggcctggactgcagccaagaangtgggccanccangatccccangnaanttcgccananggacctcttcttggagcngccttcccttccctccccanccctctccaanccccgcanaacttaaaacctgggccanaagcttggtccctcanaaaaagaccaaancaacagctgtnangctgtttctntgggtcctgtctctccantnangaagccancagggcagggcaggcctggctctcctcctggaatcacaccgtgcacncagctcagcgctgggcactcagctggggaccgggatggacaaanccttttncananaaccactgtnggggagacgtgcatggcagccggactcancctcctgcagcctccattcatgggctcttggctgggcctgaaanttgttagggcctcaactctctntggtgcagaagaacacctccncctccaanangcccctcangcttggtgccaggcttgggactgggctctggaaantnagccaaggctgctacttcaaggccctgaggacagcctccagcttcatgggccatagccaggncgccctt

SEQ ID NO: 689411 - DNA, 102 bp, Homo sapiens
atcctaacagcagacaagttctctatatcacttgttttgttgttgtagttgttgtcgtcgttgtttgagacggggtcttgctcaggtgccccggagtgcagt

SEQ ID NO: 689412 - DNA, 871 bp, Homo sapiens
  misc_feature (857)..(857): n is a, c, g, or t
agacaaggcgggggaagggggagtagcggtggcttaagccgcgcggagcagcgcaacctgggtcgctccctgttcgccgcgcctcggaccgagcccagcggagtcagtgtcctagagaccctgtaacaccacaaagcggacgaaggagtccatgtgtggggaactgtggcagcggagtgactgggacctgggaacctactgtggggccgcggcggacgagcgctcgacctcggttctgaggaaacccttttccaaagagaaatgaagaagaaaatgtatgtaccctaaatatgggagataagaagtatgaagactttggaagggtgaaagaaaagggaggataatactatttccatgttctgtgtgtacaggtgaggtgacagatgccaatatgtcttaatggtctattagaaaaggaagtgtggttttccagaaagctgtaatcatgtcttctgtatgactgtgtattcttaaaattgggcaggagggacttttcaacataggttatggattttttcttaatatcagctttgtggaataaccagagcaggtacgattagttgtcttccattttacagatgaggaacctgggatttatgttctatgacttgggtccagatctcatagtttaagaggcgaagtgatttagaactgatgtctaatctggttggagttgggtggacaattcagagttgaatagagaaatacggcagaagcgatacaaaagaatcgggtttatggtttgtgggtcacttggccaaattgaggatttttaataccgcggtgggggggaaaagtctttgtgtttaaaatgcgtggaggaaggataaaaaaggcgcggaagaaggtagagggangaggggacgtacat

SEQ ID NO: 689413 - DNA, 287 bp, Homo sapiens
tagggtacctttccgtgttttggcctcgcaagtggaactgtgacaattattccttgaggatgtgccaatgtgttgagcttcagttttcccaagtgtgttttctctcccacattcccttaggtgttcctctgatattgtttgccaaggttattctccttaaagcgcctctcggaccttgagccctcattctgtgatcggccgtgtattgtgttctcgtgcgcatatctcccgcgctccgctctcacccccaggtttcgccacatctcgcgtgaaattctcgcacaacg

SEQ ID NO: 689414 - DNA, 124 bp, Homo sapiens
cggcccgcgttcgcttagcggataggatgaaagattaagtggtatgcctcttccaaggcaacaagtaatagaaattatatttgttttaaaagcagtcagtactcttattgattcacttaagcgg

SEQ ID NO: 689415 - DNA, 222 bp, Homo sapiens
ggaggagagactcacgagctcaatagagagaaagtccatgatacaccgccattactgataccaagagaggtaggatctcacacagaaagaaaattctgatagtgacgaaagagaatgtctcttaataagtcgtgatcatgatatactcaatatgacagcagggaaaaaaaggctgatagagatcaaagtcccttctcaaaaataaaacaaagcagtcagttc

SEQ ID NO: 689416 - DNA, 134 bp, Homo sapiens
  misc_feature (57)..(57): n is a, c, g, or t
gacaaccttgagccaaaccatttcaccccaaataaacgtataggcgatagacattcnaaacctcggcgcagatagatgatagtacccgcaaggagaagatcgaaaaaattataaccacgcataatatagcacgg

SEQ ID NO: 689417 - DNA, 609 bp, Homo sapiens
gtatccatgtcacacatttacttctgcgttcgtatctcctcaggcaaaagtggagggtgccttatgggccctcctcatagggttgtctctgcatacacgaacctaacccatagttggtttggtgccagaaaaactgagctatgtctgaacaaagatgtcgtgcctgggtgtacagtgaacaacagttggtttaaaatatgaggggcaaggaggaggatgcatttcaaaagcttgattgatgtgttcagagctaaattaagaggagttttcagatcacaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgtatagatttaggtattctgaaactggattttattttattttattttctgatgctattattatatttctaacaattatactttaagttctagggtacatgtgcgcaacgtgtaggtatgttacatatgtatacatgtgccaggtaggtgtgctgccccattaactc

SEQ ID NO: 689418 - DNA, 99 bp, Homo sapiens
ggatttgctggtgcagtacaactaggcttaatagggacatgaatgtatgttatggtaaatgggaccaaataaagtcacagaagagttttcaaaaaaaaa

SEQ ID NO: 689419 - DNA, 317 bp, Homo sapiens
tcatctgacatttcttcgtgacagacgtctgatcgacccgtgtgatccctaagcctagctgcacatctccatccctggactatgacgtaatgtgacaccggccttattgtgaatgaccggcgggagccacagggacacgttgctctccagctccagcgggggcaccagcactgattggtgtcccgagtagacactgcacagacaccacagggcaaaaccaaggccacagtaggggtcgaggcagatggcgatctgccgcgaggggtacagctcacactgcagctttatggagcggcataaggcgcttgtggccgcgt

SEQ ID NO: 689420 - DNA, 931 bp, Homo sapiens
agggtagaaaagaggttcaagatacagccggaggaagtggtaaggactgaggtaaagggtcccatgcagccctcgggatgagaccctagccaccatccaactcccaagttaaagaccaagagttataggagggagtccatcctcagctccagcccaaatgcaggcctccaaagcggaccctctcgtatgctgcttggtaagtgccagagagccagggcattgtttccatgcagagagtgtgaaaagggtgtttgacaaggatcaagagtcgaaatgcccgatatgaacgcggcaccgccttcaggaccacgtggagcccatcatcagggctgaagtggccagtgaagcccttccagctaaaggaagaggagctgggagctcgacagtcggcctccctgcagtggtgactcccgtggcagcaagtccgaatggggcctccagtgtctgcccctcctcccattcggcctctgccagggcgtttggggcacccctctgcctccccgccaccctccctgtcccctgttggccaacctgcctgcaaacatggagggcatttggccacagataggcaggaggagctcagttgtcggacagctatgcagtccctgtccggtggtgctggaggtctcgcactctccttaggtgtcataagtctctcaccgcttctttacccttaccacttactagagccagggaggctctggaggaggggcaaaatattagcttctgggtagcatcttaaatcattagcctgcagttgtggcggtcttggtttacatgtgttagatgaaggccaagagcttagagaatcagtgcgaaaaaaccttgagatcgtccaacacggctgggcccctcctgggggcggggactctaccttccagattcagtccctagtcttgcgatatactccgcagtgttcggtagtatttgc

SEQ ID NO: 689421 - DNA, 355 bp, Homo sapiens
agatcattgtgtgtgtataccacattttctttattcatttgtccactgatgggcagttacattgatcccatgttttggctattgtgaatagcacttgcaaataaacatggcaatgcagatgtctgtttgatatcttgatttcttttcttttggctatatacccagtagtagaattcctgggtcatatggtaggtctatttttaatttttaaaggaacctccgtggtttccatagaggctgtactaatttacatttctacccagtatacattccctttcttcacattcttcccagcatgttattccctgtctttttgatttctctgatgattagtgatattgagcatattttcatt

SEQ ID NO: 689422 - DNA, 290 bp, Homo sapiens
ctgcgcccccgctggtgacagactgagactctgtctcacaaaaatagaactaataaaaagtattgtgtagcgggaagctctcaaaccacgttcttcctctactctcacaccaccacaacaatcatcaacacataacacatctgtgaccaaaagtgtgggggtttttcacctcagcaccaagcagtggacaccagctcggtgttctccaattcaggttgggggctcagtcttcaagactgcctgcacacccctggacaccagttgcatgtctggggccctggatcttatga

SEQ ID NO: 689423 - DNA, 109 bp, Homo sapiens
cctcaaggattttgcgaaactcatccggtcgagctgctgaagatgccgcgatcaccaccgtgcgccgttcgtcgacagtacctaggtcttcacgtgcttagtgttgatc

SEQ ID NO: 689424 - DNA, 126 bp, Homo sapiens
atctcaaagcccagaaagctgaaggttcggagcaaggacagctttgcacgttctcctggagttcgctgaggagcagctgcgatgccgaccaatgtcttcatttgcgttccaccatgaaccgctgag

SEQ ID NO: 689425 - DNA, 583 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatgttatttacatgattaccatagggaaagccatattttgtccatctcaaaaagcaatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggttgtagactacttaaagatactcaatttgccagtattatatcctgctagcctatgaattaattctccatgtatctgttctaattctataatcacctttgttatatttcagttccttaaggactgaaccaaaattactaataaaatagtattgatattcaaa

SEQ ID NO: 689426 - DNA, 214 bp, Homo sapiens
ctaaaacaccgattatgaaaagagaaaaggaggagagggcttaaccagtaacctacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatg

SEQ ID NO: 689427 - DNA, 1953 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatgttatttacatgattaccatagggaaagccatattttgtccatctcaaaaagcaatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaaaaaactgactttattaagttattccctcgatatattgaaatgcatattgttgtggacaaaaatttggtactctggtggtgtaaaggattttaacatctgtagcttggatgactttaaatatatttcttctcataatggccttacatgtcttcagacaaaccctcttgaaatgccaacctacacacacaggagaatatgtggcaatgggttgttggaaggaagtgaagaatgtgactgtggcactaaagacttcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggttcaagaggtgctccggttttctgttatgatgaaattaataccagaggagacaattttggaaactgtggcactgcacactgtctttttcaacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatgtattgtttcgaaatgcattgtaaacatgttagattcctgatgaatttaaaattgtgtgatgcttctaatcattgtgatcgtcatggagtttgcaacaattttaaccattgccattgtgaaaagggatataatcctccttactgccaaccaaagcaaggagcatttggaagtattgatgatggacgcttagtaccaccaactgagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagagctctgtgtcagaagaaagcagcagtaacagcaagtcatccctcagtgaaagcaccagtctctaacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatg

SEQ ID NO: 689428 - DNA, 201 bp, Homo sapiens
ggtaccgcttctgtgtctgttcgcgcggcaattcgcgacgaaactcgtcaccagattcgacagcaagcggcggctgctgacctgctgtaaacgatagagcatcggctgatgcatactgctggcccagaacgccagccaggctttcatcgccgcactgctcacctgcgtttcatcgaagtttccgccaacaatcgcctgtaa

SEQ ID NO: 689429 - DNA, 137 bp, Homo sapiens
atatttaactggatacattcgttccgcagcatgacctctgagtgctctccaaatgggatgtcataaggcaaagctcataacctgacacgttcacatgcacacataaaaggtttctcatcatttcggtacttggaaaa

SEQ ID NO: 689430 - DNA, 853 bp, Homo sapiens
ggagctgccgccgaagcacagccgagggcactatggcttctgagttacagtgaatgatgaagtcatccaaagtttttaatgctctgacccgtccaggaaatcttctacacaagaggagatcaaaacagagaaagaaagcagttctcttctgtttaagcgatgacaaaagacaaataatgtgtagaggaagcaaagcagatctgtggtgggtgacatgtggtgatactgtagaggacccctaacatctttggtgaagtgtgtacctctgaaatgatgtgcgcgatatgcttgtgtacgatgccaaattagaaacaaaagagtctaagaaagaagacctagtatttatattctgggctctgaaaagtgcacctttaaaaagcaagatgatttatgctagctctaaagatgccattaaaaacgaaatttacaggtattaaacatgagtggaagtaaatggtgtggatgatattacggaccgttcgacactggggagagaaatcgggaggcactgtagtagtttcacttgaaggaaacaccattataaaaatgacagtcaagtgccatctggatccttaaggagctttcaactttcttccagcttcagtccatttgtcaaaagaatcacgcgtgggtaatagttgaatttccccctttcccagtgaggccttcccaacaccatgactgcggaactatcattatttaaggaggcctatcaggatgcattcaactggtgcaactggtactttatatagaagcaaagaatggctctggcatatttcaggcaaacatggttattggccctgagaagccaaagtgtggtcgcatgaagtagcaaggacagaaaatgatcgga

SEQ ID NO: 689431 - DNA, 1886 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatgttatttacatgattaccatagggaaagccatattttgtccatctcaaaaagcaatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaatactctggtggtgtaaaggattttaacatctgtagcttggatgactttaaatatatttcttctcataatggccttacatgtcttcagacaaaccctcttgaaatgccaacctacacacacaggagaatatgtggcaatgggttgttggaaggaagtgaagaatgtgactgtggcactaaagacttcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggttcaagaggtgctccggttttctgttatgatgaaattaataccagaggagacaattttggaaactgtggcactgcacactgtctttttcaacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatgtattgtttcgaaatgcattgtaaacatgttagattcctgatgaatttaaaattgtgtgatgcttctaatcattgtgatcgtcatggagtttgcaacaattttaaccattgccattgtgaaaagggatataatcctccttactgccaaccaaagcaaggagcatttggaagtattgatgatggacgcttagtaccaccaactgagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagagctctgtgtcagaagaaagcagcagtaacagcaagtcatccctcagtgaaagcaccagtctctaacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatg

SEQ ID NO: 689432 - DNA, 1770 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatgttatttacatgattaccatagggaaagccatattttgtccatctcaaaaagcaatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaaaaaactgactttattaagttattccctcgatatattgaaatgcatattgttgtggacaaaaatttggttcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggttcaagaggtgctccggttttctgttatgatgaaattaataccagaggagacaattttggaaactgtggcactgcacactgtctttttcaacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatgtattgtttcgaaatgcattgtaaacatgttagattcctgatgaatttaaaattgtgtgatgcttctaatcattgtgatcgtcatggagtttgcaacaattttaaccattgccattgtgaaaagggatataatcctccttactgccaaccaaagcaaggagcatttggaagtattgatgatggacgcttagtaccaccaactgagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagagctctgtgtcagaagaaagcagcagtaacagcaagtcatccctcagtgaaagcaccagtctctaacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatg

SEQ ID NO: 689433 - DNA, 257 bp, Homo sapiens
  misc_feature (3)..(3): n is a, c, g, or t
agnagatcccgctgcgctcttatgagtatacacactttaatttatcttttggggaggataggtgagtcagcaatacactggtttggtggtgtggtgctcacactgtatccagcactttggaggctgaggtgggaggatcacttagctcagaattcaagacagctgggcacaaagtgagaccgccatctctacaaaaaaaatacaaaaattagccaggcatggtgtcccgtgcctgtgtcctcaactactcaggaggc

SEQ ID NO: 689434 - DNA, 1703 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatgttatttacatgattaccatagggaaagccatattttgtccatctcaaaaagcaatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaattcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggttcaagaggtgctccggttttctgttatgatgaaattaataccagaggagacaattttggaaactgtggcactgcacactgtctttttcaacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatgtattgtttcgaaatgcattgtaaacatgttagattcctgatgaatttaaaattgtgtgatgcttctaatcattgtgatcgtcatggagtttgcaacaattttaaccattgccattgtgaaaagggatataatcctccttactgccaaccaaagcaaggagcatttggaagtattgatgatggacgcttagtaccaccaactgagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagagctctgtgtcagaagaaagcagcagtaacagcaagtcatccctcagtgaaagcaccagtctctaacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatg

SEQ ID NO: 689435 - DNA, 1942 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaaaaaactgactttattaagttattccctcgatatattgaaatgcatattgttgtggacaaaaatttggcggaggtctcgaatctgttgccccagactggagtgccagtggcatgatcttgggttcaccaaaacctctgcctttctgggttcaagcgattcatctgccttcagcctcccaagtagctgggactgcaaggtactctggtggtgtaaaggattttaacatctgtagcttggatgactttaaatatatttcttctcataatggccttacatgtcttcagacaaaccctcttgaaatgccaacctacacacacaggagaatatgtggcaatgggttgttggaaggaagtgaagaatgtgactgtggcactaaagacttcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggttcaagaggtgctccggttttctgttatgatgaaattaataccagaggagacaattttggaaactgtggcactgcacactgtctttttcaacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatggtttgcaacaattttaaccattgccattgtgaaaagggatataatcctccttactgccaaccaaagcaaggagcatttggaagtattgatgatggacgcttagtaccaccaactgagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagagctctgtgtcagaagaaagcagcagtaacagcaagtcatccctcagtgaaagcaccagtctctaacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatg

SEQ ID NO: 689436 - DNA, 171 bp, Homo sapiens
actagataacttctctttttttccactttcaccagtataagaggagagttcttattgcaataccataatgcagctgtacagccattagtactgacgtgctggctaatggcaggccagtgctagccttcctagaatggtacgtcatgctaggggtcaagacggccagggctc

SEQ ID NO: 689437 - DNA, 303 bp, Homo sapiens
  misc_feature (35)..(35): n is a, c, g, or t
  misc_feature (108)..(108): n is a, c, g, or t
  misc_feature (198)..(198): n is a, c, g, or t
  misc_feature (224)..(224): n is a, c, g, or t
  misc_feature (228)..(228): n is a, c, g, or t
gcggtacgaggcgcgcgctcggggtcccggtcgcnaggaggaggaggatgtggcgcgcggaggggaaatggctgccgaaaacaagccggaagagcgtttcccaaagtntattctgcggaactagcacctactgttttctcaacaccgtgccacctatagaagatgatcatgggaacagcaatagtagtcatgtaaaantctttttaccgaaaaagctgcttgantgtntgccgaaatgttcaagtttaccaaaagagaggcaccgcttggaacactaaatgagagatcatgatgcagccgtcc

SEQ ID NO: 689438 - DNA, 1629 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaaaaaactgactttattaagttattccctcgatatattgaaatgcatattgttgtggacaaaaatttggttcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggttcaagaggtgctccggttttctgttatgatgaaattaataccagaggagacaattttggaaactgtggcactgcacactgtctttttcaacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatggtttgcaacaattttaaccattgccattgtgaaaagggatataatcctccttactgccaaccaaagcaaggagcatttggaagtattgatgatggacgcttagtaccaccaactgagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagagctctgtgtcagaagaaagcagcagtaacagcaagtcatccctcagtgaaagcaccagtctctaacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatg

SEQ ID NO: 689439 - DNA, 1745 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaatactctggtggtgtaaaggattttaacatctgtagcttggatgactttaaatatatttcttctcataatggccttacatgtcttcagacaaaccctcttgaaatgccaacctacacacacaggagaatatgtggcaatgggttgttggaaggaagtgaagaatgtgactgtggcactaaagacttcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggttcaagaggtgctccggttttctgttatgatgaaattaataccagaggagacaattttggaaactgtggcactgcacactgtctttttcaacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatggtttgcaacaattttaaccattgccattgtgaaaagggatataatcctccttactgccaaccaaagcaaggagcatttggaagtattgatgatggacgcttagtaccaccaactgagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagagctctgtgtcagaagaaagcagcagtaacagcaagtcatccctcagtgaaagcaccagtctctaacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatg

SEQ ID NO: 689440 - DNA, 153 bp, Homo sapiens
gtagtttcacatttcatcttttttcttctaaacagtatgtattcatcttctaatttccctatcttctctattcatgtacaccttgcaaggtgcaggttaattcaagtcctgttgtggcagtttgcagggcccagcttctcacatttttggcag

SEQ ID NO: 689441 - DNA, 1732 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaaaaaactgactttattaagttattccctcgatatattgaaatgcatattgttgtggacaaaaatttggtactctggtggtgtaaaggattttaacatctgtagcttggatgactttaaatatatttcttctcataatggccttacatgtcttcagacaaaccctcttgaaatgccaacctacacacacaggagaatatgtggcaatgggttgttggaaggaagtgaagaatgtgactgtggcactaaagacttcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggttcaagaggtgctccggttttctgttatgatgaaattaataccagaggagacaattttggaaactgtggcactgcacactgtctttttcaacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatggtttgcaacaattttaaccattgccattgtgaaaagggatataatcctccttactgccaaccaaagcaaggagcatttggaagtattgatgatggacgcttagtaccaccaactgagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagagctctgtgtcagaagaaagcagcagtaacagcaagtcatccctcagtgaaagcaccagtctctaacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatg

SEQ ID NO: 689442 - DNA, 1727 bp, Homo sapiens
tcaaaaattggtggggtttggttaaatttgggctggtgtccctttactttggttacaaaaagttcctttggggtcttaaatctggccctttcccccccttctttttgtgggagttttcccagtgaattaacatgtgtgccccaaataaacacactataaccaactcctatttgcaagagctattatcgtgccaccaaccttcccaggtgggtctccgtggcgccgcaaaacgagaaaaaattaacacggtgtgattctacaaaaaagagtcgccaagagtgtgaagaggttctctcttttctttctatactccacaaccatatagtgtggggggttagtgtcccccttataaggttcaccattcagtgtgcatatctagagtgtgcgggattctccactgtgccaaactctctttcagagtctcccccacaatatactctctctctattttcgcgtggagatcatagaaagagtgtatatctctccaagagagggagagagccccaccacaagaggagagccagcagccttggtggcgggccaatatcgctgtggacaaagaaccacttctcacgtggggttatagagaaaggagacgaacactaaatttgtctttaagagagtctccaaaatttaaaaatagtgtggagggacggtgggacaaaatgagggcaggtgtatcccgagaatgtttaaacatatcaccgggggttttttacaaaatgagggctatcacgcgagaatatacaagcgaggaaaaagagaggggtgggggtttaaaatataaaaaaacacgtgggaaaatgtgtggcttctcacagaagagggtacaccacagatgggaaggggtttgtgatgttcaaacaacaggtgtctatatattttcacccgtttcacaagccaaattttttcccccaggataaaaacgtctccgggagacaaaagcgggggatccccgtggtgggaaaggcaccacccaaaaaaatactggtgggaagggcgggagacaccaccactagatggtgtccttatttgcgccgcaaattataaacccaggaggggggaggcggagaattgttctgcttataaaggagaaaccccccaccagtgtattgatcggtcttcttacgaaacaaggcgggtggtagtacttgacacagacgacagcagagcagcttattaaccccacttatagttgtccaccacaacagcgtggtgaggggatgaacaatcttgaccgaagcccatccttgtttctcaaaccacagttggtgtgcaaacacgaaggacgattatacacagtgttgggggcaatatctaaccactcgtagtgggaagaaaggcacggttctttcatggaacaaacacaaccgtggcgtgcggcctccaacggtgtccacagagaagaaccccccggggtagaacgcattaaacaaacactttgcgccacgaagtaaggcacctccccagagaagaaaggggtgatgcgagcacacacggcgagggcggagcgagagcagcgtgaccacagtgcaccaacaaaggcggctactacacctgtctctaaggagaagaagaccccagctgcagggagcaacacaagtggggggtggcgcagcagacatagcaccccgcaggagataaaaggaaacacccccctcctcaaagagaagaaccgctactcatcctcggagtggagagagcagcacaaatgcaagtactccact

SEQ ID NO: 689443 - DNA, 849 bp, Homo sapiens
  misc_feature (56)..(56): n is a, c, g, or t
  misc_feature (71)..(71): n is a, c, g, or t
  misc_feature (80)..(80): n is a, c, g, or t
  misc_feature (91)..(91): n is a, c, g, or t
gctttccgctcggctgttttcctgcgcaggagccgcagggccgtaggcagcatggngcccagcggaatggntggtcttgnagccccacttncacaaggactgtcagcggcgcgtggccaggtggttcaaccagccggcccgtaagatccgcaggtgaggcccgtgcgtctcggggctggcccgtggggctcgtgcccgcggctgcggcctgtggttgcgggtggccgatgccaaggtcgggggtcgctgtctgcgacctgtggcgtggccggtgtcctggcggccttaggtcgagggtgatcgccggtgcgcttgttctccaccatgattaaggcccggactgcgaaggtggcgccgctagcggcccctgcggcgcggcgttgggatcccagtggggggccaatctgtgggggtggcccctagggtctaccggaaccaacaatggtaaggtgcccgccgggtgggtggctgcaaactagtggagagaaagctcaggggtggccctggtgttgtccacaagatggggagcggcaccatccgaaaattcttggcagctccgagggagggggaacaactccgacgggagtgcctggccagtgcaaatcgtcgcaagagcgtgaatggattaccggcaccaaaattcatccttcttccccaggaagcctcgggccccaagaggggagaagtctgctgaaagactggaggggccaccaaggtgacggacggtcaggccgcaggacgtataagagggagggcccagtcatccgtggggagacacaattaaagcgtcgagcccgatgccgccacacggggtctggatggaaaaaccggacgcgaaggtggaaaaaa

SEQ ID NO: 689444 - DNA, 604 bp, Homo sapiens
  misc_feature (56)..(56): n is a, c, g, or t
  misc_feature (71)..(71): n is a, c, g, or t
  misc_feature (80)..(80): n is a, c, g, or t
  misc_feature (91)..(91): n is a, c, g, or t
gctttccgctcggctgttttcctgcgcaggagccgcagggccgtaggcagcatggngcccagcggaatggntggtcttgnagccccacttncacaaaggagtcgtgccaggggcgttggtgcgacgatggtgtgttcacagcacggcgggcttcgtatccatcacgacagtacagtgcacggcggccaggccaagcgaagggcgcagctggatcggacgcgcagccgctcggggtcgggtcccgatccggcccattggtgcgctagcccaacggtatcggtaccaaaagcgaacggtgcagcgcacggccgctggccttcagacctggacggagcctcagcggtggccggaattcagcaagcaaggtggccccggaccatcgagatttcatgtggatccgaggagtgcggaacaagtcacacggaagtctctgcaggccaaacgtgcagcggctgaaggagtaccgctccaaaacatcatcctcttccccaggaagccctcaggccccaagaagggagacagttactgctgaacgaactgaaactggacacccagcttgacgggacccggatcatgccccgtccggaacgtctataaagacgga

SEQ ID NO: 689445 - DNA, 421 bp, Homo sapiens
  misc_feature (12)..(12): n is a, c, g, or t
  misc_feature (50)..(50): n is a, c, g, or t
  misc_feature (69)..(69): n is a, c, g, or t
  misc_feature (142)..(142): n is a, c, g, or t
  misc_feature (187)..(187): n is a, c, g, or t
  misc_feature (201)..(201): n is a, c, g, or t
  misc_feature (233)..(233): n is a, c, g, or t
  misc_feature (236)..(236): n is a, c, g, or t
  misc_feature (251)..(251): n is a, c, g, or t
  misc_feature (332)..(332): n is a, c, g, or t
  misc_feature (341)..(341): n is a, c, g, or t
  misc_feature (376)..(376): n is a, c, g, or t
caaggcccacancccccaaattgggtttccatcaaaattttgtccctgancccccaatgttttgaaaanaattgacccaaactccttccccccatggtttgaggaagatccatgctgccagcccactttgggaatccccaanatcgcctacgaggaagctgaaacggatagatgacgcccatgaaanagttacagaagaanactgacagcttgacgttctggggcccaccganaantcccagagagagaancagagatgtgaaaaacagtgaaggagactgtgcctgaggaaaacggggggcgtggctgcagttctggacgggctggccgantgcgcgggntccttgtgcagggaagagctccctgggcacctggnaccacaagaccatgttttctaagaaccattttgttcactgataca

SEQ ID NO: 689446 - DNA, 734 bp, Homo sapiens
tcggcgttcgacgacgatgggccggggaccaggatgcgttagagcattccggtcactggcgcactaggtgtcgtgccgcccgggctagacgaagaactgtgacgcaaacatagtataggagaggcctaacgcgctgtgctcttctgcgtcattgaatcacgctcgtaatactctcatcgctggtagagccaagatctgatacccccaaaatccatgccgagctgccgtacgaacaggtggcacgagtgcacgccggctatggagcatgacaggagtgtgagccatgtagggatcgaggcaacagactctactcttgcctggcgatatggtggcctcaccaagtaggagatgcaagttcatcatttaaagccaggccacagatcgcctctagatgctgcatgatgatgtgcactgtgagaaccacagagccagcacgttttctggacactaccgtcgcacttcagccattgatcaaagccgtatatgctgcactaggcctacctctgatagatactgcttaacagctccaaactcttggcgtgcgtcttgaccgagaaaggtataaactcgtgcaagatgatgcacactgccgcggttcagggttgcttgagctactagccctatagggagtcccatactagggccatcgaccgcacataccatgtgtgtgtcaagtaaagccgtgactgccaccgacttaatagtctaggggtaactgcactttgcctagctgg

SEQ ID NO: 689447 - DNA, 101 bp, Homo sapiens
gatggatgggtgagtgggtagatggatgataaatgtataggaaggtggatggatgagtgaatgggtggatggtcaaacgtgcacaaggctactgaatgctg

SEQ ID NO: 689448 - DNA, 250 bp, Homo sapiens
ctgcaggttataatggcacttgctgtggcatgagattcaacatctgatgtgtgactcagctttgtgactgtcctcactcaccggtgtgcagagtctttgtccatgaagagtggttatctactctctgctacccagtggtgagtggctgggtgtaagctgtgtgtggtgatgactaccctcacatctcagtattggccctatatcgaggtggtgatcctactagatgtctgacctgcagtgcattgcaatg

SEQ ID NO: 689449 - DNA, 491 bp, Homo sapiens
aggagggtcctcagcttatgaagatacggattgggagattaaagtaaagagaggcataagaaatggtagaagtattatttggggaacggataaaggtccatgaaattttcacaactcaggttcctcggccggggctccagctggtccttcggctcagggtcccggcttcccagaacattcggtatctacccaaagtaaacgaagtcattatacaaaaacaatactggcacgtgcatgtttatagcagcacaattcacaatggcaaaagggtggaactaactcaaatgcccaccaaacaatgaagggataaacaaacaataggatactactcagccattaaaaggaaagaattaacggcattggcagtgacctggatgagatgggaggctattattctaagtgaagtaactcaagaagggaaaaccaaacacggtatgttctcacggatatgtgggagccaagctatagctgaggaccatcgttggggtacc

SEQ ID NO: 689450 - DNA, 503 bp, Homo sapiens
tctcgtcacggggccctcttatcattgatgataaggggttcttcggcagatccctgaaatgacctccctgttggccgctctgtggatgagactttgagactagttcaggccttccagttccctgacaaacatggggaagtgggcccagctggctggaaacctggcagtgatcccctcaagcctgatgtcccaaagagcaaagaatatttttcccagcaaaagtgagcgctgggctgttttagggccaggctgcggggggcacccatgagaacaaacccttttttggattttttttttcccttagtaaaacccaagacttcagattcagccgaattgtggtgtttcacaaggccggcctttcccacaggggggggagagaccacccttttttcctttggtaggaatggcctgagttggggttgggggccggcccctggtttgtatgatgtattagtagggcccccccttaatcttttgtggtttgtattaaacttgacctggga

SEQ ID NO: 689451 - DNA, 161 bp, Homo sapiens
  misc_feature (64)..(64): n is a, c, g, or t
  misc_feature (92)..(92): n is a, c, g, or t
gcgctccggccaaccggaggtgtccagaagccccatcggggtcggcctggtacagtggctctcngcgagattcgccgctaccagaagtccancgagctgctgatcagaaagctgcctttacagcgtctggtgcgtgagatcgcgcaggacttacaaagacc

SEQ ID NO: 689452 - DNA, 369 bp, Homo sapiens
gtcacgagtgatttttatcatggacttgattgtccatgatatcttttatctactggacatcctggtactgcctctctacttagattttgtgtaggctgaaatttaaaatttttcttttaacattccttcaatgaatccagcaggtgtagaaatcgggaaccagcagtattacatggggacttattttgtttatctagcctttgggtcaagcaccctaagttgctttgctctcacttgttggatggagagggtgtggccaaagtacctgcaatataaaacttgagttttctgtactgtgaaaaataaatagactttacgtggaagaggttttttactaataatatgaaactaataatctatttcttgtga

SEQ ID NO: 689453 - DNA, 918 bp, Homo sapiens
  misc_feature (12)..(12): n is a, c, g, or t
  misc_feature (293)..(293): n is a, c, g, or t
  misc_feature (313)..(313): n is a, c, g, or t
  misc_feature (318)..(318): n is a, c, g, or t
  misc_feature (352)..(352): n is a, c, g, or t
  misc_feature (357)..(357): n is a, c, g, or t
  misc_feature (362)..(363): n is a, c, g, or t
  misc_feature (372)..(372): n is a, c, g, or t
  misc_feature (422)..(422): n is a, c, g, or t
  misc_feature (429)..(429): n is a, c, g, or t
  misc_feature (433)..(434): n is a, c, g, or t
  misc_feature (443)..(443): n is a, c, g, or t
  misc_feature (447)..(448): n is a, c, g, or t
  misc_feature (452)..(452): n is a, c, g, or t
  misc_feature (462)..(463): n is a, c, g, or t
  misc_feature (468)..(468): n is a, c, g, or t
  misc_feature (484)..(484): n is a, c, g, or t
  misc_feature (496)..(496): n is a, c, g, or t
  misc_feature (502)..(502): n is a, c, g, or t
  misc_feature (625)..(625): n is a, c, g, or t
  misc_feature (761)..(761): n is a, c, g, or t
  misc_feature (803)..(803): n is a, c, g, or t
  misc_feature (832)..(832): n is a, c, g, or t
  misc_feature (885)..(885): n is a, c, g, or t
ggctagccatgnatttcaacctgtctagccccaagtgtatgcttttaacaccacttgttactgctattataaacccctcacattccctctttctgtgcttttaagaacatttattttgaaaatttttctttgaaaacttttgatgatagctttttaattttagtgaattaatttagtaaattaattttagggttaatttacttatgaaaacttaaaaattggtaagaattttgttaaaatgttacactataagttcaaacatatatttcaagatatgtcttaaattggaagtngagatgataaaatataacgnagganatcttcatgaccttgggggaggaaaaaaatgggnagacnggacnncattaaaanaagacttcagttcatcaaagattatatgaacagacttgaaaaggcaagcnaaagggnagannaacagattnccgnncggncgcgcggcgnngcggncggcgcgccgagcggnaaaagaaggggngcgagnagagagaaagcaacgggaaaaagacagtgcagtaaaaaaactgggcaagacttgcataggcatttcacaaaagaagatatccaagtggccaataaacatgaaattgtgctcaaaatcactggntatcagaaatgtaaattaaaacccaaacaagataccaatatatacccatcagaatggcaaaaattgaaacagacgttaccaaatgctggtgaggatgtggaacaactggagattttatacaccagttgtggcagtntaaattggctaccactttggaaaattaattcctagtggaatnagtacatgtttctttgtgtcacagatggncaccaaaaatatataatgttcttgtcagcattattacatatatccctcaaacnagaatcatctaaaaatccctcaacagtaagaat

SEQ ID NO: 689454 - DNA, 356 bp, Homo sapiens
tgagacagactcttgctcttttgcctaggctggagtgcagtggcgtaatctcagctcactgcaaactccacctcccaggttcaaataattcttgtgcctcagcctctggatagctgggattacaggcactcaccaccacgcccgggtaatttttgcacttttagtagagacagggtttcaccatattggccaggctggtctcgaactcctgacctcaagcgatccgcccgcctcagcctcccaaagtgctgggattacaggcgtgacactcgcgcccggccattagtaagcattttgtttagcaggtactggatggaagcattttacatccaaaatcccatttcatcctcataaga

SEQ ID NO: 689455 - DNA, 190 bp, Homo sapiens
tcccgaattgcgttgttataccacccctcccttgccatctgctccagcatactccctagagtagtacaggcagggatagatctaactattggaaggcatccctcacacttttccaggtagaattctaggctagtccaaaaagggtccttcttttaagggttaagagaaactagacactgcaacttattag

SEQ ID NO: 689456 - DNA, 174 bp, Homo sapiens
accttaaacagcattataatatattgcttcacctattaaacaaaatatagacaacttaccagaaaaggaaatgtacttatcactttctctgtatcttttttttcttcctgatgctctaatatctatttatcttctgtatggagcaacttcctttcaacccattctactagaata

SEQ ID NO: 689457 - DNA, 968 bp, Homo sapiens
cttccccgtttttccaatgggtttcctgtttgccctcgcttttggccctccttttgtactctataagatgtctgcgcgcccacttttcgcgtgttttccttctccggggctattctttatttctatgccgctaatcccttttcggtccaagtgtccgcctgtgtgcctccctcctttcgcccaggagtggccttcggtcctcccaccaaattgcccgttccatttttgtcccactacgcgagttctcaaagtgtgttctccgaccgccgcccttacagcgtcgcggctgccctcgtgatcatctcgccgcgcagggtacaccctatcttgtccgcaccgggggccccccaataaatacgtgcgcatgggcgcatttctttcaaggggcactcccccgtgccccttacggtccgaaagcccggcaggtggtgccagcagggcggatccctccctcaaggccaccccggcctcgtggaacctctagaagctaaaacaaatacggggggacaccccaacagtgcgggcggtctctaacaccaggtgagagccacctccgggtgatgccctcctaggaagaaatgcatgcatggtagacaaacgccacgcagaaataaaataggttcatcaccacactcggtgatgtagaatagaccttttcactttatcggcgggacatttaataaatacaaatccttgtaccatccatttagccggtgttttggtgaagaatccataacatcgccccttctccctctatcataacccacgctttgacaaccctgtcatacaggagaaatatacgcacatcgctcatagtgccgctccctctctcctctattgctctccacacgtccacagaactcccaatccctgaggtttgcttttttctacttggagtgactcgaaaagaaaacgaccttagctttgtcccccgccaaaacaagacccttttaaacgaccacaaaaca

SEQ ID NO: 689458 - DNA, 154 bp, Homo sapiens
  misc_feature (49)..(49): n is a, c, g, or t
ggcgggtctcttcctggacctcgttcacccacctcggcctcccaaagtnctggggattacaggcatgagccaccgtgcccaaccctaactaattttttaagtttttgggatttaggaggtctcactatgtggcccaggccggtttcaaactccg

SEQ ID NO: 689459 - DNA, 1022 bp, Homo sapiens
gtaacactgttagccgccaccggcgatggggtgggcgctggggagcaggacgatgcatcccctttctgctgcaggaacctctcatcagaccgtcggacgggaagcggcgcccaggagaccgctgccccgggaccggtccagattcgtccccagcgaagccgtgagtcatatggggcggggacccataaggggcagcctggagccgaagccacggaagccatgcccgcagaaccctctgaaaccgtccaggccacggggcagccctctgggatgcaggccaggcctcgtggagcgaagcacgcaccgcacacgcacgaagcaggccagtgaagcagaagacaggatcgatcgtggttcacagacccgggtcacacgtggtgcactgcattctatgcactgaatggacaaacaaacgcgcatggactacccatgcatgggcaacgggatcccacaggaccatatcagaccgccgctccagcatctcaccacgaaccgccaacgcgcccaactatccctcttcgacgctcgatggagcacgcgaagactgcacgacccgacccagccagcgatggctcatccaaccatgatgcccagtcgataccagagagagatgctcaaagatagtaacccgagggccaacacacaccaagcttaccagtcaggctgggcagacgacgcatcacgccaagggtcatgggagccatccaaactacacaggacaaaggccaaagcgacgagaatgacaggcgccccaagcgatggacagcacgggcaaatggagccacaggttgaccccttaagcaagggcagacggagaacacgaagggatggagaacaccacatacacagcacaccaacaaggagacacataccacaacgcctgggcaaccaggctccacgcaaagagagccccacatccccccgggaagcagacgacgagacagcaaagacaaaagaacaacagagacaccaagcacccgcgccacaaggacggaaagaccgacacagaaaacggaccgagg

SEQ ID NO: 689460 - DNA, 603 bp, Homo sapiens
ggctccggctcctcagagagcctcggtaggtgtggaaacaggaagagaactagaactggaagtaaagcattgaagatgtgactgaattgctgcaatctcatgatcaaatttgaatggatgaggagttgctttttagggatgagcaaagcaaagtggtttctcgagatggaatctactggtgaagttgctgtgaacattgttaaaatgccaataaaggatttaggaattacagaaacctggttgataaagcagtgccaggtgtgagagagttgacttcaattttgaaatcaagttccactggctgggtgtggtggctcacacctgcaatcccagtactttaggaggccgagactggtagatcatttgaggtcaggagttcaagaccagccttgccaacatggtgaaacccacctctaccaaattagccaggtgtggtgcacacctgtagtccccagctacttgggaagctgaggcaggagaatctcttgaaccaggcaggaggaggttgcagtaagccgaagatggcgccctgatccagcctgtgtgacagagtgagaacttgcgttgtacaaacaaagtaccaatcaacaacaacaaagacca

SEQ ID NO: 689461 - DNA, 100 bp, Homo sapiens
  misc_feature (83)..(83): n is a, c, g, or t
ggaggtgctgcgaagttggggctgcctggggatacatcattcactctttggggacgtgaagaagctcatcactgatgagtttnttaagcagaagtacctc

SEQ ID NO: 689462 - DNA, 341 bp, Homo sapiens
agaggcggcactgcaggacccatcctctcgttgcccaggacgcttcctccatctccacctcctccctgcgtttgtaatgatctcttcctctcttcagtgcgttacttaggatttcatttatcctgcccatgttcatcccagatccaaatcgacccatgtatgccataccgacatcaaaggggccctccattcctcccattgtatttattcgcgaactcctatgccttccattcccattcccgcgggatctatgtttcccattccgatgccttgatacaggtgattggcatcaatgggttgccctcctgggcctaacgccatgccaatatcaccatggtgca

SEQ ID NO: 689463 - DNA, 463 bp, Homo sapiens
tacacgtcgtaaacgctgcaagctcaatcaaccgatagttgatatactctcaacagggagtacaggcttgatctcaatggtctagaacatgtactgtaatttactagaagagatggtcgtcttactattcaatgatccacacgaacttcccagctccatgcgacgagtacagtccaagaataaactcacactttctgaacgcatctatgctacctatttgtatactttgcgatcctcaggtgtccgtgccacatattctctctcaataagtccttcaatacgtttcttaataacaactggacttggtaagaatcgcgccttcaactgctgagttacctccgctactagaacatagtgctgcatcttctttctagatttcattatccgcactatagcagcttctatctcatgtttactgtcgtcgtctactttctgccttgtttctttcctccccgggatacag

SEQ ID NO: 689464 - DNA, 664 bp, Homo sapiens
tggggtggggtaagtgcgggggcggtgaacatctgttcaaagtgggttgctccggaattgcctgtcgttccacaattcaggactggctgcgggtgaaaaggcgtgggaagcttgttctcctgacgggagaacgatgcaggattcaggaatatacaggagaaggctgacgtggatcgaagggaatgcccgacatcaccggattttgatgccctggcttggatatcggcgaaacagcgcggcgagtttttgctggaagggactgtcgggcgaatccccgttcacatccggttcatcgaagcgggcgaaacatcctgacgtcgtaaaactgcggtaggcgacataaagaaaaagcgattgggcagcaagtgttgcccaggtctgctgtacttcctcatgcagtgacgtaatccatattcttccttccaaacaatggataaagggttcaataaggatatcattttatatcattcggtccggtaaacctaaaagcaaagggcgcactagtgtcaaatcttgaggtaaacgcaatctgaagtcggggttgcatctgggtcgtggattacaatgacaaatgagaagcactattgatggatcagcataagcgcagtgtgatgtcctgcgcagatctgggcccctctccccttccaggtgagggctgggtgag

SEQ ID NO: 689465 - DNA, 653 bp, Homo sapiens
ctcaatacagattctgtaataaatactaattgtcttttcccgaggaataacatattctacttggatattattccagactgcatcagctctttgccagtcaccgtttattttattacagttttagcagattgtagtacatctggactctatcacattcaaatagcttctatgtcaactccactaatttttccagagtttcaacctgattattttgccacacatctgtcaacaaaaccactgaagcccagcagatcgagctctaatccctggagtactcaatgaacttcttgggctcttagtaatttcctgtttgtaggaaggcaaagaagagatcatagagcaacaaccaattaccaccttgtacctggctcacaaagtccatatgctttctgaattagatcagtctacgcctttctctaccagtatacacaagacatcatgaatccttggtaatactttatacttatcataacagtcaatagcgacctccagaaccgtacataagtagcccttatcccagtgtacagtgacccaatggaaacatatttaggtaggtagttctgctaaccctagaatcacgatggcttcatgcaactgttttactggttcaatttccctcttaaagtgcgccattatcatgtggaaaaagccag

SEQ ID NO: 689466 - DNA, 157 bp, Homo sapiens
tgtaggaagagcctcggcttgcctgatcgccgcccgtcatacccgccgccaggtcaccatggatgatgattcgccgcgctcgtcgtcgaccacggctccggatgtgcaaggccggcttcgcgggcgacgatgccccccgggccattcaacgcctccg

SEQ ID NO: 689467 - DNA, 132 bp, Homo sapiens
cccgttggagcgactttccccatgatgctcgcggctttcattgaacggatcacgcaccagcctgatgccgaggctcgcgagctccggcccgcggtcctgaagaccgtcgcgtgtattctgcatgtttcgatc

SEQ ID NO: 689468 - DNA, 102 bp, Homo sapiens
gatgcgaggctggatgagatcacaggaccacaggtactgggcttgaaacttaatattgctaatgaagtttcaacccagctccttgtggctccgacgcggggc

SEQ ID NO: 689469 - DNA, 965 bp, Homo sapiens
acacaggctggatgtaggagggcaggtaccggcttgttaatttcagtgcgcgggcctgggcgtccggattaagaagaatggtgcgtgaggtctcagacaagatgcccaacagcagaggtgactccatcagagagcagatgagagcatctccactcggtgacacgagatctgcaatcccggtcactgcacctgaggcacgagtgctacccaaggacctgtcccaagaagcatgctagaggcatccttgagaggaacagggacctggcatgtggatgtgggtgagactggacccatcaccacccatattcactccaagccccgtaacgcctgcgtggcacaacggggggcccaaaaagccagaggctcacacacacgagatatacgagactcatgcagagggaggaggcgcaccagacgtaagtgtggtgttggagacgagacatgtacacgtctagaattgtagatgggcatagtcctacatacacacatacaaggcaagtgagaaaggaaaggcatcaaggacagcggacaatcagatgaggacgtgggagaaaagacttatgaggttggacagtgacatgaagaggaggtgcagatgggacttaccaaaggtggactgcctccggggacgactgggcataatgtagcacgtgggaggactgggagctgacgggcagccagaggggagcacgactcccccacacccatggggaatctcgtcggacgtccctccggtacgataatcaaggagccaggccctgggagaactgaggaaagttccacacagagtctcctactgacgaaaccagaaggctcttgagggacagaatactgacaggactacccgactggaccccctcgggccgcagctcacaccatgagacgagggcgcccaacatccggcacagaaaacatgatagagcaaaacagaggaccagacaagaaacaaagcaccacaaaaagag

SEQ ID NO: 689470 - DNA, 879 bp, Homo sapiens
  misc_feature (325)..(325): n is a, c, g, or t
  misc_feature (327)..(327): n is a, c, g, or t
agtgcacccagggtactctaccacatgtacatgaatggtttacttaatacgcgttcatgctatctgtgagctagagtccctggggtgtcactgtgcccggacacctgtagctcccagcgccacgtacgatagtaccgacattcgactgacctcttaggcgaccgttcgagcttacccttatactggaccgatataatactgttatctgggacacgtctcgcttatcaacaatagtctggctattgcgggattcaatcacctgtctagctagtccctgacggacgttcgaattcacggttggctttgatcgctttagaacttaatngntatgtggaggtacttgggagtggggcgctacccaaagctactctccgcacaagctaagttccccctcttggcatgccagcttcaccaacgttgtgaatgtccaatttcttggtactagttcctcaccctagttggtcactctgattggcagcgactccattgacatggtggtgccatccccgccattattaagtggagccacagcaggcactttctagtgactatggtggcctttcacctagagctcattctgtcgtttctagtctaagaactcggatggggacctgcgtacctggaaggaaggtctgattttcgctaacccatacggtcacaaccgtctcaccaactggtctgggtttcacccgtaagtcaaccccgcccacagagacccaccacaaacgaccacgttgtgttgctcgcattccgtaactcccattgacataccgccatcacacgcaataacaacctacccccttttatctactcccacaatgtctactccctttttgcacactacccaataccattcacaaactatgcacaattctctca

SEQ ID NO: 689471 - DNA, 314 bp, Homo sapiens
ccccttttttttttccggggggaaaaaaggttttgcccctttttttgggggggggtttccccctccccccttttgggaggggggggggctttttggggggtccctttcccctttgggggggggcccccggggggggggcccccccccggggtttttttttttttggccccccccccttgggtttaccccccaaaaagttggggggggggccggcggggattggggtttggtttttttttttttttcccccaagggccccccctttgcccgtttttttttttcccccgggggataggggggttttttttttttta

SEQ ID NO: 689472 - DNA, 368 bp, Homo sapiens
gcgtcgacgccagtgccacgcaccacgaatgtcacgataaacagcaggaagcccaggggatcacgccgaacgatgcaggtcggtgtaggcctcgctgaactcgttggcgatgaccgatgcaatggaactgctgggcatcagcaacgaggcggagaactgttgcgcgttacccagcacgaaggtgacggccatggtttccccagggcgcgaccgaggccaagaaagatcccgccgaccacggccgagcgggtgtagggcaacacgatgtcccacaccacttcccaggtagtactaccgagtgcgtaggccgactccttcaattgagtcggaacactgcggaaaacctcatgcatcaccgacgtgatgaa

SEQ ID NO: 689473 - DNA, 225 bp, Homo sapiens
tgtctcccacccagtatttgtgcataccactgtaccccatccagatacggaatcatggaatctaattaagttcactccacttgaatttcgagctggcctaggcgattcgcatcagctactaaaatgtggcagcagcaatgtagtgccatctccaggcttagccacttaaagccctgacagcttcggctgtgtctcaccttggaaccctgagtccattactcggat

SEQ ID NO: 689474 - DNA, 228 bp, Homo sapiens
ccccccccccccctttggaaagcccttttttaaacctatttttggggggaggccccgcttaaaggtggggaaaactaaaatccccgggaccccttaacccccccccaaaattttttggggggggccctttttttacttttaaaatgtttgggggaactttcccctgaaaaatttttggccaattttttcctggggttatttggtaaaaaaaaaagaaattcccaaaga

SEQ ID NO: 689475 - DNA, 949 bp, Homo sapiens
gggccatattagcagcggttattcggtgagcggtggtggttgtattctgccgcggagtgaagggctccgtggacatctcaggtcttcagggtcttccatctggaacgtatataaagttcaggaaaacatgtttcgagagatatgactctgaggatcgaggtatatttactccagaaggtcggcgttatagccaaaggttgtatagtatagccatggaaatgcatatttggagaatgcaggcacctgtttttgggaactttgatgcaagagtgagttggtgttattgctttggatgaagagaggtacgctagacattccatcaatgacttctttggatgaacgtctgggtgtttctgaaaagaattgataaactcaagggaggacatggcttgacggtgtgggcaggcagtaacttgtgatgctaatgttctggagtaatgaactaagggctcattgtcacaggtattgattacagtatcaggagccaataccttgtgagcaagttggttacagcgctgtgtggtattaaaccaaggttatacacgaaattgtgggaggagaaacgttcccttgggtggttcaatttgcggcacattggggtgggaataaggccatattgggttttcaggatcgtatacagaagatgatccgttgggggtgcagtaccggggggatggcagggcgccagtggttgtggaaataataaggggggggcggggggggtcaagtgttgtaccccgaacgttatgtggggggggaagtgtctgtttgtgatggaacattgtttgtgtggacgaagggataaataaaccacagggggggtttgaaacctctgtggtgtgaagggagggttgggaaacaaaaagggatgagggcactttttaacaaagagggtggcgaactagagagaagagtggtggttgtagaaaaaagaaaaagtgtatgttgc

SEQ ID NO: 689476 - DNA, 842 bp, Homo sapiens
  misc_feature (459)..(459): n is a, c, g, or t
accatgctccgactgctgagttccctcctgcttgtggcccttgcctcaggctgtggacagccttcccacaacccctccagccgagttgtcaatggcgaggaagctgttccccacagctggcccatgcaggtctcccttcagtatgagaaggatgggagcttccaccatacctgtggtggctccctcattacccctgactgggttctgactgcgggccactgcatctcgacttctcgcacctaccaggttgtacttggggagcatgaacgtggtgtggaggaaggccaagaacaggtgatccccatcaacgctggagacctctttgtgcaccccaagtggaactctatgtgtgtgagctgtggcaatgacatcgccctggtcaagctctcaagaagtgcccagctgggagatgcagtccagcttgcctgcctccctcctgctggtgaaatcctacccaanggagcaccctgttacatcagcggctggggccggctctccaccaatggacctctgccagacaagctgcagcaggccttgctgcctgtggtggactatgaacactgctccaggtggaactggtggggcttgtctgtgaagacgaccatggtgtgcgccggcggcgatatccagtctggctgcaacggtgactctggaggacccctcaactgtcccgctgacaatggcacctggcaggtccacggtgtgaccagctttgtgtcctccttgggctgcaacaccctgaggaagcccacagtgttcacccgtgtctcagccttcattgactggattgaggagaccattgccaacaactagatccaaggttcggctggcagagaggaccc

SEQ ID NO: 689477 - DNA, 305 bp, Homo sapiens
ccctcgatatgtagaattaacgtgaaagttgtgggggcacagtatgctacaccttgaattctattttaggaacattctttcactggcatatattcacttgtatcacaaaaggtggttctcattcaggcagattaacaataagcactaaaaagataattagatgactgccaatgtacatcagacataaattactgtgggggtagaattactgtaagaagagatcacacattgtgtagtttaatctttaattcttcttgtatcctgagataccagttaatattctttccttttaggattgaacttat

SEQ ID NO: 689478 - DNA, 1632 bp, Homo sapiens
agtgctgaagacattctgttgaagacaaatgctaccaaagaaaaaatggaccaagcagccaatgcaggcagctgcagcacaatctcacatcgaagccacacatccagcaaacgtttttggacccgaggcatcagtgctgcatttggcacagccattgacagccagttgctcaatgcaagtcattgaacaatggcagatgcctagcgacccccacagccagttcacagcacacttgccaccagcacagcatcatacgtgcacacgcagttgcaacagcctttctcgaaggtagcaggttattcttcagcatcagtgctgctgcacattgccagagctgcagcatgttgttcagacagcaagctcacacaagcagcaagccaacaagtgccacaccagatgttcaaagtccactggccagcatcatggtcacacaggcacagctctggcacagcacagccgcacaacaggcccccagggtcggccagccaagcagcacacggccaacttcaaacacagccagcatcgcacaagcaccattccaagggcaacccacaagacaacattgcttcaacctatcagcataagcaagtctgcacacacaagcgagctttcctagcagggcaacaccctctgtttcaaacagctgatcccccaagcagccactccagccggcagtctcaagcaagcaaggcacaatggtcgggcaaagcacaccttccaagccgggcaccaagctgcacccacacaaactcacgggcggcccaggcccaggcacatccacattcggcacacccacacggccagctccactcactcccccgcccgcacacgcccaacacagtcggcccaagcacaagacatgtcaccaacggacaaggcaacctatcgaacgcaactcgggggtggacacacgacacggactcgacagacaacaggctcactccaccagcaacacggtcagacaaaacaccctacacaccctcgggccccaacacagaaccacaaccctagccacagaacgacccaacgcccatggaaagtggccaagcacaacgggacaaacgccccgacaatggcccgcccagacaaccggacagccacaaccacacgcccacctaccaacccacaccaacagacaacacacaaccacagagcctggcacaccgagccccccaacgcagatttacggacacaggacaacaacacgaacggaccacccccacaacaaactcacacaacgcacacggggccaacagagcagctcgacccgaaccgggaacaagaggacacaagcacggcaacacgccaccaccaggaatcattcaagaacaagaccaatcgcaccgacctagcaacaacaagcgtgcaaccaacagcacaacaaacacgggacgcagcggaacacgggaccacccaccaacacacgagagcgcatcaagcaccaccacagaactacacgcacacgcgcaccacactcgagagaccaaaccacggacggaacacccaagcacgccgatacacaactaaagcagcatccgaagaccgcacgcaagacaaacaaaatgtcagcacgagcgcacgacacccacccacaacttaacacagcacacacagaaccacgaaaccccgacc

SEQ ID NO: 689479 - DNA, 718 bp, Homo sapiens
ggtcgtttatggcatttgtctggactcattacttgtggtagaaatgccccggagcgctgggtcatgcatcatccgtgactgactgagaaggcgcgagaggagtcttccccgctgcacagagtgcgtggtgatgctgctcgtgagtggcccagtggtacccagtgccgggccggaataaggacatcctctactgtgccccgatcctggctcacagagtcagatggctggctgggacgacatgacaaggcccgagaccagggcattgtgactttgagagacagtggctgtatacttctcctggaaggaatggggtcttcttgattgagtgctcagaaatgccttgtaccacgaatgtgattgctggatgaacttggacacttacaaacctcccatggggttggttctcggcatgcaagtgcgatgcgggagagacactatactcagcagacgcaccttacatcccccaacgcgcggttgtcaacacggtccaaggcatacctaatggcaccttaccttctcccctcagaagaccacaccctgagagactattgtggcccagtctatgacgacaccgattttgcacctacggttgaccaccacggaacaacaccatggtcaagaaatggaatacagaacggggacttgtaggaacaacatacaaacataatagaataacttatacaggaccatgaagcagcatgtatgtccaagaacacaa

SEQ ID NO: 689480 - DNA, 180 bp, Homo sapiens
  misc_feature (62)..(62): n is a, c, g, or t
taggtgagtaaaagagaccaaaggagtactgtgagtgtcaaaaaaaaagcacaaatatccanagcagtatttagagaaccaagggagggccgggtgtggtggctcatgcctgtaattccagcactttgggaggccaaggcaggaggatcacctgaggtcaggagtttgagaccagtctgg

SEQ ID NO: 689481 - DNA, 291 bp, Homo sapiens
  misc_feature (60)..(60): n is a, c, g, or t
  misc_feature (162)..(162): n is a, c, g, or t
  misc_feature (167)..(167): n is a, c, g, or t
gggcacgaggggggtcctgctcctctcaactttgaagtccccacgtatgagttcaccagntgacgatatggtgattgttggttaagagactgggacccaagtcagaggcttcttttagtttaaacgcccacctttagaaaaaaaagagaacagaaccccttntgtanttgaagtagattaaaaatatgtaagaattgatgatgtatttgcaaacattaatgtgaaataaattgaatttaatgttgaatactttcaggcattcacttaataaagacactgttaagcactgtt

SEQ ID NO: 689482 - DNA, 92 bp, Homo sapiens
aaggaaacgccaagacatagaaaaccacgcttttcccgtagaaggaaccgatgatgagccctgatgaaagaaggaagaagacccgctgtctg

SEQ ID NO: 689483 - DNA, 122 bp, Homo sapiens
taagatagactcgagctcggtaccgtcacatgaccatcgccctccccttttcgggactcgtattccctcttgggctgacacagcttctccctttcccaaccaataaagtaaccactttcagc

SEQ ID NO: 689484 - DNA, 132 bp, Homo sapiens
gaaccgcgccgtggtgtgccctcaggtgatcgcgaggacggacggtcacgcagttacttggcgtgcacgccatgatggcctggaattccggcttcacgtcttccttgtccaggtcgaagtagacaacgcgct

SEQ ID NO: 689485 - DNA, 282 bp, Homo sapiens
ttccccaaattggttgggcccttggggttttttttgggaatgggggggacccccttgttgttggggggcccccccccctttttttttttgggggtttttttcccgttccgggcaaatttttttgggggcagggcgcctttccccggggggggaaggcattttttgttggccttccggtttttgcgggtccctttttgaccgggggtttccctttggtttttgggtttgggggggggggtttttggtttccttaaaggtggaattaaagggtttttcccttta

SEQ ID NO: 689486 - DNA, 935 bp, Homo sapiens
  misc_feature (9)..(9): n is a, c, g, or t
  misc_feature (12)..(12): n is a, c, g, or t
  misc_feature (14)..(14): n is a, c, g, or t
  misc_feature (18)..(19): n is a, c, g, or t
  misc_feature (23)..(23): n is a, c, g, or t
  misc_feature (25)..(26): n is a, c, g, or t
  misc_feature (28)..(28): n is a, c, g, or t
  misc_feature (40)..(40): n is a, c, g, or t
  misc_feature (44)..(44): n is a, c, g, or t
  misc_feature (46)..(46): n is a, c, g, or t
  misc_feature (110)..(110): n is a, c, g, or t
gtgattganatngntttnnatcnannangagagatgcatntgtntntgccataaaaaatcattactggtaccagatgtacatagatgatttaccaatatggggtattgtnggtgaggctgatgaaaatggcgaagattactatctttggacctataaaaaacttgaaataggttttaatggaaatcgaatgttgtatttaatctaactccgtgcacaggaaaggtgacccctggttccaaatactcaaaatccagatgtcatattccagtcaaacatggcaacagtccgcatgtgcacttctgacgcatcgcattcgacaaatatcttgcatccgtccttttttcaaccatcggccttcattggttttcaattttcaactccttcatgcatggtgcatcttcttggtgggctccagtttccatgcattccccctgcagaaccccattacgccacaagcatcctgctcggtcaccagtcaagaggccgccactggctgctatggctagcagacctcaagagatgactcatggctggccaccggtgcatggcacatgtcatttcagaccatcaagtcacacccctgcatactttttccatctctgatggctctcggcctgtcccctctttcgcccgtgtccctccatccgttcattactggtcgcacaccgactagacacaatttaatctacctgagcggcgattcacatggctcccagccccagcccctcacccgccactatgctcgcccacctcctcccgtgcacctgctcatcccgcgacgcaactctgactcccagaaccaccgcagccggccacgctccacccacacgtcactggggcatccccatcccactcaggcggcgctcgcctgcctcccccccatccacccttcttccccgcccacaaccccccccgccaccccccccccccccgc

SEQ ID NO: 689487 - DNA, 201 bp, Homo sapiens
caagacatcatgttgtactttataagtgtatacaatcatgatggcaggcggattatgaggtcaagagtttgagaccgtcctggccaacatggcgaaaccctgtctctactaagaatacaaaaattagctgggcgtggtggtgtgcacctgtagtcccagctactggagaggctgaggcaggagaatcgcttgaatccggga

SEQ ID NO: 689488 - DNA, 102 bp, Homo sapiens
tcgacgtgtatacaacactgcggtgacatgcctccctgtacaagtaccgtcgtacacgtgagcaaccgtgctgacctccaaatatcgtaaaagctggagcct

SEQ ID NO: 689489 - DNA, 155 bp, Homo sapiens
  misc_feature (83)..(83): n is a, c, g, or t
gctggtggttgagatgccccaatctaccctccttgttatttagaacacgctctcccactgcacaaggctcacttattcaatgngtacaatatgtacattcaagtataatcacatctattattatttaattcaatagtactccagcacactcctcc

SEQ ID NO: 689490 - DNA, 908 bp, Homo sapiens
ccgccggggtcgagcggatccgcgcgatcctgctgccaccgcggtgtgccatatgcgggagcaggagcggtggtccggagtcaggcgccgtgccggctgggatgtggtgcgttccggtgtgcggcgggtgcggggcgctgagcggcgtgccccggcacaccctgcttgcgatgctgccgctccagcactggacgagtccgacgtaccgtgcgcagcccctctcctggagtggcaaggagccgtgacttctgcgctgcggcggccccttccggcgctacatgcagctctatacgtgtgcgctgctgggcagctggggactgccggtgggcgccttcttcggcctgcactgcgataccccgtgccccaatggctgtgcccagtgcgcgctacacgttctgcccaatgggcaacaagttacgtggttttctaccctggacctcttccttcactcttcctcctagaacttgaagcgctgcggcatggcgcgcgccttgcctccaggccgtcaagtacctcattgttcgcccttcaacctgctctttctggctgggcaggcctgtggccgtgctgggtgtcaggcaattctggctggcctacaacacagggggacgcttcgccacgctgtcctctttcctttcccagtccctgtcggatgccaacctgtctcatcatcaaccgggcgccttatgtcactggccatcggcttcgtgggctgccttgggttgccatccacggcagaacaacgttgcctcctggtcacttacattcctgcttgcatgcatagctggtgttcctgcatgggatggcacagcattcggccatccctccttcttcgacctacacgggacaagacttgaccacgtaatgccccagcaaacgacctgaagaaaaggcttgaaccatggtac

SEQ ID NO: 689491 - DNA, 298 bp, Homo sapiens
gtccagaatgtcacaggtcagggcagaggaccaacatggagcatatgttatgagcaacgtgggtctcagaggtgatcggcgatcagagggcgatgaagttctagatccatagagacgagctctagacagtagcatgcagttccacgacttgtaccagcattcccagcgtccggcattccatgtttctgctcctgtggcctccacggtgcaacaagctagcggtttacttggacctctgcctcatctttcttcttttgcgcttcagcctgcgcattcgcttcttcctccactttgctct

SEQ ID NO: 689492 - DNA, 408 bp, Homo sapiens
gcggtatgaagcccagaagctggagcgcatggagaccaatgtggaggaacggggacatcgtccagcacagtcctcaagccagagccgaacactgtcagctacaggccagtccagcttgataccacctggtggggccttcagactgcaccctgcacaggcttggtgcacggaggtgtgacccatgaagctcatggcatgagggtcgccgggatcgtggcttgacgccgatgcaagaacaacgatcgtcacagattccgggtgacgccattaattttcatgaccagatcagagaagggtgggttatcaccaatctcgggaatccattgacttaacgaagaataagtccctggagacgaggagtaggcgacagcgaccctgtaggttgacggttacaagagacacgggcgc

SEQ ID NO: 689493 - DNA, 266 bp, Homo sapiens
catattctctacagaaggaaaatccagcagacaccgagctgacatgatgtgtgctgaggccacatgacctgaatggacgggtcatgtgggagagggccctggtgggagctgtgggccacacggctgagtacttccaatacggaagccccgagctggtaggctcacacgctgtgggtgcagcccagagttgctggacagctttcacagagggtgcgtaagctaatggagtcagtatcgcacggccgctgtgaaggggtacccccgct

SEQ ID NO: 689494 - DNA, 1550 bp, Homo sapiens
ggtgtctcgctgggccctggtactgaagacgcggatccgggatcgcccctagactgattatactactcacccaaagccccgcaacccgccttttctctctctcctctggcaggatgaggcgtgcaggcctgggtgaaggagtacctcctggcaactcatgggcacactcatggctcatgctacatcagtggggtcatcaggtgccctgctgcaagcacagcacacaatgcagcaggcctccactgcaacagtctgcagcaagcaaaagtcaactgctcatcacacaatcctcttttcccagtggcacacatcaaggcaccataggcaaggcttacagagacctcaagcaaatcaccacatctcatttagacctgtcacacatggggatttcaactacactcttggaattccctacgaaacatgggcattgtctaaggggtcagacacacctcattggggccaacacgttgtcacaggaatctgacgcaattcaccacagcagggggcaagcgcgcaacctgaaaagcctggctggttggcactcatcatggcatcgtcctgtctttcactttctccatcctggctccttctcactgctcatcccattttcatgtgggcaattcacttcaacacctggagggtggcatggccatggcttcacactttcggttgcacctttgcgggggacacatttatggatgccacaaacatttgtacacttggggttttggccagctttaatcacccttttttgggattacacacacccaattcatggcaatccaaacagaacgcattattccttacgactcggttcccaccacattaactctggtggtgccatatttgtcccaagtgtggacgaccaactttgggtctggaacatcgtcggccctctacgttcgcgtaacataccagagtccaaccaatatacgctgacactatacgcaagggcggagccataagcgggaaaatcacactggtagcagtgaaagatgagcagcaccacatgcaccaaggccaccgctaaatcaaagtcacagggggacgtacaagctgcaacaacaggggcacggacaagcacacacaccagcagccgtacaccacgacgtagggcacagcacaactgggacgcgggccaccaagccacacaatatacaccagcacgattacatacgaaactctatgtgcggcgcattacacatcacaggcgacggggttaatgagcccaccggtgtcgacgcaatcttgatgagagcacagcacttcaccccacagtgccggcagcacacattgactactgcgccaccatggaaggcactctgtcccacatgcgtgcaacagcggaagttgacattcacatagcgcaccactaatgaagcgtatcactgactacgtctgaagctaacacgaacacgacgcaaccaccgaccagcccacacaagtatatagagcacacgtacatatcaacagactctacaacagcgtaacactcagcggcagccaacaaaaacattacagagcatagatacacaaaagtacaaaagtaa

SEQ ID NO: 689495 - DNA, 792 bp, Homo sapiens
agcggggcgggtcgtgcggccagccggcgggaacggggctgaggcggcgcagcggagtctgggcggctggcgcgtcccgcccgagggcggctctggcctgagggcggaggggccggggaagatgcccggggcgatgcggctgacggcggtgacgcgccggctgtgggagccgcttgccccctagaagaacccagccgagatgctggcggaacaacctggtagacggagtttgagatgacaggacggacgagcccgtggtacgaccaccaggacctccagcaagatcttcaaccttgctgcctgacccttggcggacggaccagttacctgggatcgggaacacagagtcaggaggactctggttcagcagactgtagtacaagccaactcaggagcaggttacaagggaaattgagtagttctggacgaaagcaagatggagactgtctacgggcaagatgaaacgagacaaacatgccaacagggtttatggaacgaattgcagacgttcaacaagcaatagtgcgcaccctgggctcaagcacacacacacgctcacacaccaggcgtacgcttggcctggaccaggccaacggcccagccaaccaggacacccagacgaatttccttggacgcccttggatccttggacacacccggcactctgcacagttgcccttggccaaacccctcaggccacattctggacttcacccctgtccctagaatgccccactcgtcggagatgcggagcgcatcggaaccgtcccactccttgggccccacaagcgg

SEQ ID NO: 689496 - DNA, 148 bp, Homo sapiens
  misc_feature (81)..(81): n is a, c, g, or t
  misc_feature (148)..(148): n is a, c, g, or t
ctcggtccattaataagaaggccaaggccctgggacaacttcgcctggcaaaccccaagagtctgggcagcctccagcccnactcctgcagccagccagcaatgccagaggagaaacccaggagtcagcccatgaagggccaggggcn

SEQ ID NO: 689497 - DNA, 347 bp, Homo sapiens
ccctctaaccattcacagtcagtagggccaccacatgcatatactgcacagtttgtgcacggcacaactcgagtgggtaccagtcacttggtctggggtccagtacacaatctgtgtacagtacagaaagccttcatcacctgtggccagagacctgtattctacacagtctgtcagctcaagctaatcaagttaggaaacctgatatttggttgaagaatttccaagaaacagcgtgtacctgtaagagccaggtattacttaaggggtgcacaaggtacagacataaaacaggaagggttctaaatatattcgctggtcactgcacgagtttccctagaattgcg

SEQ ID NO: 689498 - DNA, 996 bp, Homo sapiens
ggtgaaagaggtgcctgcttctccttctgccatgattatagtctgctgaggcttgcccagtgcatgcgtaactctccttcccattgatgagagagccacatgacatcagcccatagactgtggagagtattccagatctatcacattctgcgattctgcgattcccagaaggctggtcatgaaaaaatgccctcttcagtttgcatatatggctagggctcctagtgctcgggtgaacagtttttgaatcttcgtggttgccatcgtgctatagatttcgagtctctaattgaagaaaatcatctgttgtatctcgaggagccccttgattcaagtttacacaaagatgtgccttgtggagactatcctgttaattaagaacatgttcagatcccacttgtatgtgagacgagatgcttctctgtgccatcagtcaggtaccacttaaaggatgtacaggcgacttctagatatctgttgagagcctggtaaggggtgaaacacaattcagggaagggagttgaagataaaggggtttaccgtgggaagagaagatccggggtgccttcttggaagatgcttgtggttgaaagagagatgaagatgaaggtccctgtgaagaagttggcgctgccagagaggatcgatgggcaggactggcatcagcaagtagtcgcaggtaggtagtcttggttcggagagtctaggcgaatttcgctactggtgcccgttcgattgcatggtgcaactgggttccgaaacactggtccgggaagagaatctggctcaaccctgattcacgggttaggacccccgaaattctggcatcaggtctccccatgcagggtgcggtcacagacggtcgcgagcacggagcccacacagtcatcgcccccgctcacgactcactggagacgccgagcatcccacaaacgtctttcccacgagacgacgaaccaccccaacagcgcgcgcccagcaacaaccgcctcataa

SEQ ID NO: 689499 - DNA, 102 bp, Homo sapiens
atcagttcctcctgacaggtgagcagtggtgggaaaaaaaaaaatggagctgggattatgggtctgatgaagaaactaggatttgctcattgaaaactcagg

SEQ ID NO: 689500 - DNA, 483 bp, Homo sapiens
  misc_feature (483)..(483): n is a, c, g, or t
ggccgggcgcggtggctcacgcctgtaatcccagctctcagggaggctaagaggcgggaggatagcttgagcccaggagttcgagacctgcctgggcaatatagcgagaccccgttctccagaaaaagaaaaaaaaaaaaaaaaaaaaaaaaaaaaaatttggggggcgcggcttgggcccctggagaaaagttttttaagaacaatcgcggggggggcgcgcggggcgcccaagggggaaggggacaatggggccaaaaagcgcgggttcccaagagagagaactccggggcgcagagagaaaagcgggcggggagttccctccccatatataaaaaacgcgccggggggaaaaacgcggaggggtcgcggagaacaattctccaagaaggggggttccgaggagggccataggggggactcatacaaaggggggagtccaaggggagagccggaattcaattaagccccgacggggggaan

SEQ ID NO: 689501 - DNA, 768 bp, Homo sapiens
gagcgggtcggcggcctgcgagagcagcgcagtgagccaccggctgggactgccggcgggtgtgaagaaaaaaatgacactccaatgggctgcatgtggcaaccgtcttctttatgccgaaataggactcattttaagtctatctgcctacctaatagattacctccatcggagagatggcataagataagatcattgtaatgactggggtaaaattgcaacttgtaggaacaaggcatatccttgaccagttatcatcctatggatagttactatgacatagatgctgtgagagaagtaatggaaactactattcctcaaggttcataccattggagaaaggagcttccaaagcagacaaagctgagtgccctattgaaacgctacaacagattgaaagcttgtgttaagagctctcagcacagacaattcttttagcacttgtctcgcgaattacaccgcgtaatattatattcgtgcgtaggttttatggaggaccgtcttggattaacgaccattatttgactctatatctgggtataaggaacacgtaggtcaaaaagcaataatgggtcgttatcttataaaataagtacaaaagtattgaagagatagtaatcttaaagcgagcagggctggtccaaaacaaaagttatttaattgggaaggacaaataggacgaaacgttagaaaaagaggatgtttggaataagggccagtggttaagagaatggaatgaactggtgtaggaggcgacggaaagaataa

SEQ ID NO: 689502 - DNA, 176 bp, Homo sapiens
ggtgttagaggatcgggatctcctcctcctgcactgggcttatgttcactgaggttggtgggacacacatcaaatgtatcagttcttgtcactctttgctgtgggtatgggtcctttctggctaaagagcaaggacccccagaagcagccctgccctctgtttaaaatttctaacg

SEQ ID NO: 689503 - DNA, 385 bp, Homo sapiens
  misc_feature (223)..(223): n is a, c, g, or t
  misc_feature (225)..(225): n is a, c, g, or t
ctccctctatcgagcctttgactcctccgcccctgtacgatgaggtccaggcaaaggcgcccgatgcccggccacccgactgaaggactctctgactacactccctcctgtctcaccctccacaccaacagacttcgccaaagccacttcagccccagtcgaggggtcaaggcacacttagccactgtgatggggattgtgggtagagggagagaacgggttnanagagccccgcagagtaggggaatcagaaggatgctgggagtttatgatgctctgaaccatagcaaggggtgtggccttggaatccccggcatctttctctcccacttgggatcattgcccacacacccctctcctaagctgggacacgattccctagtgg

SEQ ID NO: 689504 - DNA, 1111 bp, Homo sapiens
gggctgctgatgcagagtcggtgtgcagcagaggacattttactgactccctggcccctgacacggctgcactttccatccacgtcgcggaggccggccgctactccggaccccaggatgcagaatgtgattaatactgtgacggggaacggcactggaacgtggctgagtacctgaccccggtcctcaaggcatcacagtttaaggaacacaggtgtaattaccccagaagagttagtggcagctggagatcacctagtccaccactgtccaacatggccacatgggcatacagagggaagaattgacacgtgcaggccataccataccaacaaggcaaacacataattcggataaccacaaacatgtgccgtgcatataacgcgggtgccaaacagcatggacatcatccgagcattgcactcggaagctcatccatcgacgcacgcatgcatggtgatggcggctgggtcagatacatatcacaacacagcgtattacacggacataaccggcaacagcccggtcacaacgcagatcacacactggaaaacactcacgggccacatcatcaggcttcacaagacataggctcaagcaccataatgtgaacgacgcgacacgcacgactgcaggctgaccggcagaacgactgcacacccatcggaccgaccatacagaacgcagcgtggacatgacagggcaacaccgcatgcaagcatacccctaagacatccaagggcacaacgcagatagacaccatgatcacagcccccacaatggcaacactgagcgactccaagacacgacatctcgaccaagccacacacctctagtgccctctaccattaaataggcaaacactcataacccaacgtcccgcacaaacgagatggaggggctactagtaacgaacagacgcagcttttcccagtagtacacacgtctattacgacatctggacaggacatatattagaaaaacatggagagcactgatgaactacccacttttacgacagacaaagtaataaaaccaatagtacaataagtcaatctaacaattcacgttcacaaacacgacacacacatcatcctatacacaaacacag

SEQ ID NO: 689505 - DNA, 238 bp, Homo sapiens
agaggcgtgctgttaggttactcatatctctagttcacgtgtggatatactctgctccaatttataaagtacctcagaactttcctgtatcctacgaaacaactttttaagaagagaacagatctttgccgcactcctaggagactggctgttacagattgtatgtaatagagaactgaatccactgcattgcttccatggaagcgatttctgtgcccgttgcaaaggttaccgagct

SEQ ID NO: 689506 - DNA, 552 bp, Homo sapiens
cacgagctggtgtaataaaccctctttggagcagagtattacgtagtagcaataagtacaatatctatagcattctatctgtcctttctttcctacctttactgacgtcgcacaccgtgaaacgacagccctttcagtatgaacaagttaaggaagtaatgtcagccgcacacagtttcaccctatgatttgcttgctttggttggctgggaaagcaatgtctgcaaagtgtacagcatagtatttactattctggttgaagcagaaaggaatgaaaaagcgcatatgcatcacccttctgggttgcagtatagcagtatgggaatgtatttttcttccagaaatgcgactttctggtttagctcaaatatatgtcctagcgactcattaacaaacattaactagtccactgactgaaggatgctatagctaggcactagaaataccaccaagatgaatacattgtggtcctgaaggaatctagaaagggatcagatgccccgtgtactctaatggcagtcacagtgtggtaagtgagcccgcagagagtta

SEQ ID NO: 689507 - DNA, 910 bp, Homo sapiens
ggctgtgtacttgtcctggaggacccgcatgcaggtactgactgatggatttgatataatccatcagtcagtatctgagtgcgggtccggctgtgtactagtcctggaggaaggggacgatacctcttccaaggggcataaattgggtgcggtgcttgggctgaagatgatccctgggtgcagcgagatatttaacgctagtgcagatggacaactatacccgaataggcttcgaccccatcgtccgtggatcgacgattattatcagacatgggtgaagccacagatcgtcttgctgatcgagtggacaatatcactgaacagttctgcaatgcttcagtggttgaccctgctgcgttcgctgcaggcctctgactccggaaggaaacagaggcctcaggggggagacgttcattgagattcctgtgcccagtgtagcacttatcggataaacctaacccgagtgtggcaaagggggacgatgctgcctatagttcatgcggattaacatagcgttcgttggacatggcacccagggtcgggaggccaggtactttaatgagcatatgagacgtacatgagagctctgatgactttattgacgtctgaagaaagcacggcacttaataaggcaggtaagtgttaccggaaaagccaaggggccataaaccgggaaggtgacataccgaagtaattccttacacgaagggattagatgccaactaagcagaaggacctgccccataatcgtcgacactactgtctaacgtccgtgtgcactgagacaagaaaattcttggtaccacgttctcgagcattcagcatggccggcgccccaaatagtgccactacaagcgttgagccacgtcgagtaactatagccggtcgaaaaactccaggtactagcaac

SEQ ID NO: 689508 - DNA, 298 bp, Homo sapiens
  misc_feature (85)..(85): n is a, c, g, or t
tatgaggccccaccgtcttatgagcagagctgcggcggcgtggaacccagcctgacccctgagagctgaccaccgtgctgccttncgtcaggcaggcctgcactcagtcctgggactggggccccagggcctcgtgccttctctccttgcctagcctggcccactcaggacctgcccagcctctcgcagctcctgccgatccgccctcttctccctggggctggggtgggggtggcagggagctgggacctggagagacaactcctgtaaataaaacactttatttgtaaaaaaaaaa

SEQ ID NO: 689509 - DNA, 167 bp, Homo sapiens
tccccacctgtgttctctgagagactgaagcattcgatggctccctggccaggatcagcccttcaggagctccttagtaaaggacttatcaaactggtttcaacagcacagtagcacacagtgagcacacaggtcagggatggagcacactggtctgaggattgggg

SEQ ID NO: 689510 - DNA, 319 bp, Homo sapiens
ggtgggcgagcgccagagtactgagtgggtgaagcacctgagcgtgccgagaggtcggatgtgactccgcatatacgagtctgttctgccggtccgctgtggggaggacacggaggctgcgatctgggctccccccagcttgtgtccttcggtccccagccccacctaggtctggccaatacctgcagcgtcttggagaatcctggccttggtggcctcgtttacctgtgtctgccgcacacgcccactgcccgacctgcccaggtggcccaggctgaatcccaggtcctcctggtaggcgtcctcctcgaatctaggg

SEQ ID NO: 689511 - DNA, 916 bp, Homo sapiens
tatctctaaagggtgcagggcctgatctcagagtttcttagagaaaggagagagaaagacagacagagagagagagagagagagagagagagagagagagagagagagagagagagagagagagatagtatttgtgtatatatagtagactctcaggggcgtagacatagacgagtagaggctcctgcggggagtgctccagagagggacacacgtgtctcatctgcccttacgtaggcgtgttgctatctctctcatagtgccccgaaagtgatgatgagaagcatggcagagacggggcgacagcgagatgctgctcgtcgtcgtagagcatggtgcagcaggcaggcagatgcagcggcggacgagcgcggcgaacaacaacatcaacaacaccaacaacaacatacggcggtcaaggatgatccgagcgcaggggagggaccacgtcggcggcaggcggggtcgtcgctggtggatagatacaaaggcatcagtcactccgcagaggaggcagtaggcagtcggcagtgcagcagcaagaaagagcgacatgcccggaagagagcgagtagagagaaagacagggggcagggcgaagtcagtcgacacgggacgagagagagaggagacaggcgagcaacaacgatgaaacggtgggggagaaccacaccccgcagtcgagacgaaaggagagacagacagggagacggtcaaccaggcacgtcgaacgaaggataggagagagtagtatggtagagaatggcagggctagactgcatagcgggggcacgcacacaaaacaccggacgacacgctacgcgtgtacggcggagccggacggccacataaatagggggcagagcgccgatagacagtagagaatggcatagttcgtagggggaggaggcgatag

SEQ ID NO: 689512 - DNA, 325 bp, Homo sapiens
gatctggtgatgctgaccttgttagatattattcctgtccaccccatgttgtgttgagagcttctcagactatccaccttcggctcgcttagctggttcgtgatgggaaaacaccttgtggcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgttagtttcaattggccatttaagtttagtagtaaaagactggtaaatgataa

SEQ ID NO: 689513 - DNA, 163 bp, Homo sapiens
tagaacagacaggaaggttgagtatcaactaacttacatcctcgtcagactgatgagaaaactaacagcccaatggggaatactggcctgagtacctatctcatctggttctgtcattaaccagctctgtgataccccattggatgttaggtttactcaacac

SEQ ID NO: 689514 - DNA, 338 bp, Homo sapiens
  misc_feature (77)..(77): n is a, c, g, or t
cttggccggggcgcaacgctctccggttgccagatttcaacaggccgctcggtgatccaggcggcctttttgctgtntgcgatccgcgcgccctacccggctcgctcgctgcggagcggccccttcgggccgcccttgacacgcctcggccgcgaagcgccagagcgggcatcgagcccgccctggcgctgctgacgcacccataaagccattctccagcacgcgcgtcgaaacgctgcccgcgcccagcaccaaggggccgggatcatcgccggagaggagagagaaagggtgacgcggtttcaacgaaggaggtcgagatgaccatcacgttccgc

SEQ ID NO: 689515 - DNA, 467 bp, Homo sapiens
atcgtgactccggtatcccagacaacgacgtggtcaaccggacccggttcacaagcggttcacgcgggtcccgggatcaatcctgtgaacacagcatctctttcatggcgtcaaacagatcagaaccacaaaactatgccaaatgtacatcttgaatatttgctaagtttagttacaaaaatcatctctcaagcttcaaaaaactaaacccaagtatcgtgattcagtgatttttttctgaaggtgggaatggacaatttactgaaaccctttcatagccttcaaaactgtataatctataaggatatcccttgtcaatcattacctttcaagactgaacctgaacaatactgggctatattatccacctctatgcagaaaccctggtatttccctgttaatattccaagttctctggcacattctgagaacataaagacatggcaggaaaagtgtcaaaactccac

SEQ ID NO: 689516 - DNA, 868 bp, Homo sapiens
ctgaattaggcagtcttaaaaaaaaaaaaaaaacgaaaaagaaaaaaaagaacgttgaaattggttaaaatgccaaaaaggacagtttaatttggtacagattatgttacctcaggtttctttagtggtgcttgaatgcccttctttccatataacacttatcttcttcttaattcggcaagggaatatctttaagttttaaaaaaccgggaataattatatctatctttttggcgtaatatcaaggggtcggtcgataaaatcaagtctgggtggtgggtggctgaattacatatttatgagtggtgcatcttaagtatagtggaacaagacaccatattaagtaccagcggataaagcattctatattcctgtaaaaaaaaaaaaattcttggctatgcttggtttttcaacaggaaacaaaaatgggctggtattcgggcctgtttgggaatggaatggggctaagggctctggcatttctgggcaggtctgtaatccggaggacttaatatcctccaaaagggtttagcctttggaattctgtctccaaaaaaaagtgtctggaaaaattctagagggggagaagtttccttaaacgtttcaacatcagcgtcggccatgcccctgtgcgatagtgcgctggtttgcaaccttcgtgaatataccaaggtcggcgtgcctgtcaacttcaaagggtggcctgtatgtccaaccgtagctattggtcgtgttctgcggggccaaattgtcctcacctttcctggtatcgagggcaccggctctgcaaacacaacctctttttatgtggggcgataaccaaagcgtgtgtgtcgctggcaagcggcaaaattttcttcgtgcaaac

SEQ ID NO: 689517 - DNA, 214 bp, Homo sapiens
tgcacatccattcagtatatttccatcctttatttagttttgtttgccgaaagtgaactccatgactttaaaatgatagcaatttatcaaccaaagtaatccgtacttcatcaccgctttcaataacatgcagtctactttccttagaactgttctgtattaatttctgaatactgtggaattcgtcattttcaaacgcactctggtctttagc

SEQ ID NO: 689518 - DNA, 296 bp, Homo sapiens
gatcatcacaagaagtctgagaattgtccggataaaggggcttggagacatacatctaaatgtaatgtagtatcctggatggactcctgcaacagaaaaagactttaagtaaaaattaagggatattaataaagtatgcattttggttaataatgtatcaatattgggttattagttgtgccaatgtaccagaggatgtaaatgtcaccaataaaggaattggtgtgggtacatgagatgctgtactatttttgcacttttcttaatctaaactcttataaatttaaaataaaagg

SEQ ID NO: 689519 - DNA, 252 bp, Homo sapiens
ctgtatttgggccagaaattcccagtatatttcccccacacaggcacagcctccctcatcatcagcatccccaccagagtggtatgtttgttacagttgatgagccgacattgacacattcagtcacctaaagtccatagtttacactagggttctctcttggtgttgtacatgctgtgggtttggacaaatgtataatgacgtgtattcactattatggtgtcatacagaataatttctgtgccatttcaa

SEQ ID NO: 689520 - DNA, 327 bp, Homo sapiens
gataccggcgtctgattctagcgtacggggggtagtatgtgggacttgatgattagagctgccgtagtctggtatactcgtcgggggggtaccattggcgggctatttgattggatggtaagggagggatcgtggagctcgtcagttatgtagaggatgcgttgggatgggagggcgatgaggactaggatgatggcgggcatgatagttcaaacggtttctatttcctgagggtctgagatgttcgtattagttagttttgttagtgagtgtaaggaaaagggcatacagagactagtgaagcaggataggaaaattgattattag

SEQ ID NO: 689521 - DNA, 523 bp, Homo sapiens
ctgtatttaatgttttctcttcggacagaaaagtggacacacacacacacacacacatgttgtgttcagtgttctgttttatattacttcccattgaggttggaatagaacaggttcttttcatgcaaactgtatgaaatgaaaaacttttaagactcttctttaattggagtttctgggcaacatcgtatgtgtgtgtgtgtgtgtttgtgtgtgtgtatacacagactttttttattaaatttatgatgcagatgtcctggtccttgaatcgtcatggtttacttattttgagaattgattgttaaaaatttcaaggaattaaaataaatccctttttttttttagagggtaagagattggtagaagagtatacctgtgaaaattttattagtttattcttgtggagaataccaagaaaatgtgtatttgcccattgctaaatatgatatataccatctttgtatttatttgtcccaagtgtctttttttaagaggagaataaacaataaggaattactga

SEQ ID NO: 689522 - DNA, 620 bp, Homo sapiens
agcggaaaattggaaggtcacatgcagaagagtaggactagaccctgtctccaccatatacacagatcaactcaaaatggattaaagactgtcttctatagctgctgtactaatttgtaattccaccaaaaatgtgcaagtgttgtcttttctccacatccttgccaacagttgttttttttgttttgttttgttttttaagacagagacagagtctcactgtgtcactcaggctggagtgcagtggtgcaatctcggctcattgcaacctctacttcggtggctgaggaaggagaatcgcttgagcccaggaggtagaggttgcagtgagccaagatcgtgacactactccagcctggacgacagagcgaaactctgtctgaaaacagttcaggtgggaggatcccttgaggacaggagtttaagaccagcctgggcaatgtagcaagaccttgtctcttaaacaaaacaaacaaacaacagaattgcaaaagccattagaaacctttctcctaggagaaaatgctacggaggcaaggagggaaccaggtatattctaagcggtaacactaagaagggcctaattgccccggtggtcagcatctcctatctacattatg

SEQ ID NO: 689523 - DNA, 283 bp, Homo sapiens
tgttcagacggatcccggctgaggcgggcggatcacttgacggtcaggagtttgagaccaacctggcaacatagtaaaatcccatctctattaaaagtacaacaaaaacaaaattagcggggtgtggtggcgcacgctagtattcccagctactcaggcggctgaggcaggaaattcgcttgacccggggagccagatgttgcagtgagttgcgatcatgccaccggcactccagccgggtgcacagagtgagcatcggtcccacacaacaacaataacacag

SEQ ID NO: 689524 - DNA, 257 bp, Homo sapiens
ggtgtgatgtggtgtgttatacatttcatgttaagaatatattacccacaactttcagagaagagctaatatctactgtgaagaaaacgtaacagactgtgtttagaacgttaatgtagttagtaccagtgcctgcgatggccctctctatttcatagagatatgtatccagtgtctcctgatacacttctcagttgcttgatccaggtgagaagaaagaagggcctagataaagtaaatcaacaactctgcttcat

SEQ ID NO: 689525 - DNA, 390 bp, Homo sapiens
ggtcgaccggggcctgctttttaagctgtacgaactctgggtgagcatcgctgccattgacgtcgatcttcttgaacagcgggaaactgacaccgaagttcagttcgcaaaattccgaaatggcgccctcgttgccgggctcctgcttgccgaactggttgcagggaaagcccagcaccaccagcccctggtccttgtaatgctgccagagttcctcaagccctttgtattgcggggtgaagccgcacttgctggcagtgttgaccacaagaatcgccttgccggcgaaatcggccaaggtcatttgctcacccttgatggtggtgcatgggatgctcagcaggttgtcgctcatggcagtgctcggaagagatgagaagaactgaacga

SEQ ID NO: 689526 - DNA, 265 bp, Homo sapiens
tcaaaataatgaacaatgtacattaaaatcacaaacaacaactataaagccaaatatctatagtaaaccaaggaaaatactgatctggactggttggactaaaagcacagaataaaggcaccatgctaatgaaaatttagcacaaacatcaaaacagacatagttacccacagacacatgtaacaacaaagggaaacaagatacagagacagattaaatgggatgaaaaaaggcacagtaaccattacagatacaaaaaacatgc

SEQ ID NO: 689527 - DNA, 143 bp, Homo sapiens
tcgataggcaaatttcaaactgactatcgcatccctatacattgggacagacctagttcaatgaatctgaagaggctaatcagtagacagtcccacgcctcacacgattctttagctttcacttcatctgggcccttatcgag

SEQ ID NO: 689528 - DNA, 529 bp, Homo sapiens
cctgctgaaataactccgatgggaagaaaaaagaaggcgttaagagaccctcccggcccaaccctagacactctaagatcctttttcaaacctgctcccatttcgagtcaagagatagataaatagacacatcccattgcactgatcggggggcgctcgtagtgactgagggggtcgaagaccaagaagtgagttatttataccaagcattcttcttatggctagatccaatctcctggtccctgcggaaaggaaaaagaatctcacgttcttcctttcgggaagggaggatcagggaaatcctattgatagctgatttctccagacctccgggaaaagcatgaaaaaaaggctcgaatggtacgatccctccgtcaccccagaatgaaaggggcgatctcgtagttcttggtctgtgaagatgcgtcgtaaggtgctccattttcccgtagtaaggtgctccattttcccattgaggccgaacctaaactgtgctcgagagatagctgtccataacaccacacattcc

SEQ ID NO: 689529 - DNA, 241 bp, Homo sapiens
caggccactgagacagcaatggttgtatcaactattaacgcgttatgtgaggcactatcctgtcggttttgacgggcccctggggcggagctcgtccgcgatgtgctcaagtggctgacggaccttccccgtctccccagcagtccgtgcctttcccatgctctgacttttgtatcttgcctacagtttccctaggctttcttgtctcagcaactttcccatctcgtctcttctcttgtac

SEQ ID NO: 689530 - DNA, 300 bp, Homo sapiens
ctacatggaaggtgttatgggtcatgagggcagatacctcatgattggctaggtgccattctcatggtagtgcgtgagttctccctctttcaaaactggattcatacccttaggactgaattagtaaccaccagagtaggatataatacaagccaggatgcccctcaggttaagcctcttcacatgtgtacacttaccctttgaacttctctgccatgttatgatgtgtcaagaaagctctcggtcaggcacagtggctcatgcctgtaatcccagtactttgggaggccaggcaggcgg

SEQ ID NO: 689531 - DNA, 316 bp, Homo sapiens
gctcgaccctcttcgctggcaagcaggctcctacaggtctgtggtgtccgcaaaacctgtgtccgacgccgggtgctgaatcagatcgggcaggtcacgccgtgccgcgaatcccgcaatagccttcggggttcttcggcaggtactgctggtgatagggctcggcatagaagaaggtcggcgcttcgtcgatttccgtggtgatagtgccatggccggccttgctcagttcggcctggtacagctgcttgctcttcagtgccgcttccaactgattcgggctggtggcgtagatcaccgagcggtactggctgcc

SEQ ID NO: 689532 - DNA, 279 bp, Homo sapiens
cagcgtataggagatataatagactttagaacttccaacatttttttctttttttggagacagagtcttgctctgtcgcccaggccggagtgcaatggctcgatctcagctcaccgcaacctccgcctccctggttcaagcgactcttctgcctcagcctcctgagtagctgggactacaggcacacgaccaccacgcccggctaaattttgtcctttttagtagagcaaggtttcaccagtgtcatggcttggtcttgaacctcctgggaaccttccc

SEQ ID NO: 689533 - DNA, 1239 bp, Homo sapiens; identical to SEQ ID NO: 687359

SEQ ID NO: 689534 - DNA, 1854 bp, Homo sapiens
  misc_feature (1462)..(1462): n is a, c, g, or t
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccacctggctccaaagacaaaaaataaaaagaaaagaaaaagggaagattatttcctaatagcaaaaaaaaaaaaaaaaaaaaaaaaaaaaaaaaaaaaaacaaaaagaaaagaggggggcggcgccgccaccagagaatatacccccccgggggggggccccacagtttacagccgcgtaccccgcagttcttctctgggaccacaagggggcccccctataggangagagggcgctattatatataacaacaggagcggccggggcgccggttgttaaacaaccggtcccggagacggggcaaacacggctgccaacggggggaccacttcgggggggagggagaacccctaaaaccgccgggggggtgcggaccaccaatagggggggcacaacactacttccctaacaggagagatttttagaaggccctccaggagggggcaaacataataaacaccaatctgaaaagcggggttctcagcgggggtcgaaaaacacaagagggggaaatatctgctgaggcgtgttaaaaaaaaattgtgggcaccaacgcgggagaatgtatatgtgcagaacaaattttttccccgggagtggtagtattataataatcag

SEQ ID NO: 689535 - DNA, 1842 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcagcttaagtttgaatgtcatttcttcaatgggacggagcgggtgcggttgctggaaagatgcatctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggcccccttggcccaagccattttaaacctgaaaaattttattcatggcccccaaatttgggccaaattggccaaatccccctaaaggggggcgattaaaaattaaagggcccggtttttaaaaacgtggaactggaaaaaccctggggttacccaaataaaacccctttgaaaaaaacccctttttcccaagtgggataaaaacaaaaaagcccccaccaaacgcctttccaaaaaatttcccaacctaaatggcaaaggaaaattgaccgttaaaattttggaaaaaatcccggaaaaatttttgaaaacaacctaatttttaaacacaaaggccaaaattggaaaaacccctttaatattaaaaaaaattccccgaaaaaggttaaagggtttccacagttggaacacaagagccctcttttaaaaaccgggccttcaccctaaaaagcgaacccttataaagggcaaggcccattcgggcctcccct

SEQ ID NO: 689536 - DNA, 500 bp, Homo sapiens
tgaaggtggggaatcctccgggggctcagagttgtggtactcgtaaaacagggatcatcgatgtggtctacaattgcttctattaacgagcgggttcgtaccaagacccgggtgaaaattggcttcgtgctcatcgacagcacacggtaccgacaggggtacgagtcccactatgcgctgccccggggccgcaaaaggggagccaagctgatcccttgaggaagaagagatttaaccaaaaacggatctacaaaattcagaggaattatgatgaagggaaaaggattgccaaaatcagcagtctccgggaggagcagtcccagcggggcaagcttctggcgtgcttcgtttcagggccgggacagtggggccgagcagatggctatgtgctagagggcaaagagtgggagtcctatctaaggaaattcagggcgcggaaggtaagggcgcggtaggtaagggcgcggaaggtaagggcgcggaaggtaagggcgcggtag

SEQ ID NO: 689537 - DNA, 823 bp, Homo sapiens
  misc_feature (544)..(544): n is a, c, g, or t
  misc_feature (568)..(569): n is a, c, g, or t
  misc_feature (628)..(628): n is a, c, g, or t
  misc_feature (639)..(639): n is a, c, g, or t
  misc_feature (658)..(660): n is a, c, g, or t
  misc_feature (673)..(674): n is a, c, g, or t
  misc_feature (791)..(791): n is a, c, g, or t
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatactttctattcacccaagagggaggttactgtgccgcctttcggacaagccgaaccgtgggggaagttcccggggccgtgtgaccgtgaagcttgtgggcggtgcctagctgccgaagtaccttgtgaacagccccagaagggacactctctgtgatgcatgagtgccgtgtgcctgcgggttgtgaccaacctatcttgcatgaacacgaaaactacagggtcgttgctgcgaccgagctttcaacatgttgcatgcgtgcgaagttctanattcctgagtgttgaccttgtgcnntatcccgtggcaaagaaccccatgccgcccgtgcatgcgacccacataccttccctgtngtcttggctcnttgtgagatgggctttctnnnatccagtgcatgnncattgaacgtccagcgtcggttcccgggacacgtgcagcgacagagacagacctgggcgtgcgtgtccgacatggcctggatccagcaagtggacgacttggacccttccgagacgncctggcttgatgctggagaacaggttccctct

SEQ ID NO: 689538 - DNA, 587 bp, Homo sapiens
  misc_feature (231)..(231): n is a, c, g, or t
cgacatgttaccaaggatgataaataggtgccaagtggagcaccagctgtgatgagtgccctcacagtggactggagtgagaagctttcgtgacctcataaagtgaaggcttatcttcagtcattgtgttatatattttacgtgcattagtcctcatataaacccaagaggtaaattagtataattatcgttcattgtaggtgacaaagttgagacacagaagaatcaaanaactcttccaggatcaaccagtaaaaggcagaccttggattcgaaccaggcaacctggctcaaatatcagttttaattactacactctgtactttccaagatttgtaaacagtttgacaatgcatgccgatttaaaactatgaagaaacaaacacaatttttcacaacacctctcaaatctaatgggtcctcactgtcaagattaaattccaggctgatgacactgtaaggtcacatggccagctgtgctataggcctgccagagtcctagaccctcgagcgacgcagagaagcacacacccatcccaatcaggcaacctagctaggtcatcttagacaattccctgaacaggtta

SEQ ID NO: 689539 - DNA, 612 bp, Homo sapiens
  misc_feature (223)..(223): n is a, c, g, or t
  misc_feature (272)..(272): n is a, c, g, or t
  misc_feature (275)..(275): n is a, c, g, or t
  misc_feature (277)..(277): n is a, c, g, or t
  misc_feature (280)..(280): n is a, c, g, or t
  misc_feature (308)..(308): n is a, c, g, or t
  misc_feature (315)..(315): n is a, c, g, or t
  misc_feature (340)..(340): n is a, c, g, or t
  misc_feature (375)..(375): n is a, c, g, or t
  misc_feature (405)..(405): n is a, c, g, or t
  misc_feature (428)..(428): n is a, c, g, or t
  misc_feature (436)..(436): n is a, c, g, or t
  misc_feature (438)..(439): n is a, c, g, or t
  misc_feature (450)..(450): n is a, c, g, or t
  misc_feature (456)..(456): n is a, c, g, or t
  misc_feature (462)..(462): n is a, c, g, or t
  misc_feature (466)..(467): n is a, c, g, or t
  misc_feature (470)..(470): n is a, c, g, or t
  misc_feature (474)..(474): n is a, c, g, or t
  misc_feature (477)..(477): n is a, c, g, or t
  misc_feature (485)..(485): n is a, c, g, or t
  misc_feature (487)..(487): n is a, c, g, or t
  misc_feature (495)..(496): n is a, c, g, or t
  misc_feature (506)..(506): n is a, c, g, or t
  misc_feature (511)..(511): n is a, c, g, or t
  misc_feature (513)..(513): n is a, c, g, or t
  misc_feature (516)..(516): n is a, c, g, or t
  misc_feature (530)..(530): n is a, c, g, or t
  misc_feature (538)..(538): n is a, c, g, or t
atgcagcaggattgcaacacataagtgctgctggcttggcctcttctgtgccattaaggccttggagcctgactgccaactgggctgccagccaccctcctgcacaccctacaagctgcgacctgctttgccagctgttccaggtgaggccctgcctgcagcgggcacaggtaggaccgagaaggctgggtgacaagaggacccactcctgccaacagccccngagagcgggcagtgccggacaggatgtgcagacacaactacgagctggncgngnccntgaccctgcagcgccgagtccagcctanggtgaangtttccccctccaagaaggggcccntgcagcaccacaacctgcttgtctgccacgtgacngatttctacccaggcagcattcaatccganggttcctgatggacaggaggaancagtgggntnngtccaccaacntgatcngtatgnagannggncttncanatctggtnangcggaaannaccccccagnagganangtntaccctgccaatgnagcacacnagcctgaatagtccggtccccgtgaattgaaaggcccattttgattttgccaaaaaagccgggggtatcttata

SEQ ID NO: 689540 - DNA, 401 bp, Homo sapiens
tttatttccaccttagcagaggccaaccgacccctcttggcccttgccgagggggagtccgaacttgtctcaggtttcaacttcgaatacgcggcgggccccttcgccctttttttcatagcggaatacccaacctttattataataaacacctccccccctccatttttcttgggagcaacatatgaggccctttcccttgaactttacccaacattttttgtccccaagaccctacttttaccctcccggtttttatgaattggaacggcatacccccgattccgttagggccaattcatacccctcttatgaaaaaacttcctccccctccccctagcattacttatatgataggtttccatacccattacattttccggctttccccctcaacccta

SEQ ID NO: 689541 - DNA, 1236 bp, Homo sapiens
acaacagtgttacaggcggaccgtgttattcatcaggggtgccttcagtgttcatcacttgcctctgcgcactggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccac

SEQ ID NO: 689542 - DNA, 1844 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggcccccttggcccaagccattttaaacctgaaaaattttattcatggcccccaaatttgggccaaattggccaaatccccctaaaggggggcgattaaaaattaaagggcccggtttttaaaaacgtggaactggaaaaaccctggggttacccaaataaaacccctttgaaaaaaacccctttttcccaagtgggataaaaacaaaaaagcccccaccaaacgcctttccaaaaaatttcccaacctaaatggcaaaggaaaattgaccgttaaaattttggaaaaaatcccggaaaaatttttgaaaacaacctaatttttaaacacaaaggccaaaattggaaaaacccctttaatattaaaaaaaattccccgaaaaaggttaaagggtttccacagttggaacacaagagccctcttttaaaaaccgggccttcaccctaaaaagcgaacccttataaagggcaaggcccattcgggcctcccct

SEQ ID NO: 689543 - DNA, 171 bp, Homo sapiens
  misc_feature (29)..(29): n is a, c, g, or t
acgagattatctagccaatggtacctccnagcctgatacgagttgccaggacgcaggtcagggggacttggctgtcccccgtctttcaaataaagctgtttgtctaaaataaataaataaataaataaataaataaataaataaatttattttttaacttcctggtgaatt

SEQ ID NO: 689544 - DNA, 1842 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggcccccttggcccaagccattttaaacctgaaaaattttattcatggcccccaaatttgggccaaattggccaaatccccctaaaggggggcgattaaaaattaaagggcccggtttttaaaaacgtggaactggaaaaaccctggggttacccaaataaaacccctttgaaaaaaacccctttttcccaagtgggataaaaacaaaaaagcccccaccaaacgcctttccaaaaaatttcccaacctaaatggcaaaggaaaattgaccgttaaaattttggaaaaaatcccggaaaaatttttgaaaacaacctaatttttaaacacaaaggccaaaattggaaaaacccctttaatattaaaaaaaattccccgaaaaaggttaaagggtttccacagttggaacacaagagccctcttttaaaaaccgggccttcaccctaaaaagcgaacccttataaagggcaaggcccattcgggcctcccct

SEQ ID NO: 689545 - DNA, 1239 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgagtccatcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccac

SEQ ID NO: 689546 - DNA, 819 bp, Homo sapiens
ggcggagagttgtaagaggcgtagagccaggcgtgttaagagccggctcggaactgctccggagggcacgggctccgtagggcaccaatcggtgtggatcccctccccgcgtgcgtggggctcccatggcagcaggttcgcgttcgagagtgacctgcactcgctgcttcagttggatgcgcccatccccaatgcgaccctcctgcgtcgctgggcagcggcaagagccagaggtagagcctggaggcctcggaccccgtcaactccgatgacgggctcggcgaaccggatctccacgagcgccggtcgaggacatccggtgccgaagtccgtggtgaaatccagcttccaaggggttcaggagcatctccttagcaatacgctggtcgggtgagcggctatatcgctcgccattcggcagatgctgtcccatactggatggtggccagcattcgctccgtgagcaatggagaagcaagcctgagaaacagccagaggcccaccagagaaggaagcatcagaaagccgtgggctttggaacgctgaacgggctttcgatagtacgaggaagcccaggatccttcggctcaggtggaaaagaccactaaaatggcgccagaggggttatcagaagcagacttgaccagtacgtcttataggccaaaaagggcactcctggcatccagcgggaagagctggcgttacatttcctttccgctggccagaaccgtatcctgggattgcgccgtgagaatccgaaaatgacctattagcctgaagccttgtgggaattggaagttccatggggaattgtactgg

SEQ ID NO: 689547 - DNA, 960 bp, Homo sapiens
  misc_feature (44)..(44): n is a, c, g, or t
  misc_feature (86)..(86): n is a, c, g, or t
  misc_feature (152)..(152): n is a, c, g, or t
  misc_feature (160)..(161): n is a, c, g, or t
  misc_feature (163)..(163): n is a, c, g, or t
  misc_feature (197)..(197): n is a, c, g, or t
  misc_feature (210)..(210): n is a, c, g, or t
  misc_feature (229)..(230): n is a, c, g, or t
  misc_feature (232)..(232): n is a, c, g, or t
  misc_feature (237)..(237): n is a, c, g, or t
  misc_feature (248)..(249): n is a, c, g, or t
  misc_feature (253)..(255): n is a, c, g, or t
  misc_feature (278)..(278): n is a, c, g, or t
  misc_feature (298)..(298): n is a, c, g, or t
  misc_feature (311)..(311): n is a, c, g, or t
  misc_feature (323)..(323): n is a, c, g, or t
  misc_feature (327)..(327): n is a, c, g, or t
  misc_feature (342)..(342): n is a, c, g, or t
  misc_feature (345)..(345): n is a, c, g, or t
  misc_feature (353)..(353): n is a, c, g, or t
  misc_feature (361)..(361): n is a, c, g, or t
  misc_feature (370)..(370): n is a, c, g, or t
  misc_feature (398)..(398): n is a, c, g, or t
  misc_feature (400)..(400): n is a, c, g, or t
  misc_feature (402)..(402): n is a, c, g, or t
  misc_feature (408)..(408): n is a, c, g, or t
  misc_feature (417)..(417): n is a, c, g, or t
  misc_feature (424)..(424): n is a, c, g, or t
  misc_feature (431)..(431): n is a, c, g, or t
  misc_feature (437)..(437): n is a, c, g, or t
  misc_feature (444)..(444): n is a, c, g, or t
  misc_feature (447)..(447): n is a, c, g, or t
  misc_feature (463)..(463): n is a, c, g, or t
  misc_feature (858)..(858): n is a, c, g, or t
  misc_feature (883)..(883): n is a, c, g, or t
  misc_feature (903)..(903): n is a, c, g, or t
gaaaaacataataaattcattgtatagataaaaatgacatgtanactattccaatatctgtttcctgttgaagaaaccatcaaganaaaatcttttcttggttcttcatcattaacacaacccccaaaataaaatacgattttaaaaaaatnaataaaanngnatatatatatacatacacatacacacataattanaaaatttcctganttaacaaagacatgctctnngnaagcngtagacctttnncccnnntctggtagcctttccttcttttnttttctgcagttcttaaacngcctgtttgtttnttttggtatggntganttgttttgtttcttntcntggatgtnttcttgtntacacaacngggggggggggggcggggagggggtgcncngnggggcnaagggcagngcgttgnacataancggggngcattantcnttgggtgggatgtgcntttgggggggggagcctggtaagatacactcaaaacctttattcattgatttacaaactgtacaatatttacaaagtttaggcattaatcccatattgacatgaatgctgtggagagtctaaaaataaatatgtggcacatagcttaatatacacatcatggctctttacacttaagccattaccaatagtgagatgtaatggagaatttaatgtggtagaaaagtcagagtggctgaccagtcccggaccttccatgtgaatgactcttccttggctccttgaggctggggatagtgagcaaataactttctttcaagagaattaaacactgccattctgacaggcacatgggacgcatgcagcaacatctatgcagagtctgcaagcactctntgggtggtggttgaatctgcaccanctgtggacctgatccctgtncaccagccagggaggctttggtgtgggcacttttcttgtttcttattcaatcacatg

SEQ ID NO: 689548 - DNA, 677 bp, Homo sapiens
gatggacacaaaggcaagtgtaaatgaaccgtatatatcagcacagcttccgcatggtccagcgtccttgatgacaatgcccgaaaatacggcacgggctaaaaagtgtggaaatgaattccacactacgagctttgtttatccttagggggtacatgcaggtgctcgaagaaaaacttaatgtcgtgctcttaatgcttccatttaagagaatgttcggagatattcaaggcttcttctggttctgggaccaaactcagtgacagtgtaatcgacaacatcatcaagcagaagaatctgaattagtgtcgctgggtctactgatccgcaggattacaattatcacagatgagcaccgattggccctccaccacgaagctacggggaggccaggcttaaccaaagggtatgctgatttctttctggtcaggggtcgtaaaggtagagacactgaggggatccgaagtaagttagtgaagaaattggaagcgaaaatcgctaatgtgcttacgcttaaggatagcgtagtagggtgacataatcacttggctgtaggataatcgccatgtagaagtcacgacgaggaaacaagatacagttcctaccttttgactgagaaaggccttggtggaaagccttagaaagggagaaggtttgagggagaagtaagaccaatt

SEQ ID NO: 689549 - DNA, 844 bp, Homo sapiens
tggaaacaggggtctggctggttgttcgcccaggttgggatgtgcagtgggcctgggtcattgggcttcaagggctcactggaagcttgggacctctgggttcaaggtgatcctctggtgtcagtcccctgagaaatcccccaggcccagtacatattttgggtgggataccaggggtctcatttggttggcctagcgttgtctggagaactccggggctcaagggagatctggtaagcctaagcctcctaaaggggcggggagataatagggcatggatgtcatgtggtacccgggcctgggtcaaccgggttataaagggaccgcttatggatcactttgggcgcctacccagatgaacccagggtgcgtacttaccaatttcacagggtcacgctggatttagccaccttaagtccacattctgcgcaatcttaatgtcacacatggggctggttgtacaccctaatcgatatgtcaccagggctctggggagacttggtaaacgtgtgggacaatcttggagaaaggcccggaatttctggcgcaacaggaacccactccggggtacattcccctgtggtacccttggtccgtggggcgcaaccatttgagggttgtataagccccgcggaagaaaaatacgtcgtttgacgatctgcgtatataccagtgggtaccggggacattggttgtggtctccccccgccaataaaaggggggtactgtggagtacaatcacctgtgatgagcccgtggaaaacgttagtccattttacttagacgccttggatgagaggtggggcgacccacttctgcggcaacaccaggggcattgtagata

SEQ ID NO: 689550 - DNA, 509 bp, Homo sapiens
agttcgacggagactctctcttcttgattagtatcgcaagaggtttccacattttattagtcttctttaagaacttttattttgttgatccttccgagtatttctttgcttggcacttcccatcctctgctaactctacaggcttactctatgttctacttctaacctcttgtggatctgtttagttattaattttaacatcttgtgttgcattgtgatttcttctaaacctattaattaatttgaagttgctttttgggtgttttgttgattttagtttcccagctaaactagaaggggtgataaatatctttctgttgttttgtagttttattgcatttttattagaaaacagagtattcaaggtcaggagatcgagaccaccctggctaacagggtgaaaccccatctctgctaaaaatacaaaagattagccaggcgtggtggcacgcacctgtagtcccagctactcgggaggctgaggcaggagaatggtgggaacctgggag

SEQ ID NO: 689551 - DNA, 869 bp, Homo sapiens
agacagatgaggcgacgggatgccggaggggggatgagaatgttctgggcgtcctctgcaaatctacgaatgcaaatataaatagatttgtagaagtgataagagttcactatatacatcatatttaagaactcgaaagaagtctcagtggcagtctatttgtcaaaatcaatatccatattcttgttaatatacggtgagatattgcgcaatatagatctggattttgacaccatttattgaagcggcatcaccaggctgtgcggaggtgttggcattcttcgctgatttggctgtgcccaactgttaacattatttaatcatgcaatcacatggttctgtgcatcttggatgtgaaatgctgtccagttttaatccacacatgtgtgatccttgggtgtatgaccacgatgcagaacgtgatctctggagatatctgctaattttggtcatctatgcagagtgactccggaaatgtgttctaaaacaagaagagaacttactaaggaagtgatacatagaccagcgtttatcgcaacatgagttgtaaagctggtgtactttgttgctgtggctatctgcctggttaatgcaaatgtaccactttttagtgtcagcccgtatacataaacatctagagacaaaaggatggaatgaccgagcaaagggggaacacgtggtgcgtgtcttacatccccttgaagaggtgtgtgacgccttaatttttaaactgggcggagccttagggcgcaaaggtcgccaagggaaattgtgagcaaggtaaattccgggcggggccacagagggggggcggaataggacagacagggtgggtgaacggaaaccgggagggagcccccaatttgacg

SEQ ID NO: 689552 - DNA, 116 bp, Homo sapiens
gtactcgggacagtgaagatgacgagtatcagaggctgtgaggcaggaagaaactgtgctggaagggacaatggatcaagatgaggagtcccacccagtataggaggctgagtgag

SEQ ID NO: 689553 - DNA, 222 bp, Homo sapiens
  misc_feature (41)..(41): n is a, c, g, or t
  misc_feature (47)..(47): n is a, c, g, or t
  misc_feature (122)..(122): n is a, c, g, or t
  misc_feature (141)..(141): n is a, c, g, or t
  misc_feature (164)..(164): n is a, c, g, or t
  misc_feature (192)..(192): n is a, c, g, or t
  misc_feature (214)..(214): n is a, c, g, or t
ctgtgcctcctgccccacgcagctgtgagggagcccagggnaatggngccttagacccgggcagctgtgttggaatgaggtaattctgttccgaaggaaaaaaggcaaatgaagtcatgggnacacacagagttagcaagngtccattgaacccggcaggcaantgtgtctgtggtgacccatctctcctanatggtgccacaaacatctctcnggacgact

SEQ ID NO: 689554 - DNA, 187 bp, Homo sapiens
caatcctatgagccattacaaaatggaagtgcaattaaacatcgctttcgtttcttagggacaaaacctgactaagcaaaaatgttatttgacttatcactctggactcctccatcctgcatgtagactgcctagatttacaaaaccaaattatgagaaatcagcaatgctgcccatccttttaact

SEQ ID NO: 689555 - DNA, 1111 bp, Homo sapiens
tgctggagatggagtgagggaggccgggacaaggctgcctggtgcagccccagcagtctccagctggctgtgcccccggctggcactggactgagaagcctgagcggcaacggagctgtgctggtgatgcctggggacaaggacaaagaacaggagctgtctgaagagtgataaacatgcttcaagatgaacttggacgatgctcgatggaacgactaggggacgaagtgatacatccctgtatcagaccagcagcatggagcgacatttgcgaatggcagattcgtatcttctacaacttccatgacttcagtgcccaagcctctcaaatttctcgcgtccacactatggcaaaactgaaggaaatctatgagaacatggcccctggggagaataagcgttttgctgctgacatcatctccgattaatggacatgaccatgagtggggagcgtgagtgcctcaaagtatcggctacgtgggctcccaggaggaatcggcatcatggggtcatgagctatgtcaggcactctggcaggagaagtggctaaggagtggaggacaggatgaacagagacaggtccaacagtagagccatcgtgaacagacatgatgaaatgaaaagagaaacatatcagatagagccaaaagaagaagaatgaccgattgagacatagaatatcggaaaatgacaaagagaacatgacatgagaaagcacattgctaaaaaataatatacacaaaatcataactaaaatcacaaaaaaaaataaatacaacacactaaacaagaaaacactcctataacaacaaaaataaacgataaaaaaatcataaccataacgatcacaacgaccgcaatagcatacgaacctccagccaacagaggaacaagacaaagggaggacggagacaggagagatgcggcaaagagagaagagagaccacaggagagcagaaaggaaggacacgagatagggcagaaaagcgcgcacaagcagaaacgaacagagtgccacgcagcgaaggaaagaaaagaacgtagctggacagctagaggaagcagagcgcaggagcgacaccacgaaagaaagccgtagagcagcacgaag

SEQ ID NO: 689556 - DNA, 96 bp, Homo sapiens
caaattttgttaagatcccatttaatatttgaaaaaaatcagtagcccaaatatattttgattgtcccttccaaaataaaatacatttccagtcta

SEQ ID NO: 689557 - DNA, 239 bp, Homo sapiens
  misc_feature (13)..(13): n is a, c, g, or t
  misc_feature (19)..(19): n is a, c, g, or t
aaagaaaaaaaanaaaaanaaaaaaaaaagaataaaaaatgaaaaaggttgatgtctgatgccctgtttctttgcaacatgacctgaagacgactgaaacaacgtgttctttgcctgaaatatccaccttgacttacagttttattaatgctggtgtgatcagactggacaaaaattagcatatgttattaactgatctaatttaagtgccaattcttaatagaaacactaaacaataa

SEQ ID NO: 689558 - DNA, 120 bp, Homo sapiens
atcccgtctgatacgggaagcaggatacttgggtgaggggtgggcacaaagaatggccacggagtgatgaaaggtcatttggatctgatgctatcttctttccccttcccccgtagtcat

SEQ ID NO: 689559 - DNA, 122 bp, Homo sapiens
  misc_feature (6)..(6): n is a, c, g, or t
  misc_feature (13)..(13): n is a, c, g, or t
  misc_feature (19)..(19): n is a, c, g, or t
tccacncccaaantttttnccgctccaacacttcactattttgttttgcttttcttattaatatagagacaggaatgtcaggtcctgagcccaagctaagccatcatatcccttgtgcctgc

SEQ ID NO: 689560 - DNA, 424 bp, Homo sapiens
  misc_feature (9)..(9): n is a, c, g, or t
  misc_feature (354)..(354): n is a, c, g, or t
tgtaccccnggcccatggttgcctaaaaactagctgtacccaggtcgcctcaccctttcaggtcctgccctgcccttggcccctgagtccatggacaggagtgttatgttgtcttttctccttataaaatgtaaataatggctgggcaacggttgtcacgccctataatcccagcactttgggaggcccaaggtgggtggatcacaaggtcaggagatcaagaccatccctggctaacacggcgaaaccccatctctactaaaaatacaaaaaattagccaggcgtggttgcatgcgcctatattcccagctacttgggaggctgaggcagaagaattgcttgaacctgggagncggaagttgcagtgagccgagattgcgccactgcactccagcctaggcgacagagcgagactctgtctca

SEQ ID NO: 689561 - DNA, 689 bp, Homo sapiens
atttttttttcaaaccaaaagaaacaactttgttcttccgccaagttcccatttaatgggacccattttacacacccccaggtaaaggttctctttccttttaaaacccgtttctcttaaaaaaattcgccaacatcgttttaacctccaatttttctcaaccatccccttgaaaatttcctaaggtttttctcataattagggcaccaccttccctgttcatctttgaagaatccattccgcacaagaatttaaaagaagtgattttaagatttggttggggacctatagtaacgcttatgcagcaaaccaaaacccaattgtcttgaaaattatatgcccacatgtttagtagcaaagtctcccaaacactcttgctttcacttaagtgtctggcccgcaacactgtagcatcaagcatgatcttgttgccgcaatatttaaaatatccacagtactcgctttttccgtatgatcatagtaattgcctagaaatatctttctcctacctgttattcatcaatttttcccagtctttttatacggaaaaaattgcattaaaaacacttagtagccaggttataagaggaatctgggacaactatggtgggcgattatttttcacactgtacgtgccaaacctttatgactgtggaaagactgctgttttaagaaagatttaccttcca

SEQ ID NO: 689562 - DNA, 367 bp, Homo sapiens
  misc_feature (321)..(321): n is a, c, g, or t
  misc_feature (332)..(332): n is a, c, g, or t
aattcggaacgaggatatcaggccaggagtttgagaccatcctggacaacataatgagaaaagaaaatacaaaaattaaggggtgtggtgacacatgcctgtagtctcggctgtttgggaggctgaggcgggaggattgcttgagcctgagaggttgaggctacagtgagccatgtttacgccattgcagtccagcctgggcgacagagccagactgtctgaggaagaaattgtatatcaggctgggcacagtggctcatacccgtagtcccagcactttgggaggcccaggctgggtattcacttgagcccagggagttngagaccagccnggcaacaaagtgagaccctctctctacaaaaaata

SEQ ID NO: 689563 - DNA, 330 bp, Homo sapiens
cgagaaaaactgctaccgccagtctcgatacctggaaaccatttccatagagcatacagttattgccagcaaaaacgggtgaaactgtatgatgtcttccgttctccatgaattcaggcgtctcagttcgatgctcctgccacgttctagggtcacgcctatatacggaaggtacatcggaaagcccaggctatatcatccttgggcatgacttgcttcttcccacgggtccacatcatgcatgcgctcacaggtacaatagcagtctcgcggaacacaggttactcattgagatatagctgtacaacactatgacagagtgggcttccg

SEQ ID NO: 689564 - DNA, 824 bp, Homo sapiens
  misc_feature (38)..(38): n is a, c, g, or t
  misc_feature (49)..(49): n is a, c, g, or t
  misc_feature (221)..(221): n is a, c, g, or t
  misc_feature (374)..(374): n is a, c, g, or t
  misc_feature (421)..(421): n is a, c, g, or t
  misc_feature (479)..(479): n is a, c, g, or t
  misc_feature (488)..(488): n is a, c, g, or t
  misc_feature (502)..(502): n is a, c, g, or t
  misc_feature (506)..(506): n is a, c, g, or t
  misc_feature (510)..(510): n is a, c, g, or t
  misc_feature (512)..(512): n is a, c, g, or t
  misc_feature (514)..(514): n is a, c, g, or t
  misc_feature (517)..(517): n is a, c, g, or t
  misc_feature (588)..(588): n is a, c, g, or t
  misc_feature (605)..(605): n is a, c, g, or t
  misc_feature (632)..(632): n is a, c, g, or t
  misc_feature (637)..(637): n is a, c, g, or t
  misc_feature (752)..(752): n is a, c, g, or t
  misc_feature (768)..(768): n is a, c, g, or t
ggaagtgacgcgaggcgtagcggaagttactgcagcgnggtgtgtgctntggggaagggagaaggattgtaaaccccggagcgaggttctgcttacccgaggccgctgctgtgcggagacccccgggtgaagccaccgtcatcatgtctgaccaggaggcaaaaccttcaacctgaggactttgggggataagaaggaaggtgaatatattaaaactcaanagtcattggacaggataggcagtgagattcacttcaaagtgaaaatgacaacacatctcaagaaactcaaagaatcatactgtcaaagacagggtgttccaatgaattcacctcagggttttctctttgaggggtcagagaattgctgataantcatactccaaaagaactgggaatggaggaagaacgatgtgattgancgtttatcaggaacgaaacggggggtcattcaacagtttagatattgctttggatgtnttttctgtntccctcaagtcctnttgnttantntntgnagaaaatagttcttttgtgaatgtggtgttcaaaacggaattgaaaactgggaccccatctcgtttgaaanaatctggtaatttgaanttctagtgctcattattcattatggtnggtgntcattgtgctgatttgtggtgatcaagcctcagtccccttcatattaccctctcctttttaaaaattacgtgtgcacagagaggtcagctttttcacggacattgcatttcaggnttgtggtgatacatangatcgaccaatgaagtgctcataatgacttccactgcgccctgatgtctagcatgt

SEQ ID NO: 689565 - DNA, 170 bp, Homo sapiens
  misc_feature (153)..(153): n is a, c, g, or t
aatgtatttcattctggagctccatttgtttttgtcatagtgtcactcttgggtgctgatctcgagtgttattttctgattgtggtgttgagagttgcactcccagaaaccttttaagagatacatttatagcccttaggtgttggtatgacnccaaagcttcctctgtg

SEQ ID NO: 689566 - DNA, 447 bp, Homo sapiens
cgtttccctgttggtctgatcaaaggaagaatgaatcgtgttgtgctgtattggggaggaaataggagggaagtcaccaaaacccacccgattatcatgtatgttaaggaactttaagaaaggttattcggggactatggaattaagttgacccccagaggctgagaactctctgtgaaatacaatggccctcttttgatgttagatggccagctgaaggaaatgtagataaggaaacaattggctatgtatttaaggtggtaactggggtcagaggacagtcaggtcacctagaccagttcccttgtattgactcatggttaaatatagtacagactccacctgcatggttgcagacttgcctggcagctttttgctcaagctgagcctaagccaccaaaagaaaaaaatcagctttgctggaagctacagagaccaagggaaaca

SEQ ID NO: 689567 - DNA, 259 bp, Homo sapiens
  misc_feature (245)..(245): n is a, c, g, or t
ctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatgggcagctcctaggatttnagcggtctttgggg

SEQ ID NO: 689568 - DNA, 1200 bp, Homo sapiens
accttagccaataccatatacgccaaataaagtataggcgatagaccttgaaccctggcgcaatagatctagtaccgcaaggtgacagatgagaaacattcagtaagccaagcagtaatatagcaaggactaacccctataccttctgcctaagtgaacttcactagaaataactcggcaaggagagccaaagctaagacccccgaaaccagacgagctacctaagaacagctaaacagagcacacccgtctatgtagcaaacatagcgggcagacccatcaggtcagaggcgcacaacacctaccgagcctggtgcataactcggctagctccaagcatagaatcttagtacaacataccaacatatgcccacagaacccatccaaatccccttgacaacatacacacctgtcagatccaagagaggcaacagactcatcaggacccctacggcaaaccacaccctcgctacgaccagcgtaccgacactcagacacacccaatagtaggcacatagaacgcacggcacaccactcacacgaaaacgcgtacaaacgcacacaacgagcccaccaaccgcgtacaacagaacagagccagagacatactaccactgaacacaccatcaaaaccccaacagggacacaaagcctactcaaccctaccagacacgaacagtacgaaggtcagcacaccacgctaacgcaggacaacccgacgccccgcccccgccacccacaccacgtgacgcccaaaagaaacaacaacaaggggacgcaggacaaaccgaacgacgccccaaactaccacactcacacactaacacagagcaacacacagtacatacgccaccccagccgtgcccaaaacaaccgaacacacaaagcacatcgtgctccaaaacagacccaacggggcaacagacaacaccacaaccacaccgacaacgagaacacaacgaacatcgcgacgacacacaagcaggcagcacaagacgacccaacacacgaagcgcacgagcaccaaggagagagcacatcaaaaacacaatacagaagagacgacaaaccaacacagcgcaaaacaaccagaacgaccccaatagacaacgcaagcgagacaaccgaacacaacaaggcagaaaacacacagacaccggacagcatgagcgacagcagagagacgacaacaagtccgaa

SEQ ID NO: 689569 - DNA, 566 bp, Homo sapiens
  misc_feature (2)..(2): n is a, c, g, or t
  misc_feature (6)..(6): n is a, c, g, or t
gnaagnagggatgcttactgaagttttcaggtgacttggatgaccagacctgtagagaagatttacacttccttttctcaaatcatggtgaaataaaatgggtcgactttgccagaggagcacattagggaataattctcttcaaagaaaaggctaaggaagcacttgagaaagccagaaatgcaaataatggtaacctactgttaaggaacaaaaaggtgacttggaaagtactagaaggacatgcggaaaaagaagcattgaaaaaaatcacagatgatcagcaagaatccctaaacaaatggaagtcaaaaggagggcatgcaggtggaagatttaaaggaagccatgtttttacagcagcccgcagatttaaaggaaaagggaagggtaataggcctggttatgctggggcacccaaaggaagaggacagtttcatggaaggaggacaagatttgatgatgatgatcgtcgtcgtggaccaatgaaaagaggaagagatggaagagacagagaagaacccgcatcaaagcatatgaaaagagaaaatggtgcttgagacaag

SEQ ID NO: 689570 - DNA, 903 bp, Homo sapiens
gggactgagctgaaggactgggatctcaagcctcacgtccctgcagccatcccgccgtctctgtgtcctcccctggggcccaaaacactccatcctaccattctaggctcgctgagcgtcaaggccaatggagcatcagcgcgctcgcgcatccgaccggaacgcaaacgagctgattcccaggagacgtctcctgctctcaacttatgccaatctactccgaacgcactttgacgcagcggagcaaacggtgacctgttgggtcgcggcctcctctggcggagattacacaaaaaaagaggtgaaactgcgcggaccgtgcgctgacgagatcgctaggcttcgcctccaaaccttttgctgttagacaggcggaccccgggcccccgagaccacatcgcatcataccgcatacgaaaggcaccaactgcggcatcgcgatgagggcctaaggtaccccataggcacagaggaagacgatagtggagaccgcgacgcaaagcaggacagagcagagaagggccgtgaagtgaccagaccagggcaaggccaacgcgcaacgagctaaccaaagatcaacgcccggcccacgaacagcggccacgggacagcgaagccacgcgcaccgcccaggagctacggccagggcacgacacacggccagcgcccaagacacgcggccacccactagttgccatgggacccacagagggcagcaacaaggacaaaacgccctatcgcaaaggcgaagacaacgagaaaaacccaacattaacacaggcaacacaagacagtggggaaccctccacacagtatgggcacaccacaaggacaagttacataccacaccgggaagaccccacgagggcaacaacgagctgcacacacaacacccactaacac

SEQ ID NO: 689571 - DNA, 392 bp, Homo sapiens
caggcgacccgcatgccaccgggtccactttccccgtttaattagtacagttcacccatgataatcatataaaactaaacattgtgccaaagtcttagtgatgtgtcttggggttgtgcacagtacccggtgactctatggggatattgtatttatattccctgagcctatatcgttcatctgtgaaatggggataaaaagtaacttgcttgcgtgtcacaaattagttaccatcttctccagctagcaaaattactaccagagccgttactacacacaaaggctattgaccgagcacataccatgtgtcacacaccttgacaaaatcttttaatacagtttattatgtactattcaatctttacacaatgtcacgggcgcagtctgtgagg

SEQ ID NO: 689572 - DNA, 157 bp, Homo sapiens
tggagtaatgtaggaaaatgtaattaagataatgatgaacaggacatgtatagcctagtgtctcatgaggctcataggaagggagaaattgacactcgtgaaggaaggtgtgtatgagaattcaaaagacttttctgtattgtgcccctgagtttta

SEQ ID NO: 689573 - DNA, 197 bp, Homo sapiens
  misc_feature (98)..(98): n is a, c, g, or t
  misc_feature (114)..(114): n is a, c, g, or t
  misc_feature (148)..(148): n is a, c, g, or t
  misc_feature (183)..(184): n is a, c, g, or t
gagacttaagtaaaacggctgcaggccagattcgcccaccagctcagagaccacctttatccatgctttgaagtaggactccttccgtcttcaaaatnttgaagaccctaacangcttttatgatgggggtcatatctatggtcacgnatatagtagaaaccaaaagaatgtaagtatttgtnnatgatttaaaaat

SEQ ID NO: 689574 - DNA, 493 bp, Homo sapiens
  misc_feature (492)..(492): n is a, c, g, or t
agattaatacacactctacaagtacacaccactctcaatgtacacaccactctacaatgaacacaccactctacacacaatgtacacaccactctcaatgtacataccacttacaatgcaacacaccacactacacacaatgtacacaccactctgcaaacaatgtacacaccactctacaatgaacacaccactctacacgcagggtacacaccactctacaatgaacacaccactctacacaccatgtacatgccactctacaatttacccaccactctacacacaatgtatacaccactctacaatgaacaccccactctacacaccactctacaatgtacacaccatgctgcaatgaacacaccactctacactgaacacaccactctacacacaatgtacacaccactctacaatgtacacaccactctctacacaatgtacacaccactctacaatgtacacaccactctacgctggaatggaatng

SEQ ID NO: 689575 - DNA, 424 bp, Homo sapiens
tctagaggatcccgtgatgttatcgcccaacactacatgaaaacttttacatttcatatggccaaatttgttaatattttcttcttactttttggtttcctgtatagtgtagaaggtctctcccacccccaacttttagtctgctagagttttctttaggattaatattattaccttttatagagtatggaattcatagttagaactggagctgaacctttgaaggagggaaaggaaacaaacactgacaaagcaaggtggtagatcttgacaactgatttgatgtggagtgggcacgtcaaaaggtgtcagtatgaggtaaaaaatatattactgagcttgtcaggagtatgtgtagaattttaggggaagtctaagttgtaaaaaaagggcttattaaagtatctgtgttggggataacata

SEQ ID NO: 689576 - DNA, 150 bp, Homo sapiens
tattcactctcattaatgactcccctcatgattgtgcttgtgctctctgtcacatatatcggttatctgtctctctctctgtggtatcgtgtgtatatatagggcactgatatgatcgtctacgtgtccttggtattcgcgcctctcatg

SEQ ID NO: 689577 - DNA, 1039 bp, Homo sapiens
  misc_feature (384)..(384): n is a, c, g, or t
ggaagcctccaaggtaacccggctatgggactgcagtgcccaaggaatttctgctctggttagaaaaaggactctgcttcagtccacttctgctctggttagaaaaaggactctgcttcagtccacagtacataaaatgtactcagctatcagctctataagagctggatgcacatcaggagtgtgcccctctgtaacaactctagtcagcacaggccatggtgcacaaaagggacttggaaaatgatggaatgaccagcctgtccaacagaggggcagccaggacatctctgccctcttctcatcccccagccacagtggccaaagaggcccccactaggcactgtggctctgcatgacaaacacacatccagcccaggactntaagcctctcacctggactccagtaaaaaccttgctgagcctccttgtctatccttcctcccccacccaccattgtaaagtttatgtcaccagaatatttctttcatgtctaattgcttaagaacttggttgttcatcaattaaatctagatgttcaaaatggaaaaaaaaaaaaaaaaaaaaaaaagaaagaagaacaaccaagaaaacacaacaaaaaacaaaaaacacaaagagggggggggcgcgataagaaagtacaccgggggagaccaataatgcgtaccaccggttttgtgtgcaaaaaggggaccccaaaaggatggagcactgtataaaacagagagacagaggacacaggaaaaaaaaacaagagagagagagaggaaccacacaccacacaagacaacaatacagggaagagggagccaccaacagcgcggggggggaagaacaaacatgcggaggccacaaccccgagacaagaagaatataaaagccgccgcaggaggaaaactaacaaaaagcaagagcaacgggtacaaatagaggggtgtacgaaccacaaacagcgcgacatactaggagcgacaggagaaaaaatctagctgctactacgagagacaatgatcaagcaagaagacaattataaccg

SEQ ID NO: 689578 - DNA, 226 bp, Homo sapiens
acccactccaccttactaccagacaaccttaggcaaaccattttacccaaaataaagtatagggcgatagaaattgagacctgggcgcaatagatatagtaccgcaagggaaagatgaaaattataaccaagcataatatagcaggactaacccctataccttctgcataatgagttaactagaataactttgcaggagagcaagtaagaccccgaacagagagca

SEQ ID NO: 689579 - DNA, 341 bp, Homo sapiens
gcatataccaaaaaaggacaaacagatagaagagtcatctcagtgtgtaacgaggaaaagatttatctcccatcctctgatcctccatatgatatctgatagcgaagatgacaataaccccttgactcttcacgaaaactcgatgagagagaaacttgaaaagtcagaaaataagttcataccgcaattaaccttttggtcaagtaatggaaacttttgactactagtgtaagtcaaaagacaaaggactccagcaagatgagagatttctctattttgtaacgagtagtccaccgatcgtcatcaaagagagagaatgaacaactacgaaagtttaaggg

SEQ ID NO: 689580 - DNA, 131 bp, Homo sapiens
  misc_feature (69)..(69): n is a, c, g, or t
cgacgaaggtggaactgcgtatcctatggcagcggcagacaagagcccgacgtgaggaggagcccgcgnaggactgtctcacccccaccgggacatcacgctctgttctggcacccaggcaccccatgtcg

SEQ ID NO: 689581 - DNA, 115 bp, Homo sapiens
cgtacagatgatgcgagaaccattcaaatatagtcaagaatcttaatatcaaccaatatatcaagcaagctggaaggcagaaataactaaccaataatttagtataagtacccaa

SEQ ID NO: 689582 - DNA, 106 bp, Homo sapiens
tcacctccctgcccagctctcccttccaccagcagacagagaacacttagtcttgcctgtcaaaaagtccaacatttcataggtagtatgggccacatattacatt

SEQ ID NO: 689583 - DNA, 164 bp, Homo sapiens
ccccccccccccttttttgggggggggggttttttttttaaaaattttttttttgggggggggggaaatgggggggacccccttttttggcccccccgggccaaaagggccccctttttttttttttttttggttttgggcctttttcccttttttttttttta

SEQ ID NO: 689584 - DNA, 209 bp, Homo sapiens
ccaagatagcgccactgcagtcgggcctgggcgaaagagcgacactcagcctccaagcagctgagacacagattgcacaccacgccctgataatttttgtggagggtttgttttttgtttttttgtagagacagggtcttcccatgttgcccaggctggtctcgaactcctgagctcaaatgatccacttcagcctcctgagtagctgg

SEQ ID NO: 689585 - DNA, 385 bp, Homo sapiens
tagaattgctcagttgagtgaaatcattctttggaaatccatgcgcagacccttctgtgccactgcatttgctactgaaatcaacccgtgataaagctcaggattgagagttaacctgggtccaagacatggtaccacttccttaatagctgtgtgaccttggcccagttatataatctctctgagccttaattatcttacctgtaacagggggatgataatgacttgacagtgttgctgaaagtgttaagaggacaaatgtggggtatagggtatttgtttggtgtttggtacacggttaagcacaattctaagaccaatttcttattaaactctaaagtattaggaaacgttgtactagcaaaattagggtaggtcgagaaag

SEQ ID NO: 689586 - DNA, 156 bp, Homo sapiens
tgcagtatcaggcgaagtgctatataatgtgtgctggatatgttacaggatattagaacagcttattagcgaacaaaggcagagaaaggctcgagggtcatgctctcccatctatagtgtgaagactctctgccttacctaatttcacgagccagg

SEQ ID NO: 689587 - DNA, 927 bp, Homo sapiens
  misc_feature (194)..(194): n is a, c, g, or t
gcgaaaacacacaaaaaagaagcgcaacgagcagaacacacagttattatatatcgtgacgtagtgtctatcctcctgatttcgcccccctgtgattctgcgcaaagttgttgacgacggacatttgtttatccccggcgtcgctcactgttccttggcttttcttagagcgcctttgcaatttggccgcaccnacatcttgtgcaatggcccaccttctcctccggccctttggggccagttcccttctgtgtcggcaatatttccccctttctgcagcctcccaagggtgttcaaccgcccccctccccgaaattttttcccgccaactgttaaaaaataattcttcaaccttcgcgcccaaagttatattctccttcaaacacttgggccacaaaagtaactcgcccccttctcccttcctttcaactgcccacccgacctctacatgggattggtaacaaccccacaccccactcccaccacctgggtacctccatttccacgacccctgtttccgaaaatagttctcattctcgtcaggacagagtcttctccactatattaacaatcgcactgcaaaagtttttgccctccaaacacgattaaccacaaaatttaaataagtagccttaataacagtcccatttttagggtggaaatacccccacattctcaaccacacgcaaaacccaatggtcctccttccaagatggcaaatcccaccgttttccaaacacgcctgccgcgtccgacttcacgagttcatccgaattcacgcacttatttctcgctcggtcaaaacctctcctttctaaattttcccctgtaatataggagcttcttgataatttctactcctcgatgcaaaccttttgccctggccaaaaccccgcagaaaacccattaaactgttccaaaatgaca

SEQ ID NO: 689588 - DNA, 114 bp, Homo sapiens
ggcttacttgaggagcatgtgggcttgcatggtgacttcctgaaacctgtggccacgggaatgcctggtctccttcctcagccctaggaatgttctaagatcctcagcctcttt

SEQ ID NO: 689589 - DNA, 424 bp, Homo sapiens
gcgctcggcttgatggagtttcgccatgttggccaggttggactcgaactcgaactcagtggttccgaacaacttggcctcccaaagcgctgggattacaggcatgaaccaccgcaccccagcccagcatttgtcccttggtggactgctttatttcacttagcataacgtcctcaaggttcatctatgttgcagcaggtgtcagaattcccttccttttaaaggctgaataacattgtggtatacaccccattttgtttatccgttcatctgttggtgtgtattcaggctgtttctgccttcgggctgttgtgaagaatgccgctatcaacatgggtgtgagaatatctgttcaagtccctggctatatttttcttttggatatttagccagaagtggaattactggatcatctggtttcttt

SEQ ID NO: 689590 - DNA, 370 bp, Homo sapiens
gatgactccgtacatcgaaggcggagacgttgtagagccgctgggtgagcgtgtactgggtcgtgtaatcgcccgtgacgtattcaagccaggtaccgaagatgtcatcgttccagccggtacgctggtcgacgagcagtgggtcgaattcatcgagctgaacagcatcgacgaagttatcgtacgctcgccgatcaactgcgaaacccgctacggcatctgcgccaagtgctatggtcgtgacctggcgcgtggtcaccatgtgaacatcggagagctgtccgccgtatcgctgcgcagcgatcggtgagccggtacccagctgccatgctacgttccaataggtgggttgcagcggacttggagggga

SEQ ID NO: 689591 - DNA, 288 bp, Homo sapiens
  misc_feature (39)..(40): n is a, c, g, or t
  misc_feature (58)..(58): n is a, c, g, or t
  misc_feature (69)..(69): n is a, c, g, or t
  misc_feature (154)..(154): n is a, c, g, or t
  misc_feature (191)..(191): n is a, c, g, or t
  misc_feature (242)..(242): n is a, c, g, or t
agacgatccttactcccaagtagctgagatacaggtgcnnccagcacgccggcctttngtattttgggnagagacggggtttcaccatgtaagccaggatggtctcgatctcctgacctcatgatccacccgcctcggcctcccaaagtgcagngattacaggcatgagccaccgtgcccagccaagtgcntaattttaaaagaaaaataatttatgtggctcacagttggacagactatangaagtgtgtgctagcatctgcttctggtgagggcctcaggaaactt

SEQ ID NO: 689592 - DNA, 482 bp, Homo sapiens
  misc_feature (1)..(1): n is a, c, g, or t
  misc_feature (95)..(95): n is a, c, g, or t
  misc_feature (388)..(388): n is a, c, g, or t
  misc_feature (409)..(409): n is a, c, g, or t
  misc_feature (447)..(447): n is a, c, g, or t
  misc_feature (462)..(462): n is a, c, g, or t
ngaagttagccttttaactagaaagcctaagagttctggcacatttatttcttcttttgttgaaatttattcacctagataaaggcagcagtttnggactcagatctttattttatcccaccttcttgtcttctgtattccactcttcttatgttctttcccttcatctgtttccttggcctggccagagcagcagtgctgatcttcatttgggaaaggatgttcctgggtattaccaattagtatacagataagtaaagactagttttccagatctaatacttttttttgaagtggttttgctctgtcatttaggctagagtgtagtgaagtgatcgtagctcactgcagccttgaacttccggggctgaactgatccttccacctnagcctcctgagtagctgggantacaggtgtgtgccaccatgcccagctaattttttaanttgttttgtaggaancaaagtccgggttggttctt

SEQ ID NO: 689593 - DNA, 452 bp, Homo sapiens
tattcattcaattaaaatagtttttttaaatctatatatccatgtctttttgtcttaagggaaaggggtggctcatgataaatttcctgctaatgtgtaggaaaattagtttggttaccatgttaatgtaaatgtagctaatatttaaattgcacaataagttattagaatgtaacttttgggccaggcacagtggctcatgcctgtaatctcagcactttgggatcccttgagcccaggagtttgagactagtctgggtaatatagtaagacctcgtctctactgaaaatacaaaaattagccaggcatggtggtgcttgtgtgtaatcccagctacttgggaggctgaggtgggaagactccttgagccacagaggctgcagtgagctgtaattgcgccactgtactccagccctgggcaacagagtaaaaccctgtctccaaaaaaaaa

SEQ ID NO: 689594 - DNA, 181 bp, Homo sapiens
ttattcataagggattcaggtgattctcagctactccggaggctgaggcaggagaatggcgtgaacccgggaggcagagcttgaagtgagcggagatcgcaccactgcactccagcctgggcaacaaagcaagactctgtctcaaaaaaaaaaaagtcacacctaatgtaaaaacagggac

SEQ ID NO: 689595 - DNA, 1440 bp, Homo sapiens
cttacttttttcttttcttcttctttacctttgttgtttatcctgtgtttctgttcttgttccttctctgtggtctctatgtgctcttctgactccgttttattggtgtccttttctgtctttcatttggcactctgtgcatctcgtatcctttaggtactttattttttcctttggtttctctttgttgtttttctctctgttctctgttcccttcctttttttcgctgtcttttcgtttctgttctttgtttgttcctgctttgtttctctctgagtgggctccactgacttgtggtttcgctccgtctctcgtgtgtgctttcccgtgtgatgtcccctgttctctctttcctttctctttctatgtgctcgcctctgtatctctttaatcgcccctcttcttgccgttctccccgttcaatcctccttcttgaccatctttctttgtttttgatctctaaatctcttgtctcttgttatagttctttctttcctctcgtccgttcatctggtcctactgtgttccttccacccgtgggttctctcctcttggtcattttctgatgccacttctttgtcctctcacaatctgtctggttccttccatgtccatgctcttttcgtgattctttttgtcctcctaccctttttttcttttcttcttgttgtgtttcctctttctcatgtgatatggccttcctttgtcatcttctgtcttttgctccttttgctttctttctctctccgtgccatctgtcccgtcattgcgtgtgtcttgtcgtcttctgtgtcgtgttcctatgtcgtcttcactgtgtttgtgggtcgccccctggtggtttttcctcttggtctttcctctgtgtggtccggtgcttggttgtcgctctcgtcggtctgcctctgtctggttatctgccgttcgtgtgatgtccggtgcgtttcctcggtgatgtgggtctctggtactcggcgcctgccatcccttgtgttgctccttttcctccgtctgggtcctatgtctcggtgtgtctgtgttcccccgtaagtcttggtacccttctggttcggctgtcctagtgtccgtctgtggcctctggggtctgttcttcgtgtggtcgattaggggtcgtcctgtgggtccgtcgtgtggtagctgcctcacctccctatgcgccccgtccgggccctcggcacttcggggtaggtttcatgcctttgtattctgtctcaatgggcgctctgcttccatgctctcacctgctgccgcagctcgccttatcaggtgacagctgccctccgcgatgtcagagggaacacggagcagaaattcccgccgcacaccccgcccgccccagaattataggcgcagcgctccagctctggtctcggttgctaggtgggtgtgttccctagtaacgccgggtccgcaaggag

SEQ ID NO: 689596 - DNA, 683 bp, Homo sapiens
tagtttcgtacagcacggtggtaatcggcacgcggagagagacatggcagacctctccagaggcccgccaggtgggcatggtcccccattttctttaaggcagcacctggagtggagagaggccactccctctccagcccccgatgtggacccggggaggggaggctgaggcgtttggccccgtgcctggccaggagaggcccatccccagggcatgtttcatgtgtgcctggctgggccctgaatgtcgaggatagtatatagcccgctcctgggttcttgggagcttggtgggcccttttggtaactcgtgttggtggtccattggtgtgtgtgcgtggggacagaggcctggaaatgcggaggactatacatgagaagtgcaggttttgtgtgaaggccaggcagggtttggatggccggggtgtgtgatgatggagagtgcccatagggctgatgttggggtcgggtgacggcaagaggtcagaaacagaagagctgcagttgcttggagctgggctgagaactgggcttgctcctggcaatcccacccgttatactcaccctatctccaccttggtgccccacctcttaatcagaatctgaagtagttccctactcacaattcatctcttgaacactgactcacacctttagggcactaatgtgtgtatagaattcca

SEQ ID NO: 689597 - DNA, 990 bp, Homo sapiens
attcattttgggggaatgaaaagttttaattaaagagctttgttgataagaaagggtagaggggaaagatcagggtgaatcttgattcaaagccactgatagcacctgaaagactggtttgagagagcaactggagagcatgggcaagtggtttatttggtgagaagatgatctgtatttggtatggagcaggtgggtggcattgagggagtatacctcaagagtataccttgagaagaatgatgtatccatcactgtgattatcgatggaagctgataatactgatgttaatatatatgacagtgcaaataaaggaaattaggaagaacttgctgaagtatgatactaagatttgctcagaacagaaatattatgttagaactggctgtaagagcaactattaagatatgtataaaaaagagtgagtaggctgggcacagttgctcatgcctgtaatcccaacactctgggaggccaaggggggcagatcacctgaggtcaggagttcgagaccagcctggccaacatggagaaaccccgtctctactaaaaatacaaaaaaattagctgggagtggtggcacatgcctgtaagcccagctactcgggaagctgaggcaggaaaactgcttgaaccccggaggtggaggctgcagtgagccgagatggcaccactgcactccagcctgggcaacagagtgagactctgtctcaaaaaaaaccacacacaaagagctacagcaaggcacaacgcttgcaccaaaaatttgacgctccaattaaggaacggaccaaaccttgttacattaaggtgggggtgctgagcctgccaacgccctttttgccaaactgttaaccaggcgaacgggtcttacggacgggccgggactcgcgggccctgcaaacttccaatttcccaggtttcgcggactggactgtcaactaattaccacctgggacaaaaaggggggaggaaccttgcacatagaa

SEQ ID NO: 689598 - DNA, 500 bp, Homo sapiens
agctgactcctagaggatccctctctgcccagattccaggtagtctctggctccagaccgagttccaccatgtggtcagtcatgtcatgtccaagccacaggtcatatcatggcgcttccagtcattgagtgctccttaaagaggctggaggagaggccaatgacatttgtacttgagactccagagtctagatttataaccactatgttacggctgcccttgtggctgcaaggacacttctttcattcattcatttacaatagatgtagcatctgctgtgtgccagatgccattctaggttctagggaaacaaggcagagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctg

SEQ ID NO: 689599 - DNA, 441 bp, Homo sapiens
  misc_feature (11)..(11): n is a, c, g, or t
  misc_feature (311)..(311): n is a, c, g, or t
  misc_feature (356)..(356): n is a, c, g, or t
  misc_feature (398)..(398): n is a, c, g, or t
ccattgctggnctttctgttgtctgcgtgtctcggttttatagaaaagggctctcaccatgggcagctttccctcgcgtccttaagccgagatccccattttcgttgcctgaagtgcccattgtgtgaatgtgtctgtttacccttcacctatcagtggacattaggttgtttctgatttttggtggttactaagagagatgctgtgaatactcatgccttcatttttcttgattaaacccctgggagtagaatggttagaacatatgacaggtgtctaggcttaacattttcagagactgccagtagccnggcatggtgacacacacctgtggtcccaggtactcgggaggctanggtgggaagatcgcttgagcccaggaggtcaaggctgcagtnagctgagatcgcaccactgcaccccagcctgtctcaaaaatta

SEQ ID NO: 689600 - DNA, 213 bp, Homo sapiens
ctgcttgtcctgctctgactagttgtgagaacttgggaagtggcttaacttttcagtactcactttcttcagtctgtaaaacgaggaggattgcttgagcccagaagtttgagagcagcctgggcaacctaacgagactgtttctacaaaaaatactacaattagctgagtgttgtggtgctggcctgtattctgagctactctaaggctgag

SEQ ID NO: 689601 - DNA, 855 bp, Homo sapiens
ggagtcagagggggcgccagcgctgctaggagctgacagtggtacctcaaatcctcgggccgacctggagcgccagcagtctcctgccttcgggtagcggctataaattcttcgaggacattttacagccagagacagagtttgtctttcctctgtcccatctgcatctcgagtcgcagagaccccccataggtagtatctcatccatggcaaggtgaatgtgtgagcacactggatgcaatgtagaacttattgaccttggtggacccggatgcaggcagactgtgttcttgccttgcgaagatcctccaacaatcccccagtcgatctggggtggacaaccatttggacggagctgagcctgccggttgcctacttcagacagtgaccacatctaggacctcctcctcctcctcctccgagttcctccagcaagctggcatagcccaaatccaagtgatgatggagcagatactgcccttggcacagtcggactgaacaggaggacagcgggtgactggacggggccagagcctggaggcctgcaagtctagcactgggcccttgcctacagaatggaccacgctggctattcgtccacatgagagcacaggcccaggtcagagccttgtcggggagaaggaccaaaatcttataagttgccagataaagcacccagaaggttgcggacagcgcatgcttggggacattgctgtagccttttctaaggaaattaacccgtttacctgctttaacttggcaaactttttttcctggcaggcaatccttcccaacagatatgggcgttgagtcccctgaagatttgaattcgccaatcgacggagcacgcagaag

SEQ ID NO: 689602 - DNA, 247 bp, Homo sapiens
ctcgtttacacaagatccgccacaccacggaaattcggtggatactccccagaggttcccatccggccacgctcctccccccattcaccgatccgcgaaccgaacccacgttaccactccctcatgctccaaccctcttgaggacgatacaccctcagtctatactcgcacgcgactccacctcgtgaaaatcccccgccccgaaagcaccctgccccgccctactccatccatgctcggcagtgta

SEQ ID NO: 689603 - DNA, 712 bp, Homo sapiens
ggatgagggtcggctccaagctaagagtgggccattagctgttcctacttagtatcatccaggtaccagaaaaaggtctccctagtgtttgacacgcctcctgaacagctcttggtgaggtctcttgaggcttggggatccagtctaggaatcccctctgtcacatggttggttacagtggctgggcgtaggtcacactggtcctggtgatggaacagcacctcctctatccagctataccccacagaattcacatgggataatgatgctctcctccagaggatatgaattgctcaggcccatcaaagagtctaactagattgcttgcaacctgttgcaaaaagttcaggaagaatacatcaggtacctccacccctctggggaaagagctgccagtattgagtgaaggtaaggcactttaaggattacaacttatctgatggtcaatcagcagttcctctaagaagagcttcaaaaaaaattaacaaggcagcatgatctcgacaattgcaccctttatgtcactaagagacctgggaccggcatgagactggtcggctcaataaggcctcaaaaatctgctctgccaactgaagttgccttatttgcaattagggcacaataatagacaggatcttaaaacactgagaacaagtgaatgccgtttaaacttaaaaccctagaaaaaaaaccaacaaaacaacaaaaaaaa

SEQ ID NO: 689604 - DNA, 127 bp, Homo sapiens
ttgggcaaaaaagttgaaaaggtggttgtgtcgaccgatggacatgtcctggacagcaaacatgagagaatcatgaacacaggttacatggcagcaaagaaacacctggagataaaccctgaccatt

SEQ ID NO: 689605 - DNA, 648 bp, Homo sapiens
taacatgcttttgattatacaagcccatattggatatatcctaagggcaaaatctttcgtaaaaagcatatatgttgtatgataccattctgtaaaattttgaaagagaattgggacatccatagtaaaagatagacttgaaaaccgtccacccacggaaccagtatacctttaaggtatggggacaattttatgttctttcgccatctctggagggtctaaatttgcaataatacccatccatgatgttgattgaaaacataattgataacacgcgtgtccgatatgcctacagtctcgtagtgccttgagaggttgcattttggcgtacttttctcatatttagacatgtgagtagttcctagtatatgagcgtcgttagtacaacatatgcacgtactgcctggtcacctccttgactaggtaaaatgctttctaaattttttatactcttttattcaatatagatgggatgtctatatgcagcatgatatagtatatggcataatgtcaaaaactttaggcctgacggtgttcagttacgtcgcaatatcctttttaggatatagcatatcctcgattggttgtgtctaaatgtgcaatccacaactccagatgctcagggtattattcatatcataaatgtag

SEQ ID NO: 689606 - DNA, 575 bp, Homo sapiens
actgagggtgtcacccggaccgtgctcaggaaccccagagcacgggcttgtgctgtcgctgccgtgtcaccccttctacaaggattgacatgttggcagctcaagcaatgtggattcatgatgatacccaagacctcgggtgcacgcaccgaaaggacgcccttcggatcatgcctgctattagtacacgtcatcacagttattgtgtccacgaaaatctaggtatctgtgcacgaagaagtggacaacataacgaagagaatctgcagaccccatgttgtatgtggtgtctattacattaggcagacatgcattccaggcagaccccagagtttttggcaccagtgccacacagtttcgtgtaaagacaaactgtgtgaggccatggtaccaggatgaaacctgttctgctcagactcatcaggcatacgtcagcttctcatacaggagcttgacagcgtaatcctcgcatgtgcaggttcacagtagtggtccgcgctcctgtcagaattctgctgcagcactgatctgacaggaggcggaagacatggccgcatattgtctgccggtggtac

SEQ ID NO: 689607 - DNA, 138 bp, Homo sapiens
gatgagcttgctaccaccaagagccactggcataattgccagcagccctgctccagagctcacctcagctggcacccctctcacctggcacaatggggccagtgataactccagcccttccaataaaactgatttccc

SEQ ID NO: 689608 - DNA, 306 bp, Homo sapiens
tgcaagacattaatggtatgggaaagtgtgtacattgaggggaaactcgctgtactctgctcagtttttctgtgaacctaaaatcgctctaaaaaagaaagtctattcatttaaaaaagtcttcgttcatgggctgtacagaggcagagggcagcctcaatttggccctcgggccatggtttgtggatcccccggtttaggctaacagtgcccaatagaaatgtaacgtgagccacctctgtgatttaaaattttccattagccacgtttaaaagtttttatttcgaagtaaatacaggaagttgc

SEQ ID NO: 689609 - DNA, 569 bp, Homo sapiens
gtgatgggcgtggcgagtaggcgacagcgccaggtctccagcatcgcccgggagtagcgcgggggcgttcttcccacaaacgcccgacccacggtgaaaacttctcacggatctgcaggcggtaacccgacgccacttcacgcagttcaaaggcacggccctcgcaagatttgcgcaggatctccaaggccttcttgaagaccggcggctccgggcgttcggcctcttcaaagagttcgaacaggcgctccagagatcgcggtttacccgaggccaggagaaaggcctccagcaaaggggccagttcgcggggttcagtcagattcatcgattcagctcgttattcggctcgcgcccgcacgtggatagccgcaaaaggctcattctgcaccagctcgaccaaggactccttcaccagctcaaggttcgccataaaggtcaccaccacgcccagtcggccctcttcggcagtaaacaactcgacaaagggcacaaacccacctcccttgagacgttccagcacatcgctcatgcgctcgcgggtggacagcgcttcacggctgacctgg

SEQ ID NO: 689610 - DNA, 1645 bp, Homo sapiens
taaaggttaaaaatttttttgttttttcccaaaaaaacccccaaaaagtgggaaaaaaaagggaggtccgaaaaaactcccctccaaaatcgcggggcgcgagagggggggaacaacagcgagcgcgcgccaaaaaaaagcgggcgcgcgcggggcccaacgcgggaagaaaatcaaagaagagccctctgatcccagggaacaccgacgacgccccgagggtccaccgcctatattgcgagagagagcaccaccgcgccgaggagcgcggcggcgtgggaggagagacacaatagtttggtggggccccacaatatatattctctctctctctattatgagagaggagacgagagagagaagaggagaaagagtcgccctctctcttgtgtaaaccagtgtgtttcgcgagagaggagctctgttgtggtgcgctctctcttgtaggagggggctgctctctctctcccaacacagcgcgcgcgcgcccctataggagaatatcgtctctctctacgagaggagcaccccatctctctcgcgcgcgcacgacggggcgtctctctctctctctcgcgagcgcgcgagagggggggcgccaccaaactgcctcaaaaacctcgcgcgcgaggaggatgggaatccgcgagcggaacgtatattatacaaagacgcactgcgagagagcagcgccccacaaactctctctctctatagcagagagagagtggatgattgccagagcggccatggcggagaccaacatatgtgcgacacagcgccgtgtaaaacagcccgcgcggaaagtgtgtcctctcccgaagcacccctcccccttaatagaagagagagatctatgagaaaagcggcgcaacaacaccacgcggggtgcaacacaaaccagagagaagaggggggtgtccaaacaacacgcggagcgcggaactccctcttgcgcgaacaacaaaaggcgggcgccaaagagggcgcagaccaccagaccaaattatttctgctggcacacaatctcggctgcggcgatgagaagagcgccccacaacatgatttttacaaccaaacagacgaaacagtgtgtcgcctcccccacagaggggtgggcggcaaccccccttctcggttgctgttgtgccgttactacccgaacgcagggcccccccgggggagctatctaacaccgagagcggggctgtctcctaacccaccagacgacctagctcggcgggtgagagcaccccccccccgcagagaaccgtaagagcgcttacgtagacgccgcgaactcgatgtacagaaaacaagagctctccccccaaaaaagacgcccccccctagagtttgtatctccgccccagacgtgctactacgttgttggcgcccgccagagaacacacttacgagagctactcagagaacgcaacactcggacgacggagaagaagaacggagcgtgcggagcacgaacagccacctcaccaacatacaggagaggggagaggacccccacggagggccccaccatcatgagcgcgcggagaaagaacacacgcacgcaccacgaggagcatccacacaggggaggacataccacccggcgtactaactccacagggaaaaacaccgcact

SEQ ID NO: 689611 - DNA, 813 bp, Homo sapiens
gggaacgtggtatcaccattgatatctccttggggatcattggaggagccagcaagttactatgtgactatcattgtgtgccccagtgacagcagagcactttatcagaaacatgattacagggatcgtctcagggctgactgtgcgtgtcctgagttgttgctcgtctggtgttggtgaaagtgttggaagctggtatctccaaggaatgggtcagacccgtaggagcatgcccttctaggctgtacacactgggtgtgaccacaggctagatggtcggtgttaacgaagagtggtattccactgagggcaccctacgaggcccagacagagatgatgaggaaatagttgaaggaagtcggcactgacattaggaaaaatcggatagaaccccgacacagatacgcatatgtgtgccaacttttcgtgggttggaatgcgtgacaagcatgctggagccaaggtgcgtaacactgcctggggtccaatggcgatggaaagtcacgcctgttaaggatggccagtgccgaggtggaaccacgctggttgaggctctggacgtgcagtcctagcatgcaattcgtccaactagatcaggccctttgtggcatgcctctgccaggagtgtctaccagaattggtggtataggtactgttcctggttgggcgagctggagactggtgtgctcaaagccggtatggtggtcagcttgtgtccagtcaaggttacaaggaagttacatctgtcgtaaatgcccatgaagtttgcagtgaagctcttctggggaccatgggggtccatgtgcaggaagg

SEQ ID NO: 689612 - DNA, 107 bp, Homo sapiens
cgcgcacacatcctgcacacatccatcgcgcacacatcctcgcgcacacatcctgcacacatccctcgcgcacacatcctcgcgcacacatccttagcggattccga

SEQ ID NO: 689613 - DNA, 246 bp, Homo sapiens
  misc_feature (176)..(176): n is a, c, g, or t
ttctgcccaacacccatgagacacattactgaatgagcaggtgaaagccatcaaagaatgggtgacacgtgacaacttgcgcaagatgggagcgcccgaatctggctggcggaatatctctttgacaagcacacccgtgggagcacagtgataatgaacagctaagcctcgggctnaatttccccactagccggtggggtgacttcccgtggtcaccaacggcagtgcatgcgtgttggggataca

SEQ ID NO: 689614 - DNA, 293 bp, Homo sapiens
  misc_feature (87)..(87): n is a, c, g, or t
tatttttgtgccaggtgtctcaactcttggcttagtgatcagtagcttgactcccaaatgttggatgagcacttgcctggctgatantattattagcagtttgtgttagatatcttcaactaatacaacatcagctccttaacagtttctcatttgatatttaactaactttattagtacatgagtaattaggaatattgacctaccttttaacaacaataaaatggtgttttttaaactcaaaaaatgtctagaaaaagggaattgatatatgaaacagtgtaaccttaagc

SEQ ID NO: 689615 - DNA, 212 bp, Homo sapiens
gcaatttaattttttataacaacttgagataaaatctacataccacacagttcaaacattcaaagtatacaattcagtggtttttagtatattcagagttgtgccaccattaccacaatcaactttacaacgtttacatcaccccaaaaaagaaaccccatactaattagcagtcacccctttgtcctccccaacccttctgtcgtcttctc

SEQ ID NO: 689616 - DNA, 420 bp, Homo sapiens
  misc_feature (97)..(97): n is a, c, g, or t
ctcgagtttcaatgtctgtctcatactttctctctggattgactgtcacaaacacttcgaattcctcctttttatacggttccttgagctttagtgncagcagaactgtcactgacccgcttcctggtcaggatcttctggctgcacttgcttgaacttgaaagctccctgtttcggacatgcctctttacgaggctatatattgacttctgtgcctacaccataccgtggaaatacttactgtgactgcgcaacggctaggctctgcggaaagatttgaaacagtccgcaacttagcatttaaacttatggtatacgctgacagatgatgcatctgatgacccctactgatctgcggaattagaagcatactgtgctttcacaagcttctctagttattccacaagggggggcggttct

SEQ ID NO: 689617 - DNA, 227 bp, Homo sapiens
tcactgcaatcacggtagcttcgcccattgcctcttcaaccaggcacatacatcgagaagttgaacctgcactttatttcacactgaacagacttaccccgacaacaacacctccccagtgggacaaacctaccccacctccccacactctactcccagctaacgttccctataatcatcatgacccattaaacatttgcaaaaccacacttcaacccacaggaaga

SEQ ID NO: 689618 - DNA, 127 bp, Homo sapiens
gaaatgtattgaatacatctatgtagcaggtactgtggtaggcgtggaagatagttgagacagggaacaaggccaacattacggagcttagtatcaccacctagaagagtttttaaaaaacatagat

SEQ ID NO: 689619 - DNA, 289 bp, Homo sapiens
cagttggatttcgctacagacacagcccacactgaagacacacgactccactatagacacagcacacacacacaatgtaggcaaacagggacaggcgtggtggctcacaccggtaatcctaacactttgggaggccgaggcaggagaatcgcttgaacccgggaggcagaggttgcagtgagcagagatcacgccactacactccagcctgggcgacacagtgagtttcggtctcaaaaaaaaaaaacttgcaacagaaccttgaggcttacacggctctgtaaatgtg

SEQ ID NO: 689620 - DNA, 106 bp, Homo sapiens
tactgctaaaggagctcagaggtaaggagcaggctctttcttgaggagtcatggcagtgcagctgcgcttacagctgcatccactcagttactttcctgacttaga

SEQ ID NO: 689621 - DNA, 139 bp, Homo sapiens
ctctaaactcagcacaactggatcaaatgggaatgacttatagacttttctccaagaggccaatgaccacagacacataaaatgatgctcacatcacattactaggggacatgcaatcaaaccatagtgagatactact

SEQ ID NO: 689622 - DNA, 976 bp, Homo sapiens
gccattaaagctgaattttctaagcaaaaaaaaaaaaaaaaaaaaaaaaaaaaaaaaaaaaaaaaaagggggggcgcccaaaaaattttccctaggagacgccaaaaataaagcgcgcatacccacagatttatttgagagaaaaggggtcgccccatataggggagtggtattataaagctataggctcgggggccgtcatgtataacaaagcgacaagagatgggggacaaactgggcgacagtggagaatctttggggtgaagaggagacccctttatatttcgggggggggggaagaacattattgggtggagtaaattatactccactacagaggagatatatataagaagttctatatagggtgagatatatattataaaatattaatataagagagtgttataagtgtgtggttgtacacaatataaaagcgcgagcgctatatatgaggcgtgagcgcgtgtgattaagagagatattatgtgggagatgatatatgtgagaaggttattatgtgagatgtatttgtgtgagagatatatatatatatatatacacacgagagagagaggactcaataagtaaaataatatcaaacaaagacaaataaaagtaaaacataagcaaagagatatgaagaaagccagaggaaagatcagagctagtagtaatagaaagtcagacgataacaagagcaacacagagagaaaaagtcgacgaaagcgaaaacagtatatagagagagaatagagaaagtatcaagaagaagataatatatgaacagtcaaactacagagatacgaagatttggcgaagcatctcctacgaataactaagagcgaagacgatcacagtaaaccgaatacagaatcgagagcacagtcatgcactatacactcacatgcctacagtaaacgacactcgacaacagagcacacacacgacaacaatataatgctatacaaagcac

SEQ ID NO: 689623 - DNA, 196 bp, Homo sapiens
attgcacgagccccgacgaccgcccgacgtgcattcccgattcctcttggttcaagtccactatggcactctaaaggatcagctgatttataatctctaaaggaggacagacccccagaataagataacagttgttggggttggtctgtggcatggctgtgcatcagtatctaatgaaggactggcagatgaactg

SEQ ID NO: 689624 - DNA, 2026 bp, Homo sapiens
acaaaagataggaagaaccttaaaaatatagatgccttttatgcagtgataaaatgtctagatatttatactgtggtgattattaggaatatgtgcaaagattggctattaggatgttcattacagtgttgtttaataattataaaaggacagaaagcaatgtggactcaaaaataggaaaagaatttaaataaatcctagtgtacccgttatacatgaaattatggaaatatgaccctgagcatggaaatatgtacatgagaatgtctaaaagctagttcattttgaaaaacaaaataatgtcacctcatattatttatagtatataaagatgattttaagagtggcagtgtctgggattataggtgattgtatttcttcccttttgcacatctatgttctctcatttgtattgtgtggggagaagtgactttttttataaaaagaaaaaggtatatgcatcccagcagagaagcactggctccacccagtacctgcctcctcatgccaccctctcaagccaaaagccgggggaagcccaggcaccttgaccatgaccgcccgagactcacacttcttctttctcatcagggaaggaaagcccccctgtaagcgatactccagatgagggcgatgagcccatgccgatccccgaggacctctccaccacctcgggaggacagcaaagctccaagagtgacagagtcgtgggtaagtgggtcaccagcggcctctgtgcctgtgaaacctttatctctttgtatttttccaagacagtgatgaagggatgcaagtcattttatccattgtgttccctcaactggcatattaaagaaatatggcacaaagatcagcaggatgggggtcctctggtgtgtgggaggatggacactcacaggccagcatggccgtgagagccacacaccccgcaaaatgtccaagttgaggagcaatcctgcccagggacgcgtctctgtcactgtcctctgtcctcactgcacttgcaggaatatcaaatgttatggattgtagatcgtgaaaattacacacttacgtgttttggcaacagtgcttttcagtgtttggggttagaacaagccacatctggccattttatgttatccctctaatctctagttcttaaatttcagatttaactgaaaatagaaagtttcataaatggtaatttttaaatgttagaaaaaaatcaaagcacacatttacataccttttccataaaaaagtgtgtgtgaaaccatctgcaactccactggttaacttacacatgcgacagtttgtgtttggaaaacttcacccaccctctttatttcaagaaaccaaagacggagagaagttcagtgaattaaccaaggtgaaatgacagagtcagaattgaactgaatttctgactgaaaaactagttctcgctccattataccatgttctaatgagctaatgagtcaacagttccctggaatacctgttttcttctttaaaaagagaaagagctgtgatactgagagctacctattggcataaaagaatatgaaggacatacaggtaaaatgaggtagactggatcaatgtgggtcagctacataagcccccatagccaaggagggaacatgtatgtaaaattctcaggcttatgagaatcacaactgtatgtctataggacatcctaatgcaataatgggaaaatgtgataactgaattttatctacatgtatagaaaacatattttgggccgggcatggtggctcaagcttgtaatcccagcactttgggaggccgaggctggcggatcacaaggtcaggaaatcgagaccatcctggctaacacggtgaaaccctgtctctactaaaaatacaaaaaattagccgggcgtagtggtgggcgcctgtagtcccagctactcgggaggctgaggcaggagaatggcgtgaacccggcaggcggagcttgcagtgagccgagattgcgccactgcactccagcctggatgacagagccagactccatctc

SEQ ID NO: 689625 - DNA, 220 bp, Homo sapiens
aaacaaaaatccgagggggggggggggggggcttttaatttttcctttaaagaccccccaactgggaatttttttaaagccctttaaaaggggggacaaattggccccttttaaaaaaaagggcccaaattaaaaaaaaatgaattatggacccccctccaggttttgggggttgtccttttcccaccctgatggggaatttatggatgggtttccttta

SEQ ID NO: 689626 - DNA, 1484 bp, Homo sapiens
  misc_feature (1)..(2): n is a, c, g, or t
  misc_feature (4)..(4): n is a, c, g, or t
nncnccttgttgttcttgccccgcccgggctggtagttgtgttcgtctgcttcttttatggtttctctcgtggcgacatcttgtttgttcgcgcgtggccagttcatattggtcgctggcggggtggttctgccgccctgtgtctgtctcttgtgtttgtgttgttttggtcgctccggcggggggcgcggtaatcttccgttgtcggtgggggtgtggtgcggccccgttgtgtgtgtctcccgccccggcgtctgtggttgtggggtgctttccctctggagtaggctcccgccggctgctgctgttgttttctcccctccccctgtgtgtgttttatgcggccgccaccgtctcgtgtgtttttattaagttgcccctctcgtttttgggggctccccttttttacaaactgcgggggggcgtcttgtgggcccccccgcgggtttttttttcgccccccccccttttttttttttttttttttttttgtttttttgtttttttttttttttttttttttttttttttttttttttttttttttttttttttttttttgggggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaaaaaa

SEQ ID NO: 689627 - DNA, 985 bp, Homo sapiens
  misc_feature (983)..(983): n is a, c, g, or t
gcagcagaggaaccttttggaggaggaagaggacacagaggccctgtagccaggcaccaagatccctcccaggtggctgggtctgaggggaactccgagcagccctaggtcctcaaagtctggatttgtgtggaaaaggcagctctcacttggccttggcgaggcctcggttggttgataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggtaaggcctggctcagtttttcctttagtggcctggagaaggtgcatggggtttgaaggaggaaagcatcctgtcttccttgtgttctgagcatgtttctaattgactggtagctcagttgttgcaagcgattggttccaagtggtaccgagtcatagagtccttgttctggtacagccttgtaaaggacttctcaacacgtaccaattccaccctataaataaaacaagggaaaagtgaacagcatcacatgagaggcttggcgagggctgctattatagtaacacatactaagtagtctcagctgagccctcagggtacgtgtgctgagtggtcacctccacaaaacaaaaaatcctgatacaccaaantt

SEQ ID NO: 689628 - DNA, 111 bp, Homo sapiens
atcctcaaagatcacccagcactcagaaagggatagacgccttctgccggcaccgaggctgcctctccacagcgctgtgccattggactgcgcccttccttggtgcctctg

SEQ ID NO: 689629 - DNA, 6208 bp, Homo sapiens
  misc_feature (4932)..(4932): n is a, c, g, or t
gaattccggcgtcgcggacgcatcccagtctgggcgggacgctcggccgcggcgaggcgggcaagcctggcagggcagagggagccccggctccgaggttgctcttcgcccccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgtcaagactccacggacaccgagagcaacaacgaggagcagcgcagcggtctcatctacctgaccaaccacatcgccccgcacgcgcgcaacggcttgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattgggttggggaaagtcggtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgntttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaaaaaa

SEQ ID NO: 689630 - DNA, 6627 bp, Homo sapiens
  misc_feature (5351)..(5351): n is a, c, g, or t
acaaaagataggaagaaccttaaaaatatagatgccttttatgcagtgataaaatgtctagatatttatactgtggtgattattaggaatatgtgcaaagattggctattaggatgttcattacagtgttgtttaataattataaaaggacagaaagcaatgtggactcaaaaataggaaaagaatttaaataaatcctagtgtacccgttatacatgaaattatggaaatatgaccctgagcatggaaatatgtacatgagaatgtctaaaagctagttcattttgaaaaacaaaataatgtcacctcatattatttatagtatataaagatgattttaagagtggcagtgtctgggattataggtgattgtatttcttcccttttgcacatctatgttctctcatttgtattgtgtggggagaagtgactttttttataaaaagaaaaaggtatatgcatcccagcagagaagcactggctccacccagtacctgcctcctcatgccaccctctcaagccaaaagccgggggaagcccaggcaccttgaccatgaccgcccgagactcacacttcttctttctcaatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgtcaagactccacggacaccgagagcaacaacgaggagcagcgcagcggtctcatctacctgaccaaccacatcgccccgcacgcgcgcaacggcttgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattgggttggggaaagtcggtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgntttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaaaaaa

SEQ ID NO: 689631 - DNA, 6231 bp, Homo sapiens
  misc_feature (4955)..(4955): n is a, c, g, or t
gcagcagaggaaccttttggaggaggaagaggacacagaggccctgtagccaggcaccaagatccctcccaggtggctgggtctgaggggaactccgagcagccctaggtcctcaaagtctggatttgtgtggaaaaggcagctctcacttggccttggcgaggcctcggttggttgataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgtcaagactccacggacaccgagagcaacaacgaggagcagcgcagcggtctcatctacctgaccaaccacatcgccccgcacgcgcgcaacggcttgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattgggttggggaaagtcggtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgntttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaaaaaa

SEQ ID NO: 689632 - DNA, 1193 bp, Homo sapiens
  misc_feature (256)..(256): n is a, c, g, or t
tctgctgacccccggcccttttttaggggggaaactccccttggtctggcaagagacgggggatcaacagggaccagcacccatctcgagggtgggtattttctggtaaagatcagggtgttcctccctcgtagtgtttagaggagaaacaccctcatagatagaaaacccccccgagacagcagcactgcaactgccaagcagccggggtagagagggggccgccctaggcacatgtgggcgcccttgaagacangcaggggtcttcagattgtcaggcgctcagattgtcaatggtgtctggagaacgcggcggggttggtcacctggctgtaggggcgccacaccggtcgggggccccaccagggaatcttctcaaatgtcccaaggcgaactatctgttcgcagacaacaccgggaaacccatggtgcgataagacgctcgggggtcgggccattaaagcgcgcgggggctagtccgcccgtctggagacgcttgggcagggggcctcccacggcaagagaaggcgccacacaacaccaggtgtgtgctgccccccggaaccgggttcaccttcgggcacttttcttcgggaaagacgcctttgaagtgttgtggtgtctcaagaaccccaccactcaaggggcccggggacgaggtacttctagagggggaacatccagaggaatcctcttgcggatcccatagggggggttcctccttggaatcgcccccaaaaccctggtctttgcccacgtgaagaaagcccagagaccacaccacaccagggcccccggggggtcccccagaagcgacgccccacgttagaaggacctacggtcacacactctcgtggggttgtaagcccgcccgggacccgcttggggtggccctcaagaagggagacgcccaaaattttcctcgaatataggtaggataccctttggccccccgtatgaggggagaaccccccaggcgtctccacacagggtctccccccagcccggaccaaggagtgtgcgccgcccagaaaaaaggggtgatatacaccccggaatgtgggcgtccgcgccggcccgcccggatatagcccagagagacagcgccaccaccatgtttgcgggcccacattttgttcccaaagaaaaccacccggggagaagcggcccccgaaaaaaaggcccttttcagg

SEQ ID NO: 689633 - DNA, 5969 bp, Homo sapiens
  misc_feature (4693)..(4693): n is a, c, g, or t
gcagcagaggaaccttttggaggaggaagaggacacagaggccctgtagccaggcaccaagatccctcccaggtggctgggtctgaggggaactccgagcagccctaggtcctcaaagtctggatttgtgtggaaaaggcagctctcacttggccttggcgaggcctcggttggttgataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgtcaagactccacggacaccgagagcaacaacgaggagcagcgcagcggtctcatctacctgaccaaccacatcgccccgcacgcgcgcaacggcttgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattgggttggggaaagtcggtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgntttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaaaaaa

SEQ ID NO: 689634 - DNA, 268 bp, Homo sapiens
cgggcattcgacgcagcggacggtgcaccgcagcccctctgagtgatgcctacctcagtggtatgcctgccaagagacgcaagctccggtctgatatacaacacgactgcaggaagaccccatatacagtccccagcgcttacccaatgcccagcggggctattgctgatgatccttagctctttgctctatgggcctatctcatcaggggaacgtttcccccctcttccttcacaggatataagaaataaaagtcggatttatctgg

SEQ ID NO: 689635 - DNA, 6268 bp, Homo sapiens
  misc_feature (4992)..(4992): n is a, c, g, or t
gaattccggcgtcgcggacgcatcccagtctgggcgggacgctcggccgcggcgaggcgggcaagcctggcagggcagagggagccccggctccgaggttgctcttcgcccccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggttacatatggggctgatgactttagggatttccatgcaataattcccaaatctttctctcccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgtcaagactccacggacaccgagagcaacaacgaggagcagcgcagcggtctcatctacctgaccaaccacatcgccccgcacgcgcgcaacggcttgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattgggttggggaaagtcggtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgntttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaaaaaa

SEQ ID NO: 689636 - DNA, 207 bp, Homo sapiens
gaccggcatctggacttctggcatctggacttctggcatacctggaccttctggcatacctggaccttctggcatacctggaccttctggcatacctggaccttctggcatacctggaccttctggcatacctggaccttctaatagtggatacaggttgccgtggcttctcagcagaaacattacaggccagaaggtccaggtatg

SEQ ID NO: 689637 - DNA, 6653 bp, Homo sapiens
  misc_feature (3830)..(3830): n is a, c, g, or t
  misc_feature (5377)..(5377): n is a, c, g, or t
acaaaagataggaagaaccttaaaaatatagatgccttttatgcagtgataaaatgtctagatatttatactgtggtgattattaggaatatgtgcaaagattggctattaggatgttcattacagtgttgtttaataattataaaaggacagaaagcaatgtggactcaaaaataggaaaagaatttaaataaatcctagtgtacccgttatacatgaaattatggaaatatgaccctgagcatggaaatatgtacatgagaatgtctaaaagctagttcattttgaaaaacaaaataatgtcacctcatattatttatagtatataaagatgattttaagagtggcagtgtctgggattataggtgattgtatttcttcccttttgcacatctatgttctctcatttgtattgtgtggggagaagtgactttttttataaaaagaaaaaggtatatgcatcccagcagagaagcactggctccacccagtacctgcctcctcatgccaccctctcaagccaaaagccgggggaagcccaggcaccttgaccatgaccgcccgagactcacacttcttctttctcaatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgtcaagactccacggacaccgagagcaacaacgaggagcagcgcagcggtctcatctacctgaccaaccacatcgccccgcacgcgcgcaacggcttgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattgggttggggaaagtcggtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtaccccaaaattttaaaaaaagggtnaccctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgntttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaaaaaa

SEQ ID NO: 689638 - DNA, 2885 bp, Homo sapiens
  misc_feature (1609)..(1609): n is a, c, g, or t
gttcttagtctcagcactatgaacccctgtttggattaaatgctgaggtacttatgtacaatttcctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgntttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaaaaaa

SEQ ID NO: 689639 - DNA, 129 bp, Homo sapiens
tccactgtcccagtgaagatgggctggcccaagaggagttgccagtacacagccagctgaccaaacatcgatggatgaggtgtaatcagtggctccaaagattagctctggggcccggtacatgcaatg

SEQ ID NO: 689640 - DNA, 1114 bp, Homo sapiens
ggatcccctggaagccaagagttcaagaccagccaggctaacatggtgaaactccatctctactaaaaatacaaaaaattagccgggtgtggtggcacatgcctgtaatcccagctgctcgggaggcagagagaggagaattgcctgagcccagaaggtggaggttgcagtgagccgagatcatgccactgcactccagcctgggtaacagagtgagactccgtctcaaaacagaaaaaacaaaaacacgagaaaacaaaaaaaaaacccttgaagctttaccagaagattccagaatgtcctccagggcgtaatccacttggtccagagcaattttaacggggggccaggccattcctaatgacattgtcgcaggatatccacgcactacacatacggccaacccaaaaattcttctgaccctaaggggtacgagcatctgtgcgacactcactccagactttgagttgagacggctctcgaggcgggcacaatttccaccgtgcacacacaacaacagcgacagagggttccttgacaccagtagttgtccccatgtgttccccacgacataacgtggatgacggtgtcatcttcagcccgccgtgtgacgcttatattccccacacgttgtcgcactgttacacgattgatgtaacaccattaagaacgcctgttacgaaacctttaggaggtatgcgaaggacgcatcgttggtcacccccctatacgcctaacatcattagcacgagtcgacgaaacggatctttgagcgaacgcccagacgctgtcgccgtagaagaaatacccccccaatggggtcaccaactttacaagacggcggctacatttagaaaagcgacgattttatgtgtggtcatataacgtaagaatctttatatggtggaagaaaagaaaaggacggcatgttttacgaacaccacctgtgagatgtgcggacaaagcgggcgcgttgtgaaaaaacctacataagtgagaggcgcagcatcaatacctggcgcattcgacatcacgagggaggacaccgacgccgacgcctctactgggagatgcctccagagggccacaagacatcctccgcggtgaacgcatg

SEQ ID NO: 689641 - DNA, 495 bp, Homo sapiens
aacagaccagaagtagaaggaaagaagaagataaatataccatgaaaacactaatgaaaagaaagcttagaggctgggtgcaatggctcacacctgtaatcctagcactttgggagacagaggcgggtggatcacctgaggtcaggagttcaagacagcctagccaacatggtgaaaccccgtctctactaaaaatgcagaaattagctgggcatggcggtgcgtgcctgtggtcccagctgcttgggaggctgaggcaggagaattgcttgggcccggggagttgaaggttgcagtgagcctagatcgcaacatttcactccagcctggtgacagagcaagactccgtctaaaaaacaaaaacaaaacaaaaaaacccaaaaggactgagttcagagaacttcctgatagttgaacacctggaggatcttagagggtggcataaacagagagggcatagaagtaccatgccatacccccataactccccatatg

SEQ ID NO: 689642 - DNA, 909 bp, Homo sapiens
gcctgcaggctcttctcccgccgcggcccggcgctctccgagtcgccctgcggactggtctcgcacagtgctgggcaccgggcgccagaagacactggccatgagagcgggcaaccaggtaccggctgagctgctcgctccggggcacgagctggacgtacggggcctggtgtgctgcgcctatccgcgggagcctttgtgtccgtgtcccgagaccgcaccaccgcctctgggcccagacagtccaaacaggagcttcacagaaatgcactgtatgagtggccattccaattttgtctcttgtgtatgcatcatcaccctcaagtgacatctaccctcatggcctaattgccaccggcggaaatgaccacacatatatgcattttctcactggacagtccactgccatttataattctaaaaggcacaaaaatacttgtctgtagtctatcatctggaaaatcttgggacattacttagtggttcatgggacaccacttgtaaagtctggctgaatgaccaatgtgcatgatgacttgcaggtcatacaagttgcagttgtgggcggaaagatcttacctgacaggcttaatgttgactgcatcagcaagacacccacctgttacaacccgtcgcgaacggctcgcacccactgtggagacggatcctctctccagggcctgacccacccgtctacagcgggtcgccccactcctgagtgcccccgcaatctcctctcctgttgcgagtgatggtagcatccagaacgggtgcaacaccccggccagcgctcgcagcctctctgtccctcccaccccttctcacctatcccatcccatgccacatctccgccacccgcccctcccactcgccatgggcgtccacctccgccccatatcgccccccacg

SEQ ID NO: 689643 - DNA, 861 bp, Homo sapiens
gaatcagttttttccccccaaagtggaataaatagtggtacgcattattttcgtaaatactgagcagtagaacccttatggtagtatagcagtataaaatgggtgcttggaaataaagaatttttctgaaatggtatataatgtggtaacggtatatatacaaaatatatcttcacatctagtatatctggttggaagaatgattatgtaaatgggcagaatgggtatgaaaagactttctcattaccattgtgatggtgaatgctcgagtttataacctgaaaatatttactctatataaagaagtttggtccttggcaattggtaatacgttcatttaatatactctggctccaggattccagtatttgtcttgaagaactaataaaatctcacctgtcaatttctatatggtagcttttggtgacagtatagaaggctaaaagcaaatggtctaaatacgcacttgcacacacgtatatgattattatctccaaaatattgagacttacacataacagcttggcgcggctagattagaacaatcactaccataaaccattagatgtcctaattatagtttccagaactgcctatgtagaaacaaatacctcaagttggtgtctatgttacctgtcgctttggccacacatgatgtctggtgactcagttcgggaaaatcacggctctgattcgcaacacctgttgcctgtgtttccccattccaccttattacgcggggggctaaaaatactatgcccgggggggttccataacacagcgttaccacaaccagcgctaaatgggccacactaatggccaagttgtagaaatcgacacatgaggggggacaagaaaacc

SEQ ID NO: 689644 - DNA, 480 bp, Homo sapiens
  misc_feature (38)..(38): n is a, c, g, or t
gctcgacgggagagagaaaaaggaaaacggggcatggncattcgacgccttctccaaggggtctgatttctgagacaccagcttcaccttcttaacaaggcacctaattacaacaagcattcacattttggtgcattccagaatggaaaattcagatagcagcattgattcttccggtgcagctcagttggagatgttgacacccgaagacctgagctcagggtaaagggcctgtctggagaacccttccatttagttattaagataagggaagctggattcctgaaaatgtccgtgggtactccaaatgattattggtaccatttgaattgaacctggacttttagccggtcatggtttccaaatggccttacgggggaacctgattaaaattggcccctaattaccaaaaaacaaaacgagtcgaagctgagaaaaatctccccggccggatttttgtagtattgctcccccgggatt

SEQ ID NO: 689645 - DNA, 237 bp, Homo sapiens
tctggtccccatactacagcagcatctgccccactgttagtatttgttgagtgaataatgagttagtccaggaatgggagcaaccaagccgttccgaccttcagctgtacccttccctttcgagtgggaattcacacgccgagcgtctcttcttaagaagcttaaagcactttcacattgctggggacttctttggagtgagaatctctaagcaaaatgtgttggccaggtgggaac

SEQ ID NO: 689646 - DNA, 689 bp, Homo sapiens
  misc_feature (58)..(58): n is a, c, g, or t
cttcgtggaggtggcgggtggcctatgtctcctttggactcatgccggaaaattggtngcgatgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttga

SEQ ID NO: 689647 - DNA, 310 bp, Homo sapiens
  misc_feature (19)..(19): n is a, c, g, or t
tcaagtttaagacacaacnatagaagacagacatagctgggtgcaagttgtacgcctgtaatcacagcactttgggaggccgaggatggtggatcaagtgaggccaggagttcgagaccagcctggccaacatggtaaaaccccatctctattaaaaatacaaaaattagctggatgtgatggtgcatgtctgtaatccccgctactcaggaggctggagaatcccagctactcaggaggcaaggagaatcgcttgaacctgggaggcagagattgcaatgagccgggattacgtcactgcactgtagcc

SEQ ID NO: 689648 - DNA, 222 bp, Homo sapiens
tgctctgagatcccctggtgtacatagtattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatactcatgtacagccaggggataatctaggtcactc

SEQ ID NO: 689649 - DNA, 195 bp, Homo sapiens
aatgaattactgaaaccaactttccccatattgtcctaaatgatcccagatgacccttgaaggacaaggaggtgaaacagaaaacagcttcagaaaggagtgcttagaaagctatttaggtgggctcctcttccttgactatctacgcaggagggaaggcagaagttgagacgcagccagtagaggaaactccgg

SEQ ID NO: 689650 - DNA, 645 bp, Homo sapiens
tgctctgagatcccctggtgtacatagtattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttga

SEQ ID NO: 689651 - DNA, 354 bp, Homo sapiens
ccccctttccttaaatggtaataactgggaggtttagctggaaaaacttaaaatcaaaaatctggttttgaatctgttcttttttaaaagcatattcaacttccatatggaggtgtcaaagaggatttaaatttaaaattttggagcccaaaggaaaaggtttaactgtaaacataaattttaaaaatgccggaaaataaattgtgatccttttttatcaacacaaaaaaaactttactttgtccaaaataaacaatcaaactgtacatgttaacaacccctttttcagggccaatttggccttttgcaaagttttgtggtttttaaaataaataaacatattatatgttttta

SEQ ID NO: 689652 - DNA, 618 bp, Homo sapiens
  misc_feature (23)..(23): n is a, c, g, or t
  misc_feature (32)..(32): n is a, c, g, or t
gtgtactatatactcagaagtanttggtcatngacttgcctcagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttga

SEQ ID NO: 689653 - DNA, 1138 bp, Homo sapiens
  misc_feature (58)..(58): n is a, c, g, or t
cttcgtggaggtggcgggtggcctatgtctcctttggactcatgccggaaaattggtngcgatgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgaaaaaaaaaaaaaacaacacacaaaaaacacaaacaacacacacaaaaaaaataaaaaaacaacacacaaaagcggcgggggcccccaactaaaaaatcacccaagaggggcccacaaataaggcataccccatattagtaaaaaggggggccccaaatatagaggagcgaagctaatataaaaagaacgacacagcacgaggccaacagcttaaaaaacagcggtcaacgagcgaaaacacgcgctccataggagccacccgggaacagagaaccacaacatcacggcgggggggggaaacaattagggggacaacaaacacccccaagaaaaaaaaacacccaggaagaaaacaacaaacaaaaaagcggaaaaagaggtgcaaaacaaccgaaaattacgggcgcagaaaaaaattggcaaaggggaaataatggtcaaaaatttcc

SEQ ID NO: 689654 - DNA, 524 bp, Homo sapiens
  misc_feature (113)..(113): n is a, c, g, or t
  misc_feature (117)..(117): n is a, c, g, or t
  misc_feature (267)..(267): n is a, c, g, or t
  misc_feature (486)..(486): n is a, c, g, or t
accccaccacgaccctaccaaaaaaaaaaaaaagaggagaagtcggccgcaccttgctttattgtgtttcatttaacgctgaaatcacacaatgattagaacatgaaactttntttnaaaaagatatggggataaatattaaatttaaaacacaactcttgacctataaagtataaaaagtacttacaatgaaatattcttcactaaatctgacactttgggattccaggcaaaaggatcgcttgggtgccaaaagttcaagaccancctggtcaaggggggagattctatctcctactccaatgtaaataacaaaatgaaaaatatcacgatgattccagaccaggaatactacagatgtccaacacttccaccctgaatccccaaagaggcccgcttttagcctccacactggttaggtgacctgcctctgcatttcactcttctgcttcagataaaaattttcaggtctgtctcccactctantgaaccactcctttggctactgtctggagagaatttaa

SEQ ID NO: 689655 - DNA, 224 bp, Homo sapiens
  misc_feature (4)..(4): n is a, c, g, or t
aagnctcgaaaaggggcatagctggtgaggagagtctgggcacctcctccatggctctcatgtgcctattcatttctgtggcgaggggcatagaggtatgtggcactgaagatgggtctttatgctctgtaaatcttgatggcactggcttcctcctaagtccccatactcaagcctcgctcacttcccctcattctgtccccccttttccagaggcttgagga

SEQ ID NO: 689656 - DNA, 206 bp, Homo sapiens
  misc_feature (3)..(4): n is a, c, g, or t
  misc_feature (51)..(51): n is a, c, g, or t
  misc_feature (171)..(172): n is a, c, g, or t
cgnngaagccctacgagttggagcctcgagaaatagcccggggtccacccntgcacatgttccccccagcctgtgcagggccccagccccctccacataccaccggcagccaccggcagcggcagcgaggaaaggtgcagcagtggcccacagccggcagctgcacgggannccgagagagtcccgcgctgcaggaaagtgccccc

SEQ ID NO: 689657 - DNA, 783 bp, Homo sapiens
  misc_feature (58)..(58): n is a, c, g, or t
cttcgtggaggtggcgggtggcctatgtctcctttggactcatgccggaaaattggtngcgatgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatcaaa

SEQ ID NO: 689658 - DNA, 549 bp, Homo sapiens
tgtaatttcttgttaatcaccctcctcccagctcccaaccttctgagtctccagtgtcgttattccacactgtggcccacatgtacacattatttgggcttcaacttataagtgagaacatggcctccaggtccttccatccttccacgttgctacaaaagacatgatttcattcttcctttatggctgaatagtattcgtgtgtgtgtgtgtgtgtgtgtgtgtgtgtgtgtgtgtgtgtgtgtgtgtgtgcgtgtatgtgtcgagggacagtatcactaggagatggagggctcctccctccactagagagagagggagagatacatagagacaaagaataagtggacgagacactgagaaacaggtcggggagaggtcatggagagccagctccccgcacacataggagacggcacagggaagacacagcgagagctcacgaaccccaacccaagctgtgccgcaggaggtcgtcaaccccaaacgctatctggggagccacaaggatccggaagatagagacgcacacattaattctccactctc

SEQ ID NO: 689659 - DNA, 162 bp, Homo sapiens
aaactagttacctgaataataaacctctccctgttgccagagcaggcaccacacacggggatccctaagggggctccaggtgggtgctacaaacacgatgctgagagttcctttagtcttctcaagatggcagccaagtttttggtgtcccaaataactagg

SEQ ID NO: 689660 - DNA, 786 bp, Homo sapiens
  misc_feature (96)..(96): n is a, c, g, or t
  misc_feature (126)..(126): n is a, c, g, or t
  misc_feature (187)..(187): n is a, c, g, or t
  misc_feature (193)..(193): n is a, c, g, or t
  misc_feature (205)..(205): n is a, c, g, or t
  misc_feature (270)..(270): n is a, c, g, or t
  misc_feature (304)..(304): n is a, c, g, or t
  misc_feature (336)..(336): n is a, c, g, or t
  misc_feature (340)..(340): n is a, c, g, or t
  misc_feature (352)..(352): n is a, c, g, or t
  misc_feature (405)..(405): n is a, c, g, or t
  misc_feature (415)..(415): n is a, c, g, or t
  misc_feature (444)..(444): n is a, c, g, or t
  misc_feature (461)..(461): n is a, c, g, or t
  misc_feature (542)..(542): n is a, c, g, or t
  misc_feature (565)..(565): n is a, c, g, or t
  misc_feature (577)..(577): n is a, c, g, or t
  misc_feature (580)..(580): n is a, c, g, or t
  misc_feature (591)..(591): n is a, c, g, or t
  misc_feature (649)..(649): n is a, c, g, or t
  misc_feature (667)..(667): n is a, c, g, or t
  misc_feature (672)..(672): n is a, c, g, or t
  misc_feature (680)..(680): n is a, c, g, or t
  misc_feature (682)..(682): n is a, c, g, or t
  misc_feature (687)..(687): n is a, c, g, or t
  misc_feature (760)..(760): n is a, c, g, or t
cggaccccgcgctggcgctgaagcgcaggctgcggggcgcggcgtcgggagtgccggcctgcgtgttccttcccgcctgtcggagggggagtcccngacagtccttagcagtggctccgccccccnggtcgaatcctcctcttccgctcctggcctgccctccgtgtcccctcctgtgccctccccnacctcngctgcttccccngaggaagaagaagaaagtgaagatgagtctgagattttggcagagtcgccctgtgggcgctggcngaagaggcgagaagaggtgaatcaacggaatgtnccaggtattgacagtgcatacctggccatggntacngaggaaggtgtngaggttgtgtggcatgaggtacagttctctgaacgccagaactacaagctgcnggaggaaaangttcgtgctgtgtttgataatctgattcnattggagcatcttaacnttgttaagtttcaccaatattgggctgacattaaagaaaacaaggccagggtcatttttctcacagcatacatgtcatctnggagtctgaagcaatttctgaanaagaccaaaaanaancacaagacgangaatgaaaaggcatggaagcgttggtgcacacaaatcctctctgccctaagctacctncactcctgtgaccccccnatcanccatgggnanctganctgtgacaccatcttcatccagcacaacggactcatcaagattggctctgtggctcctgacactataaacaanaatgtgaagacttgtcgcgaagagca

SEQ ID NO: 689661 - DNA, 410 bp, Homo sapiens
ggctgatcagagtgctataacacatcacacattttgtgatgaggcctgagataaacactatccacctcgacaagcaacagggtcaacttctggcagagatgtgtatccttattggtgaaaatgacacatttggagctgagaccaagaagaattgtgacctggacgagaacattgagaaaggattattggatcgagcttttaatgtgcttcttattcaacaccggtgtttacaaatacctgtgtggaggcatccattaagcaatccacccgagcttgaggaaagtgacacccttggagtgaggcgagcagcacagagaccgctgaaagctgagctatgaatatccttggaagaaggtcctccacaagaaattaattatttaacacgaattcactacgctcaatctgggttt

SEQ ID NO: 689662 - DNA, 119 bp, Homo sapiens
agatcgtcaccttcacagccgggatcatgctgtatggaatatcaaaacaatctccaccatgaaagtcatgcagtttcaggctatgaaacgcaaagccagttctcccgtccacccatctt

SEQ ID NO: 689663 - DNA, 175 bp, Homo sapiens
cactcttctggccaaagaatactcattttaattgataattggcagaggaaagaagaaatatttagagtagacatgtagttgccctttagagtcatttcttaaggccagcaaattgcaaagccaggccaggcacggtggctgacacctgttatccccgcacgttgagaagctgggt

SEQ ID NO: 689664 - DNA, 429 bp, Homo sapiens
gtacctagcaacatgtgacagctacagcagcaaatactgaacgctcatgaaactcagcagccactcgtgacccctgacctttgtttctggcaattaatatgagcttattcggtatggaatcatcgggagtctcgaaggaccaaaaggtgcctcgtcctctcaccctgctaatgacctgggggtaccgggcttgaaggtccaccagtcctgtgagcagggccttcgcggcatgggctgcatatatttagcagtgtcctcccgcttgatgatgttaatcacctcagccagcaacaggttcttgcacgggtcccccagccagtgtgttgaagatccgatagagagctttaggcgtgaactcctccttgtggaaagagcccacagtcatcatcctcgtgctgaaggtcatcacgtctgctgggtcatacaggc

SEQ ID NO: 689665 - DNA, 202 bp, Homo sapiens
actcgcaaggccttccgtagcgctttcgcgctgcgccccgtcgccagtattcggcagtacctactatgtcactcctcagtcccgccatcgagccgttgcgctttcgtgaagcgctcgggcactacgcgtccggcatcacggtggtcaccacgcacatcaatggcgagccgatcggcttcacctgccagtcgttccacagcgt

SEQ ID NO: 689666 - DNA, 167 bp, Homo sapiens
aaatttcccagctctgcaaagcgtaactttttaagtaccaaaacatcattgcttaccttcttttttttttgtctttttaagaaaatgattacaaaaatggtgcatgttcattagtgaaacttgaaagatatagaaaactttgcgaaataaagtaaaaattccttgta

SEQ ID NO: 689667 - DNA, 319 bp, Homo sapiens
ccccccccctttttttttttaagggttttgggggtggtttggttggaccggggggcccgggccctccctggaaaatcccctgggaaaattggccgggggtggggccggttccctttccccccctggggggggtttggtgggtttttgggggtttggggggggccccccaggccggggggggggggcccccccgcctaggcccgggggctggggtggggggggccggcccggtttttggttttggttttttggggcccctggtaaccgggggtttcccaaatcccctcccccttaattaaaaaaaaccccgggtttggga

SEQ ID NO: 689668 - DNA, 360 bp, Homo sapiens
ggcacgagctggtctcagtgactaaggagggcctggagctaccagaggacgaggaagagaagaagaaaatggaggagagcaaggcaaagtttgagaatctctgcaagctcatgaaggagatcttggacaagaaggttgaaaaggtgacaatctccaataggcttgtgtcttcaccctgctgcattgtgacaagcacctattgcttggacagcacacattggacgggtcattagggcccaggcacttcgagacaactttacaattgggctacattattgccaaaaaacaccttgagatcaacccttaccaccccattgtgggacccttcggcagaaggcttaggcagacaaaacgacaaag

SEQ ID NO: 689669 - DNA, 861 bp, Homo sapiens
  misc_feature (861)..(861): n is a, c, g, or t
gggtgcggtggctcatgcctgtaatcccaacgcttggggacgccgaggtcggttggatcatgaggtcaaaagattgagaccatcgctgggcaactatggtgaaaccccgtctctactagaaatacaaaaaattagctgggtgtgggggcgtgcgcctgtagtcccagctactggggaggctgaggccaggagatttgcttgaacccaggaggcatgaggttgctagtaagccgaagatcgtgccactgcattccagccttggtgacagatgcaagagtccgtctccaagaaaaaggaacaaagaagtttcttgaggtggaatgatgttcacacaaagacccattttatagataattacggcattggtgaatacaattagtaaatagtcttctgaaaagaggcagcgtgataccttaagtgtttactagaattgggtctggatatgtatgtaagaatttattggcgagggaaatacggggtttcatgtgtttcaaatttcgagagtgtatgttactgttgacagtgcttatttaatatccaatggtctccaatctccatttaccttagggactgtacaggagctgtgcaagatgtatgaatggtattctttataatccacaataacatttctggtcaggatggaatcactacatgtggtcacattttcaggtaaggatgaggaagcttaggttaagtgggggtaagaacgggttggttcaggttcattgggcgaagggctttgcgtgtttaagaaggggtcacaatcgtgattgcacgtttgggaataaaattttttgagggggggggcccacatgttaaggctcggggatataggggcggaaggccaagggggccaaaggn

SEQ ID NO: 689670 - DNA, 809 bp, Homo sapiens
agcgggcggggcggacgcgcgaggagcgtggagccgcggtcctgtcgtggctccgcgtgcctgcgtccgcccggccagcccggctctgcgctgcgagaggccgtacgtgcagctcgcggctgcgctcggtggagagaagcgctgggggacatggggcgcgtgcgtgcccgcctgggcctcgcaggctccggaagccccgagtgagcgagagctgtccccagcctgtcttacctggtccatggccaaactggagtgatcccgtctgccgttggtgcgccttccctctcctagccccaggttccgggtgcccttggaggagccccctctaagtccagacgtggaggaggagtgacgatgacttgggcaatgacccttggcctgctgagcatggcttctggggacctcgatcagcaagcctcccggcctgggtacacccgagacaagcccatgcccgcgaagcatacagtcggaagcggggaagctttgaggttttcaaccggacaactacaattcgctattgagaacccgactcaaattctgcaattcgtcagggagcggccctgcactacccaaaccgcaactgatgcctacagtacagcggaatgccagcaccgcgatatcttgaacccatgacataaatctgaaggggtaacaaggagccaagagagaagggacaagaagcgctattggccctcattatcatcacggatataggagtacccgttgccagaatgacaagaagtaagtggttgatacgatacaggtatatatgagcgaacaatggcggaatgaagaatgaagtatagtta

SEQ ID NO: 689671 - DNA, 852 bp, Homo sapiens
tagctggtcagcgggctgcgtaagggctcccggcggtgcccaaataggtgtggggtgctgggttgtgctcagccgagaaataaaatgttggggcggccgccccttggggcagtagtggggtcgtgttttgcccacctggggaggtggtccgtgccctttacacgcagacgtggccccgtccgtcttagtatggtgttgcagaacaacgtcgtgggttcaagtggtatgacgtagcgatcaatctggatagacggtcgtgaatatacctggggaaggccctttcgttatgcgccgcagaaatgccatggtagtaggtcttggcgcccaagtgctcgggcgttgcctacctggcataagcagggcttttgccacggtctcccccctattgttgcgacagcgcacctcgggtaattcttgttaaggtttcccccaggtggtctctatttatacgtaggatctgagggagctctttcttgagcagaagcactgttggaacatgggggaggcgaagcaaagtagtcgcacacaaactacgcccgtgtgcacaccaatgatgaacgccactcgttctgttcggtcactccagcgtttacttcaggagaggcgaagcttagttctcccacacagaggatagaacctgggagcagccaccatatgatcccacccctcccgactgtatgtccacggtggactcgtaactgcacccggcgagttgccctacagaacatctttagtcaggcacggggatcttttcccgcttttatctttatgagccaagctttctgtccaccccggatgagcggcgtagctcccggttttccccactctggggaggaaaccgcccacatgaca

SEQ ID NO: 689672 - DNA, 384 bp, Homo sapiens
ggggtcttggggtccctggctgggtggccagaggcccgaagccagcgctgggaagggctgcggatgcccgggtcatgatggaaggtggcaggtccaatgacacgcgggtctggtcctgggctaagataccggcccctcgtccgggcccttgcattctagtcttccgttctgcagaacaacggggccgaggccccttcccatctgctcgcccgtggtgcttgaagtcatagcacccatcgccgtggtccaagtgcgctcttgggtagcctccgtttcccagcggcaccgcgcggccgccagtgccggccttaactgccaccgtgcgacctgtgccgagcatgtggaccaccgcaaggcactccctcgccaggtctcctcgagaag

SEQ ID NO: 689673 - DNA, 196 bp, Homo sapiens
tgtctgatatttgagtgaaaaaaggtactgtcaggcagctctggacacacaagaaggaggaattattttaaaagctgtactctttaattggtagtatctttaaaatcagttggtaacaatgaaggatttgaaaggagcattgactttggcactttaaaagtatttctaaaaatattttggtgcttcgggtcgaaca

SEQ ID NO: 689674 - DNA, 211 bp, Homo sapiens
tcgtctattcatcggcacctggcttactggctcgctctggtggcttccacaggttgtcctgagaacacgaggctgccaggtatcctggtacaagaaggcggtccgcttggactgagagggtaggcttactccccttccaatccagccaggggaatggggtgccgatgaatagcgaggtgccgatcaatagcgaggtgccgatcaatagcga

SEQ ID NO: 689675 - DNA, 181 bp, Homo sapiens
tgattagaggatccgatcagtgcatgtgaagtaggcagagagtgatgatactagaacaggagggatgtcagggaggggatccggaactagatcttggagagaaaggaggagttgagaagataggcaagttagagagaaagttctcctgtgagagcaaacagtacccacaatggcagtggat

SEQ ID NO: 689676 - DNA, 375 bp, Homo sapiens
tgggacgcgaaggtagcggcagcattcctgttcttcaggttggtctcgtggatctggcaaagctccggtgatgattggccggtccggagggtggcgaggctccagagctgcatgctcgccggatcgagccctcgccgtagttctcgtctccgatcaacacccacctgatgccatgtttcttgtagtagcgggcagtgtcagggacggggccaaactcctgagtgacggcattgcgcacggagttggccttgtcgccatcaatgttgatggcaccaatgagcaggttgtcggagatgttatccaagtgcccatggaacttgagccaggggccagcagctgacatgtggtcagtggtacacttccctttgaccttga

SEQ ID NO: 689677 - DNA, 302 bp, Homo sapiens
gaggatcccccctagaagacgaagtagctctatggagtccttaaccactgatagtcttacaaatactggcagatgccaagtctggcaactactgagacttcactgattttttgcacatttcaagtcagcttctccatgtacttgcagcttagtatgagccaacacattattgaacagtatttgaaaagatcttcactgagaatcgggttagggagttacagctggagaacaagaacattagcacaagtacctgatctgcttttgagcaattgctatttataaccggtcgcaatcactacata

SEQ ID NO: 689678 - DNA, 347 bp, Homo sapiens
  misc_feature (49)..(49): n is a, c, g, or t
ggatcttaaagtgcactcttctatatctccgcagcagtatgtattgcanaagagcaaaagaacaaagcttccacagtatggaaggggacctgagtgggttgctgctgctggctccagcagcctgcttttattcccttatctgaccccacccacgtcctcctgattggtccatttatagagagctgattgttccatttacagagcgccaactgatccattttacagcagagctgattggtctgttttgacagggtgctgattgggtatttacaaacattgagctagacacagagtgctgattggtgcatttacgatcctttaggtagatatagaagagtgcacttttg

SEQ ID NO: 689679 - DNA, 632 bp, Homo sapiens
cccaccgcgtcccaataagaagaaaaagtgtgaaattcacaggtggaaaagtaaggccccgggcccccatgagggcacacccagtggagaagcccagcgtcccagtgtcacgaacacggtgcccctctaagaagaaggaaaccacatgagcagggcacaaaggcactttttcctcctcggaggttttgaggagacccctgacacaacccaccacaggttggcaatactgtgtgtgctcgtttcttgagtttttctctttaggagttaagttgaggttcccagctgggttttgggaagaaaaggaagattgctacccacagtcttggaatagttaagggcgaagaaccccgcacaagttgaggtaattatagaggaggcttgtctttcacaaggcacggttcctggggcttcaagggctaaggaagggaaggaggcctgcccctttaacagaaccccacgtcaacacatgcggctcaaagtcaactcacagaaggctgttgcactttcacagggctaatgttggtcctttgtttatcctcctataaccccacgctgtttgtgtttcacacaatgttgtgaattttccttggttctttttaaaggaatgataataaacttacttgctttaggga

SEQ ID NO: 689680 - DNA, 128 bp, Homo sapiens
tgcttggaagaaacagattaagtaagacaaaaatatatgtcttcaagaacacttacgtttctgagaaagaattcttgaatgcagattctaatgtctggtaaaatgctttacagtgtaaaaaaaaaaaa

SEQ ID NO: 689681 - DNA, 336 bp, Homo sapiens
cgagaagaccctatggagctttaattgattaatgcagactgtacctaacaaacccacaggtcctaaactaccaagtcctgtgtttaaaatttagtgtggaaagactcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaa

SEQ ID NO: 689682 - DNA, 889 bp, Homo sapiens
gacactcgcttgtggaacgtctgaggttatcaataagctcctagtgtccacacgccatgggtcatgattacagggaggtacggacaaggttagtatcacaagcctgtggtgcaaggtgaaatgtggaagatgctgaaggagagacccgtgggaaggttcttgtgattgtgtaaacctatggaaccagagagtgctttgacagttttggaaatacctgttctctgcctcatgccatcatgggcattaatccaaagtcatgggacatgggatgatggtgttgatttccttggggagattgcataaagcaacgtggatgattctctaaaaggggagcttttggccaagtctgagtagtaactggcactgttgacaaagggtgcattggtgcgatccttgaggaacctggcaaagacatactttggcgataaacttgtagctaggtcgaccagttgtttggaaaatccaattatctgtgtaacatgcatatttcacactccaatgaatgggtggcatgtgcttttcacttgtggcagaaagacttggttcgaacatgggaaggtgcgtcaggtgggctcgctttttacactcctaggattagcagttgaagacgtacggtggggccaatgaattggagagaagctataccggagggcataggtgctttcaagtaaactgggaaaggacaacttcaataatttatttaaatctaatttactggtggatggaggacgcaaagacttggacactaaacgaattccttgctttaaaaagaagtgataatttgttgcggggaaattctaacgggcatctggcaagaaccgtttcttgcaggaaactagtttggacttttggggggtccaagtgacgtctgtgaaaaactcgtgggcag

SEQ ID NO: 689683 - DNA, 1014 bp, Homo sapiens
agagcagcaggaggagggacgagcatgatgatcgtcgtgtaccagattcgttcttgaggcgacgttggcaagatcttgctcagctcgaaatgccggagcatggaaatctcactagcatgagcaatgctagctgtaaattagcgtattcggcctgcctacgtctatcgacctgtgcgctataccaagttaaccaggctgattctggaagttctgaggaagaagctgctgtataaataaaagtactcgagaatgtcttgtgtcctcgacatggggtattagacctgagctccattctcaggaagccagaaattctcgctagtgctccagttagatatgctggtgttcctcttgacagaataaccacgtgaacttttgaatgagagaccctctccgcaagtgaggttcactctcagtaaagcccttgagggacatggggtgatgcctggatgactgactcgcttgctgcggacccatgttggtactatgaacgcgagtacctccactatgtagctcgaaacgaccgtcttgactgtatggtatgactgaactgtggactgattcgtacagcccacgatactagagtagacgtactccaacacaatgtcttgactgaacttcacggctgaaccgcgggcacatgtgaattattcccccagagaacataggccagagaaccggaagttatccactctacggggtccacccagagttggaaagcaatatgatgagccgagaatgaacgacgtgggctacacggacagaggcacaatctacgaagttaggcagaactggacatccagtaccggatgctacgaggacgagctccactcacaaatgaaagggcgcgctgacggcgcgcatcaggcaaccccgtgcccgaccgcccgcacccgctgcaacccgcgaaagaccggtacaacggacggacaccagacgcgatacaaccaagaccgaacatacgggagagacaaaaacaccgatatcagtaaaacacaaccgcgcagagcacgaaag

SEQ ID NO: 689684 - DNA, 1095 bp, Homo sapiens
cgtgacgcgtgggggaagaagggagctggggtcggagccgtcggggccaaatggatgacggggccatggaacaggcagtctcggcccaacatgctggacgctccctccaccccctgctgcaaaaatgacccaaccggagttgaggcgctgcccctgaatggccccaccttacacttggcagggggcctggatgccaggctcccaggactgctccagaaccgagggaagctcgggtccctccaagctagccatggtgaggcgccggaggccccggggccccaaccccaccggcctgaccacactgccctgggtgccctcctccagaagcccgagatgcggggggccgggagacaacactcctggctccccagagaggcgtgggtctcggggctgagggccagggcccggatgcccaggttccgggactagggccttggcagccagcgggggtggggaccacgggaacccaagagaaggtcctccacaaatcccagagccggctcccggccatggagcccttgaagagcctctatcctcaagagccctctagggtcatggaattggcagtggcaagcagaagacagtagactgaggacgacggaggaggcaggcctggcctgaggggagtcatccaaaggcagcagggataatgccaaaccggtgtggacagcctgtccgactaacaagccagtggaggcacaggaattgacagctggcccccttgacgtgaacggggttgacccgcgttgaactgagtgttgccccggagacgaagccagttcaacgaagacgaatagactgtaggacacgaccaggtaagatggcaagcggcaacattacggccaaatatgagaccagagatagtaggaccgcccatgtaaaggtggccagaccaagggaatagggagatagaaacaaggacaagactagagacgacgagaaggcgaacagagagggctgacgatcacagtaaagaaacaaagcagacagcacacagagagacagaaaacagagggcaaaagcaacggaaaaaagagcccagaagcgcacaagatagaaggcagcaaagagaaacgaagccggaaacagagacag

SEQ ID NO: 689685 - DNA, 194 bp, Homo sapiens
actgcgcagtacggatggctgagaccaagaggtgaactcgccaggacgggggtggcagatgggcacttacatttcgacgatgccctctggcaagttggcaggaatctctgtcaagcccttccctcgacagtccacgatgttgttgctgcaagtgcaggctgaagggcaggagatggagtcgcgtttgcgcactg

SEQ ID NO: 689686 - DNA, 178 bp, Homo sapiens
atcgtatatcggtgcctcagagttcgggctggagacgaggccaggtctccagctagggagtaggacgtagcccagccagctagccgaaggccaagacgccaggtaccggtaggacgtgacaagcaggacatgacatggtccggtagtgacgagcgaggactagaggtaggcgctgtcc

SEQ ID NO: 689687 - DNA, 321 bp, Homo sapiens
cgggggggggggggggggggggcggcccggggttgttaaaccctcccccccccctttggggttttccaaggggtttttccccgccaaatttggggggccgggggggggtgggggtatatccccccccagggggggggttttgttttcccccccggggggggggggaaaaacccgggcccgggggtttttttttttttttaaaaaaaaaaaaaaaaggggcccgggggggcccccccccccccccccttttttacccgggggtcctggggccggggaatttttcggggtttgggtttttttacccttttaatttttttggga

SEQ ID NO: 689688 - DNA, 523 bp, Homo sapiens
cccccggaaggcagacggcaacaggagtcaggagtcaacaggatcgcgggttgagcatcgtgcaagtatgtctggatctaagcaaaacaagcactatgaatgaatacctaaatactttagagttaaacaaataaagtaacaaaggaaaatgagagaggggtcaaataatcagaaaataatgatactctgaataaagaacagaaacacatgaaaaagaatcagatagaatgtctcgacatggaaaatatattcattaaaattaaaacctcaaagggtagcttaataacaaggtaggcagagatgacggaagaattaatatagtataggctagagctaagcagttaacatggaagaacacaaagagatacagaatggaaaatatgaaagagaggtaaaaagagatagaatagataacgagaagattcaaaatacactcaaaaggaaaaccaggaggagtaaagaataggcatgggggataagcaaaagtggaagacacatatatggctgggaattttccagagtt

SEQ ID NO: 689689 - DNA, 347 bp, Homo sapiens
catcactccccgtggaaggtaagaactccttcgcaaattattgttttcaagagttttgcgagatcatgaaaaatgcctactgtagtggggaaacatttcaatcctgcatctacatctctgaattgggcatctctgaagcctttcttaggccacaggataaagaggccacgcagatggggaatgaaggcctgccctcctttacatgtgtagttgatctcgtgttcacatcatttgccttgggaccgcctcttactgctggaaccctgccaacaacagtgctcgctgctgcagcatatcctgcaccaacatgcgtaatcaatgcaacctatctgtactgagcatctgac

SEQ ID NO: 689690 - DNA, 392 bp, Homo sapiens
ttgcataaatccacccctgtttgaaatctatcaagccttgttaagcccaacacaacatcatgtagcacttataggaataaaaggacttatgggctcagaattacctaaaagatgggggaagaattctgaatctgaaggtgggaaatcaacagcgaattgtagtaccactccagaagcggagagattttttaccaactccacctctctgactttaaagcaagctgcgatggttccaagcgaaatcctggttccccacgtagcgctgttaacatcaaacaacgtaatcagaattaactgactacgtgagccgcagaccccccctaacggaataatacttgcaaaagccaaaaaagaaaagtttagccctcaataaaagaaaggcgtattccccc

SEQ ID NO: 689691 - DNA, 112 bp, Homo sapiens
tgagagtaggataactagataatcttaatccccctactattattcctatagtccagcaatacatctctaacgttttcattaatgacgtgtatagtaattattagctctgtaa

SEQ ID NO: 689692 - DNA, 422 bp, Homo sapiens
  misc_feature (422)..(422): n is a, c, g, or t
agcacaagaaagtgatgttacaaacactaagagaattcagagaaacagcaggatttaaagtagcacacagagatctttgtgcatactttcagttcaaagacagagtggaagagatgacccatttttaacagcaacaaaaagataaaaatccccatgcgtaaaagaaatgtgaaaccctaaatgggaaaaactttaaatagaccataaagacaccaaagtccgattttaacaccaccatggtttgaatgaattccccaaaagttcatgtgttggaaacctggactccaatgcagcagtgctgggatgggattctggggaggtgttggctcatgaggactaatccattcatggactaatgggttctcagggagtggagcagttatcaccagggggctggttataaaagcccagctttgccgtcn

SEQ ID NO: 689693 - DNA, 187 bp, Homo sapiens
ggtgcccgaggaggcagccaagctcgtggcctgcctcttgcgtgctgctgctcaacggccgtgaaactgctacagcgtgaaggccgccacccgggtcccaggattgccttttgccgccagccaagctccttggcccttggcccttgattcattcttgcttgtggcttttgtccagtatccgggaagg

SEQ ID NO: 689694 - DNA, 314 bp, Homo sapiens
aggaactggcagctttgcaaatgcttttttcaaactttcctgatcctgcaggcaaggtaaaccagttttggaagaacctgcgggagttgcagcagctccgatgggatgagagctgggggcagactgtgctccctttggttatggacatacaactcctgggccaaagggtaaaaccccggggcccctgctgtcctttccccaggtttttttcggagtttcagggcaaacccttttgagcagggcctcccagtggccaaaagctgaaatgacggcaggggggccgcctggtgaatgaattggttttgtggcccgga

SEQ ID NO: 689695 - DNA, 93 bp, Homo sapiens
  misc_feature (11)..(11): n is a, c, g, or t
  misc_feature (31)..(31): n is a, c, g, or t
gatctaaaatnagagaagcatttaaaaaatnatttctgtcttggttcatcttattgttagtggtttatgctaataaaaattgatttaacaatc

SEQ ID NO: 689696 - DNA, 2328 bp, Homo sapiens
  misc_feature (1757)..(1757): n is a, c, g, or t
gctccggccgcagtgttgggactgtctgggtatcggaaagcaagcctactgttgctcacgtattacgtatagatccattgttctctttcaagcatgccgtgagagaagtgcacgcatggcagcaggagcgcaggtggacgacttcttgccgtgttcagtcgcatgaagacttgacccaagcctcagtagttcccctcactcagtcgaaatcaccgtctcgtacttgccaatcacacggcaagacttgcttcccgtctccgcggcaagcattgagctcgtcgctaacctggctgttcctcgacgtgcgcgctatgccgcaccacacgcactctcccgcgtacctgcaccaatgcacatagcaccgcagcacactcggtcatcagcacagatctcgcgcacccaagctcgcgtcacacacgcacgccctccacaccacattcgtcgcaccacttccaatccccccccacaccgcacccttccaggcgtgacactacgaatcaccacaacactgccaccgctaccccggccgaatacggcaaccgaccccacacgcgccccaacttcatgcggaccaccttgcaccctccacaacaagccacccctgcaacttcccttaacaagcttacaaacaaactcacaacctactgcccagcgccggacaaacaccccaaacaatctaggagcacccaaccacgtgcatcctcttggcgctcatccacctctttacaaacaacgctcccaacgttcttaccacaattcgacggccaacggcgcacccccaattccccgtgtacatacccaaaggcctgggcaaccacactctgccggtacctctggtcaccaccacatcggcaaacagaccgcaagcatatccgcaagctttgacaaccccacaacgatatggcccaacacaccttccatgatgtgagggccacgcataacccaaacaagcggactctcaggctcaaccaaggccagccccatcaggcacctattcctcccgcaacgacgacctctcatttgaccaatccgtgcatcgctctcaaccagcattctattagccccgctcttcggagtcatcgctacacggtttaccactccccgcctttccttagcgcaacacgatcagtcagggtcaggcgctcccacaacagcgagacagagcgacaaggaccaaccacagcagggtcgcactccgcgtcagccccgcctacctacagcgcccactcggcacacacaccaccgacagccgccgcaccacgacacggcaccagcccgccgccgcagcccccccacctgactgcaacacctggacaacacacgctcgtccgcccacaccacgtcggcggagctcatcaacacgacctgcaagacgcgacccgagcgccacaacctattgcggacgcaccacacactacagcagaggccgcaacagcaacgcacaacacagcctaaatccaccctcaagaactcgccaccatgagcggcacaaccaacactaagtagcgacgaacacccacggtaccggcccccgactacatacacacactcaccataatgacacgacgcacaaaccccgcacacatacggagacacacaagataccacccacggcgacacgctatcgccacaccaccacactcgcggcacgcaccaactccgcaccgccaacagactacgtggatcaaagatgacacgagaatagcaaacagccacgcaccaccagaccgcgacccacactcgattccagcgcagcnatgcacagtacccaactcaaagcgccccagcccagcgaccaggcagccgactaccccgcccgcgcccaacacaacacataaactcacgtgacccgcagtgcaccagacaaacgatatgactcacacagtcacctctgcccacacgtacggagttcgcactcactcccacgctctcgactacaagacagcgccactgcgcgatccaataacccctcacgcggcacacaccccctactcctaatatatagcatccacaatccactaacaacctcaagcaacaactgcgctaactctaccaacacgacacacacacccactacacacacgcacacacactaaaatacaatactcaactagtacaaacacaaattgatctaaccaccccacaacaacttctccatcattgacagcacacaccaatcaacattccgctccacacagcacacccgcctcctttctagctataacgcccccaagcacgaacatactacactccctacctatctcacctcacacatcaacgaacccacactatccttaccccacactattcaccaccacgcccccatcc

SEQ ID NO: 689697 - DNA, 110 bp, Homo sapiens
ccgtgcactgagcaggcttctctgtagaaccccagggtcttcggcccagaccacagcgtcttgccctgaggctagagcagggagtcccgaacttctgcattcacagattt

SEQ ID NO: 689698 - DNA, 125 bp, Homo sapiens
cccaaacccactcacctacttccagacaaccttagccaaaccatttacccaaattaggattggcgattgaaatttaaccctgcgcaattgattttgctccgcaggggaaagtttaaattttttcc

SEQ ID NO: 689699 - DNA, 864 bp, Homo sapiens
tgacagacacattctggacatgatgttcgtcgtggcaacgtgctggtgacagcaaaaatgacccaccaatggaagcagtggtcatgtcaggatatcagtgagagtgaagcgcgtatgggggagatctatccgtgaaccactccaggccaaataagcgccgcccatatgccccgctatggatcgccacaaggctcacatagacatgcaaattagctgagctgaaggaaaagcatgatcagacagacctggtacaaaagcctggcaaggatggccctacaatcctagaagaacatggagatgctgccataagctagatatggaaatcatggcaacggcccatgattgcagtctgagcgagctaactcacacacatatccaacctaacgagaacgcatcagcgtgaccgtgatatgagaccagaacagacagcggcagcagttgttcagtaaacagccagctggacccaagaaccggacactggatcgacatggaaaaggctcaccacacagcatgcaccaagaacagcgtcacgaaggacaaacagcacactactagtccagaaagtacgcatggccacccccaccacactacaaaccaagatggcaggaacacgaaaccgaggcatccagcaaccagcgctaggtaccacagtggagcccatctaagagttcacgacagaaaccaggaaatggcacaccggaataacaacgccactcgtccacaccacagcgcaaggaccgcgcacaagaacgacggaccaccaacaggcacaccaacagcaggcccaagcaccaagcaaatcaccacgaacaaccgccccaatcgtagggccaccacctgcaaccaaaggtaccggccctgaca

SEQ ID NO: 689700 - DNA, 345 bp, Homo sapiens
ggagttggcaaggtccccaagtttgcccagaaaggtcagagggctaaatgaatattatccctaatacccgccccccccctcttaatcagtggtggaagaacggtttcaaacccgtttgtttcaattggccacttaagtttagtagtaaaagccgggttaatgaaaccaaggcgtgggaaacccttcagaaggaaagaagaatgttttggcgccccctttggttttttttttgggggggggcgggtttaaggtattagtttttaaaaacagcactttttaaggggaacaacttgcccaaaaatttgtcccagaattttgggcccccttcaaaaagttaaatgggga

SEQ ID NO: 689701 - DNA, 430 bp, Homo sapiens
  misc_feature (2)..(2): n is a, c, g, or t
  misc_feature (18)..(18): n is a, c, g, or t
  misc_feature (23)..(23): n is a, c, g, or t
  misc_feature (52)..(52): n is a, c, g, or t
anccccggtcactctagnccagngaaaacctgggctctgtggacatcaaaangagcaaagaaacaataaaaagttgtagtagactcactcactctatctacacaaaaagacgtctttggggcccgcatgctttccctggacagaaaccggacctcctcatcttgcaagcctgttgccctctcagaagccgtggatcgtctttcctaagtacagagttgaccttgaagttgtgaaagtggaagctcaagtggagcttacttcaaagctttggagattatctcactaaccagcattactttgcagaagtgggactaaggctcggaggctgggttgcttggaggccaagccagttccagaacccaggattttgactctgccccatttagctcaatgcagtgccgccttccttctttgactgtggactagagtg

SEQ ID NO: 689702 - DNA, 150 bp, Homo sapiens
aaggctcttgtatcttcctttactactgtaattgggtgtctcttcctgaatcttaggctgcagataaaattaatgtcccttattttcctgccatgttggttcgaaattgtcctgctttaggttatgtcctcagtctggccatctttccaa

SEQ ID NO: 689703 - DNA, 396 bp, Homo sapiens
tattcgtgttcggggttggaattcacgctggacttgcggttggatggctctgatctcccagggaggccgccggccccgtcgctcgtccgatgtgcgctgtccggccgctgatccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccatgtggcagagctggagcggcgtttccccggtgcccgggtgccatggctcagtg

SEQ ID NO: 689704 - DNA, 628 bp, Homo sapiens
gccgccgacaagaggaggctgacctaggcagatgtttggacagctggcacgttccagtaacatcatgtccaatgaaacaatcggtacccttgcctttctcacatcagagatcaagtcactctttgtgcatcccattcctggctgagcgcatcatctccatgttgaacctacttcctgcaaccaacctggttggcccccagagatgggctgccttaaaagtcagagggacttcagcgacattgacttcaaacccccagcagcgtatgtatcagatatctgcaactatcttacgttaaatcttggggatgaggagaatttctgtgccaactgttgcccaaggatggacgtcctattcccgcaactctcttgggcacagacagttcgaggtctatgaaggaaaaaataaatatcgcctgggacattatggttcatgggcgtcttcagcaactttggaccgaagagaaatcctagttctcttggcagaacctgcagacaatcaggaagcagggagaaaccctattggcgggatgcctggtggattgaggtttccttggaatccgccaattcatggagcaccacctggagtgtggtggaccctggtggttggcttgcctagtctttcccaaaa

SEQ ID NO: 689705 - DNA, 1370 bp, Homo sapiens
  misc_feature (120)..(120): n is a, c, g, or t
  misc_feature (1370)..(1370): n is a, c, g, or t
gctcacacacacacacacacacacacacacacacacactagtttcgtgccttgcgatgaggcggggcagtgtgtataatggaccccgtggatcttgctacctatcagcggttcctatacntctgtcctctccctctcctggctctgcgtgtcgtggatgtcgtggcaacgcggtgggctgtgctacacgaagcggtccctaggccgctgtgtcgctatgctccaggccacgtgcgcctgacccatgcggctcctctgcgcaccaatgtcccagggcaggacgcacgcgtgctttctccactcctcttcccagaccaacgtctctactttactatcacatagtgacccctcttagcagacgcgtctcaccacggccacgtctcagcggctgctcccatctactcccctctggagcgcacagcacgcgccaggcaacaattcctccccgggctccctgctccatgcctactttcctccatcccagatatcagagctgtccagagaccatcttactcctgccacccatacaagagacacttatacggccagagatttcacacttaagcgccagagcacgtttgcgcgcctacagcgtcatctgtacccttcctgcgcccacttcactgcgcagcgctcacctgggcgactcaccacgctgaacctgcgcgagagcaccgcaacgagcactagcacgagcctaccccgctgctgacctaccacccagcaccgcccctcacgccccgcgcgccgccctcggcgcacacagcagcaccacacacgagccaccggcacccgccacctcctcaccccgcgctgcggccaccgaactccactcagcgacgcaagaactcccaaagcacgcggagcaaaagcacactgcgccaacgacatcaccccccgaagggacaccaaccacgcacccgcaaacggccccaccagcaacaaccaagaaaccacaccgccacaccacgcccgcctacgcgagacaaacccggcgacacagaacaccacgaccaccaccccgctgccccacaccacgcgcgcccaccacgacagcaccgaccctcgcccccggccacgaccccccaccccacgcacacacccaccagacgccaccacaacgccgcaaaacaaacacaccacccgcgaacacccctacaccgccaccgacccaccccagcacgccaccaccccacacgcacagacgcccccaccgaaaaacccccagcgacaccctctgacacaacgactacggacgcacccaaccgcccaccccacaccacacccacgacaacgacaacaaccacccatcacccacataacacgacacggcgcgctgcgacgacccaccaacccccaacccccccgccn

SEQ ID NO: 689706 - DNA, 101 bp, Homo sapiens
gccccgggggtttttccaaccccaaattttaacgggttttttttcaaaaaaaaaaaaaaaaaaaaaatttaattttttaaatttaatttttttaaccccca

SEQ ID NO: 689707 - DNA, 438 bp, Homo sapiens
taacctactaatgcctaatccaaggttcccaaatcgcccgcacatccacaagcacataaagttttttgttacctagtggccgatttcggatagtaggggtaggggcggatactagggatagggtaaggaggaggccattttggtctgaaggttttattttatcgcgcctaacggggatgctttacggagtgtattctgggttaggggcggtttttttgtaggtcgcgtaattcgctgccgggtagccctcgggtggaccgagtaggggtttaggggggggaatcgcccgattctctaagggggggggggggggggggggggggggggggggggaaagtttgtgtataaatgatttttttttaaatgcggcgcggtcgttctattgggacccgcggggttaatggccttgggttatatatttaaatggatggtggctgg

SEQ ID NO: 689708 - DNA, 126 bp, Homo sapiens
ctgtgaacgcaacatcatagacacgaaagggtcattcctgggtgtcctcacccaagaaaaagatggaggcatgttacacacaagatttctctttttttaaacgatacactaaaattgaaaactctc

SEQ ID NO: 689709 - DNA, 154 bp, Homo sapiens
tagggcagtgtcataggagcccaagccccaaatacagaagccaacccctgggatagtagaggagccaggcctagccggggccacccccaccattaggctaccagccctaactgagaaactagcacccactagcgggtactctacctagtaccag

SEQ ID NO: 689710 - DNA, 355 bp, Homo sapiens
  misc_feature (58)..(58): n is a, c, g, or t
  misc_feature (171)..(171): n is a, c, g, or t
  misc_feature (336)..(336): n is a, c, g, or t
ttgaaagggcaagattttacctttcaccccaggttattggggtctcctagtttggtgntcccatagtcccatagttcctcatggttttgtttgtttgtttttttgtctgtcgccccaggctggaagtgcagtggcacgatctcggctcactgcaacgtccacctcccgggntcaagggattctcctgcctcagcctccctggtagctgggactacaggcgcgtgccatcacgcccggctaattttttgtatttttagtagagacggggtttcaccgtgttagccaggatggcctcgatctcctgacctcgtgatccgcccgtgtcgacctcccagntctcatgttttatctatgg

SEQ ID NO: 689711 - DNA, 302 bp, Homo sapiens
  misc_feature (48)..(48): n is a, c, g, or t
tataaagaaacacggtatggtccaaggatctacatgaaggctggaacntccttaactatgttacattatggtcaggcacacacagttcagccattggactttagtggcttaaaagaggttagaacaagatcagtccttgatactatgaagaatattcatccaatttataacattaaaagcttaatgattaagagagagttggcaaaagcattcgtgaacgttacgactcacaaagattgggagagactttatgccacagattcaaacacaaagaatgtgaataaaacgcgggtgaaacttcg

SEQ ID NO: 689712 - DNA, 179 bp, Homo sapiens
tcccatcatcgctcctcgccacccattcgcatgtctctttcccgtggatccatgtagcccattcggctgtaactttcctctcttgggcgcctcattggttcttccatctcacgttgacgaatcatcatctcttcctctcttctacgtcgttcctccccttgcctcaatggcatttcttt

SEQ ID NO: 689713 - DNA, 594 bp, Homo sapiens
tgaacatttctcaaggcagcttgagtgctctctgaggaaacactggtgtcgagcatggtgatgaggagacttcgagtgcagcagctgatacacctgggattggatggggcttatctgtgcaagcttgaaagtcgttctcatctgttaaagtgacactttcactagtttctttgcagatgggtttctggtagcaattaatgtattgtgttttcttttgcagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctaaaaaaaaaaa

SEQ ID NO: 689714 - DNA, 1092 bp, Homo sapiens
  misc_feature (1)..(1): n is a, c, g, or t
  misc_feature (321)..(322): n is a, c, g, or t
  misc_feature (324)..(324): n is a, c, g, or t
ntagaaaaaaaacaagggagcatcaaggaagaaaacaaaggcgcctcttccacacgtcccccaaacaacgcgggggaaccccggccctgcacacctcagggcgagaacccccaaatgcaacgggaagcttggtcctataagaaatcccaaacggccaaaagaaactctcacctggtctaagcagcgaagcaatactgaggacacggagacaccagtcgtcactcaagaagaaattcaaatcaccagagaagagagataaagaaggagagactgtgttgttggaattgcctgtaacatgaataagaagaagctgaagtcgtnntntaaagagtatgcacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctaaaaaaaaaaa

SEQ ID NO: 689715 - DNA, 995 bp, Homo sapiens
  misc_feature (23)..(23): n is a, c, g, or t
  misc_feature (62)..(62): n is a, c, g, or t
  misc_feature (92)..(92): n is a, c, g, or t
  misc_feature (112)..(112): n is a, c, g, or t
  misc_feature (164)..(164): n is a, c, g, or t
  misc_feature (166)..(166): n is a, c, g, or t
  misc_feature (224)..(225): n is a, c, g, or t
  misc_feature (227)..(227): n is a, c, g, or t
aggcttattaggaggagaaatcnccagaaacaagggcagaaaggaaaaattctcaccctgtnttaaagtaggagatagaaaaatacttgttnaaacaggaaaaacagttttnagtcaaagaaagaaaattcaattcaaccaagaagaagagagattaaagaatnanagaactgtgtttgttgggaatttgcctgtaacatgaataagaagaagctgaagtcgtnntntaaagagtatgcacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctaaaaaaaaaaa

SEQ ID NO: 689716 - DNA, 163 bp, Homo sapiens
  misc_feature (2)..(2): n is a, c, g, or t
gntgattatgcatcgaagaagtgcccatgcctcaagctgcttgaccacaggcctgtggcaagccgccatgtttcacctccatctcaatctctccgtccaagtcatggaagaatattcttcagcgtctcttgactgcacacacgtgtccacaacaggatacggg

SEQ ID NO: 689717 - DNA, 134 bp, Homo sapiens
tggagaaatcggaagaaatccatgtgtgtattgccagcctccacatcgggcgggggcaggtccgggcgggggcttagcgctggccgtcctctcacggggccaccggggagtctgtgcccatgcaagaagggacg

SEQ ID NO: 689718 - DNA, 449 bp, Homo sapiens
  misc_feature (174)..(174): n is a, c, g, or t
  misc_feature (185)..(186): n is a, c, g, or t
  misc_feature (257)..(257): n is a, c, g, or t
  misc_feature (339)..(339): n is a, c, g, or t
aagctaggtggagcctggtttgaatcggagaggtcttctgggcattgccatctgctgctgctgctgctgcaggaggaagaggagccggaagccggacaggagtgaggagaaggccatgcgtgagcgggaggagaggcggatacggaggaggaacggagagcagagatgaagacnagaatgatganntcagaaaaaaatatggcctgtttaaagaagaaaacccgtatgctagatttgaaaacaactaaagcgctccngcacatcagtcccgacgcttcctgtgaggtgcacgctccgcagcccatgccccagcctgggatgaaccaacgttgtgccaantttgcgtgtctccctgaactccttggcccaagtgaaacgctgccagccttccatggacaggcgtgcggagaagctgcccctgaaggacagtcctctcgtcttgcagactg

SEQ ID NO: 689719 - DNA, 941 bp, Homo sapiens
  misc_feature (23)..(23): n is a, c, g, or t
  misc_feature (62)..(62): n is a, c, g, or t
  misc_feature (92)..(92): n is a, c, g, or t
  misc_feature (112)..(112): n is a, c, g, or t
  misc_feature (164)..(164): n is a, c, g, or t
  misc_feature (166)..(166): n is a, c, g, or t
  misc_feature (224)..(225): n is a, c, g, or t
  misc_feature (227)..(227): n is a, c, g, or t
aggcttattaggaggagaaatcnccagaaacaagggcagaaaggaaaaattctcaccctgtnttaaagtaggagatagaaaaatacttgttnaaacaggaaaaacagttttnagtcaaagaaagaaaattcaattcaaccaagaagaagagagattaaagaatnanagaactgtgtttgttgggaatttgcctgtaacatgaataagaagaagctgaagtcgtnntntaaagagtatgcacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctaaaaaaaaaaa

SEQ ID NO: 689720 - DNA, 257 bp, Homo sapiens
  misc_feature (37)..(37): n is a, c, g, or t
  misc_feature (58)..(58): n is a, c, g, or t
cgtcgacgtccagtctttgtctctctgtgtctctgtntctgtctctctctccaatcanttctccagcaccacacctgcctactattatgctccctgccactatggaaatggactaaagcccttttctgaactccttgggcattgcacacatgtgtgtgcacacacatacactgagacaaagacacacacagagagagggggaagggaggtggaggagggagagggggaagacggaaaggggaagagggggtcgacgc

SEQ ID NO: 689721 - DNA, 432 bp, Homo sapiens
  misc_feature (309)..(309): n is a, c, g, or t
  misc_feature (357)..(357): n is a, c, g, or t
  misc_feature (417)..(417): n is a, c, g, or t
aaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagtttttgcaggtngtaaagccatttaccaagattagttgttagggtaaagaaggggccagntttttttaggaggaatttgttgaaaatatgtttgcagttgggcagcttccagccaggagnagggggcttacctaa

SEQ ID NO: 689722 - DNA, 1071 bp, Homo sapiens
  misc_feature (1)..(1): n is a, c, g, or t
  misc_feature (321)..(322): n is a, c, g, or t
  misc_feature (324)..(324): n is a, c, g, or t
ntagaaaaaaaacaagggagcatcaaggaagaaaacaaaggcgcctcttccacacgtcccccaaacaacgcgggggaaccccggccctgcacacctcagggcgagaacccccaaatgcaacgggaagcttggtcctataagaaatcccaaacggccaaaagaaactctcacctggtctaagcagcgaagcaatactgaggacacggagacaccagtcgtcactcaagaagaaattcaaatcaccagagaagagagataaagaaggagagactgtgttgttggaattgcctgtaacatgaataagaagaagctgaagtcgtnntntaaagagtatgcacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaaaagtggcctcgttggcctcat

SEQ ID NO: 689723 - DNA, 84 bp, Homo sapiens
gcacgagacaaaactcaatttgacacaccctctgtaaaggcaatgatgtgcaccttgcagatgctcaataaagtaattactgac

SEQ ID NO: 689724 - DNA, 423 bp, Homo sapiens
  misc_feature (71)..(71): n is a, c, g, or t
  misc_feature (235)..(235): n is a, c, g, or t
  misc_feature (241)..(241): n is a, c, g, or t
  misc_feature (299)..(299): n is a, c, g, or t
  misc_feature (382)..(382): n is a, c, g, or t
  misc_feature (388)..(388): n is a, c, g, or t
  misc_feature (407)..(407): n is a, c, g, or t
gaggggcatgctttctttcctgataggtctttactgtccctagtgggtcattcacagttgcacgtgaacgngcatggaacaaaggtaaaagggggtacacacacaggcctgtgcatgcatgtggttaatacttttacggagttaaccgaaaatatgtaaaacagataatctgcttaaagaaaagttttctatacagtagacgagacactgtggatacatagaacaatgcttgtgnaaatcnaaaagaaagaaaaccagaacaattcaatattcttaacaaataaataagaccaattggnatagtaagtattttaaaaagatgataggttactactggaaacccccttcttaaacatggccaagggactggatttaatatttnattttnccagaccagtacctacatnttggaagatttataat

SEQ ID NO: 689725 - DNA, 838 bp, Homo sapiens
  misc_feature (23)..(23): n is a, c, g, or t
  misc_feature (62)..(62): n is a, c, g, or t
  misc_feature (92)..(92): n is a, c, g, or t
  misc_feature (112)..(112): n is a, c, g, or t
  misc_feature (164)..(164): n is a, c, g, or t
  misc_feature (166)..(166): n is a, c, g, or t
  misc_feature (224)..(225): n is a, c, g, or t
  misc_feature (227)..(227): n is a, c, g, or t
aggcttattaggaggagaaatcnccagaaacaagggcagaaaggaaaaattctcaccctgtnttaaagtaggagatagaaaaatacttgttnaaacaggaaaaacagttttnagtcaaagaaagaaaattcaattcaaccaagaagaagagagattaaagaatnanagaactgtgtttgttgggaatttgcctgtaacatgaataagaagaagctgaagtcgtnntntaaagagtatgcacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctaaaaaaaaaaa

SEQ ID NO: 689726 - DNA, 639 bp, Homo sapiens
gtcacttcgtggctagggtacgaacgtgcttgtgggagacaagtctggggcttggtgagtctgtgtgtggccagcatgcctctgatactgtgcagggtattaagcgtgtcagggcctgagtgttctgggatttctctagaggctggcaagaaccagttcgtctagtcattgcgggatctgctcgagggcttggtaacacgatccacacgcctccgttaaggtacaccaggtttccatttctatagtctgatgtcttttgtgctcagtaacactcgtgggctgttacttgcttctgagcttggaagcggtttgcatttacgcctgtaaatgtattcattcttacatcttatgtaaggtttttacttggtacgcaattctcgattctttgaacgagatgacaacaaattttggttttctactgttatgtgagaacattaggccccagcaacacggtcattggtgttaacggtacacaactaacaagctgcctgggcgaaaaaataacacatataaagacagacaccataccacacacaaacacaccagagcgtggcgcgcgcgcgccgcgcttcacctgaggcgagggtcaatccacagctccagacagaggggtgcccccacaaaggggcactttaacgc

SEQ ID NO: 689727 - DNA, 114 bp, Homo sapiens
agattttgaggctgcagtaagccataattgtaccactgcactccggcctgagcgacagagaacaagaccctgtctcaaaaataaagtgggggaaggggtgcaaaattacactgt

SEQ ID NO: 689728 - DNA, 268 bp, Homo sapiens
tatccacatcatgcccaggacccatattacgctgaggcactttaagtacctgatctgctaccctgactatacctggactacagctacatctcattgccgcccttcttcccaatcacaaagcctcctttgcgtcctcctcttgatatccccccaccttaacccacaagtataagacacctctactccctcctatggcgactgatcatgcaccccttaccatctcattgaaacctaatcatccttaccccacttaacgaccgtatccgca

SEQ ID NO: 689729 - DNA, 255 bp, Homo sapiens
taagtacgatattagtataatcatttcagccctcataataaggtattatacatgtcaagatagctaaaagaatacgttttcaaatgtcttcattataaaaaataagtatgtgaggtgatggacatattaatcagcttaatataatcatttaatagtatatgtagctatatcaaaacatcacattataacccataactacatgcaattattatttgtcaattaaaaatacaaatctaggccaagatttactcatcg

SEQ ID NO: 689730 - DNA, 1233 bp, Homo sapiens
  misc_feature (3)..(3): n is a, c, g, or t
  misc_feature (12)..(12): n is a, c, g, or t
  misc_feature (15)..(15): n is a, c, g, or t
  misc_feature (691)..(691): n is a, c, g, or t
  misc_feature (699)..(699): n is a, c, g, or t
  misc_feature (732)..(732): n is a, c, g, or t
  misc_feature (789)..(789): n is a, c, g, or t
  misc_feature (851)..(851): n is a, c, g, or t
atntcggcacgnggnggagggagaagaaatagaagaaagttctgcaacaaccatgtctgagaacttccagtattaatgtcagacaccaaaccaaagatccaggaagctccgagaacaccaggcagaataaatgccaacaacctacacttggacatataattttcaaactatatgaaataaaagataaaggaaaactctgaaagaaaccagaggtggggcagaaaacaccttacctacagagacacaaagataagaactgcattcaacattgcagaaactgtgaaagcaagaagacagtgaaatgaaaaattcaaaatgttgacagaaaaaaacccaccaacctaagtttctgtacccactgaaaacacccttcaaaagtgaaggagaattaaggccttcctcagaaaaataaaaattcaagaaacttgttgccaggagacctgtcttgcaagaaattttaaatgaaattctttagggaaacaaaagatatgtaactgaaacctggatcaacatttttttaaaaagagcattaaagaaagaattgtggtacaataaaaacctatgtatttattcttaattgatctgaccaagaagttcatagacaataacaaatacacacagatagattatgtatgcttatacacaagttaaatgagtaacactaatacaaggaatggaatggaaggatggnagggaggnattgtggtacaataaaaacatgtatttattcanaattgatctgaccaataagtttgtagataataataaatacacacagatagattatgnatgcttatacacaagtgaaataaggaacaataatacaaggaatggaatggaaggatgggagngaggaatcaggtgttttctttgttaagcaggtagtcacccgtgaagtgggatagtgttatctgaaagtggacttgaattggttgtaaactgtatattgaaggaacttaggtgtgttctttgttaagcaggtagtcttatttgggggaatagtgggataagtgttatgtgaacagtggactttgaactgggtcgtaaactggttcctgagcgaattagggtgtattgatggtaacgcagggtagtctaataagggggaataagttggaaaagggtgatctgaaaagtgtgcctgaaattgcgttggtaaaggttattggcaattccgggtaacaccaggttaacaacacaggtcttaacagagaacatacgtgtctacaaaag

SEQ ID NO: 689731 - DNA, 134 bp, Homo sapiens
tatttctgcaccagatttaaataactaggaggaatatataatccaataaatgattaccttctctggcaggtatccccagcagtcaattaacaataagccagtataaaccacctaaataaccaatctgtcaatca

SEQ ID NO: 689732 - DNA, 444 bp, Homo sapiens
  misc_feature (167)..(167): n is a, c, g, or t
  misc_feature (222)..(222): n is a, c, g, or t
agatgttatgtaagtagttgggttgagatgacatatctgacactctatgttaccctcagaagctactacatgtgaaattctaatgactgcattatcctgccaaggtgaaagaggcaggcatgagcaaggacagttaagaggggtgagagcctcatcatgatggggangtctgttctgacatcttgggaaaaactgtccacagtgtgaagtcatccacttgtngtcctggtttacagtttgagcatctgtggttatggtgtcgaacattttagtgagttctgagtggctcacccttcaggtacaagggttttcccatgaaatttacattgagttgtccacctccagcttatagggcttctggaacagagtgggtctttttcttagcgattccatggaagaaaatggaattggaggaactagtagaattcagggtaatgtccagtc

SEQ ID NO: 689733 - DNA, 195 bp, Homo sapiens
gtctctgctccagagatgtatgctgaaacctagccatggtgatggtagtaagaagatggggctattggaagatgattaggtcaggtggggctttgtgagatgtggatgatgtgaagcatccaagagctccctcgccccatccatgctaggggaaggacatgtgggatgaagacatcctccgatgcaaccatggac

SEQ ID NO: 689734 - DNA, 206 bp, Homo sapiens
  misc_feature (115)..(115): n is a, c, g, or t
  misc_feature (120)..(120): n is a, c, g, or t
tcaactgggtcgagtctaacttctatatatcattacccatcatccagcttcaaaatataggcgtttgtacttcccttttccctttacttatctacatattcctttccattccagnctaancatataccagtcacaaaagtttctaggcatagtcccgtaataaatgtcggtgtcccctgtattcttcaagatacggtcccctggta

SEQ ID NO: 689735 - DNA, 204 bp, Homo sapiens
atcttgaatgaaaaaccagctatggcacatacatgcaattaaactactagttagccatagaatgcgatgaactgtctgatacgggaccacccctctggataagtctcgaatatcatgagagacacatttttgagggtgatgtagctgttctatatcctcattgtcctaatgacatgcctctatacatgtcctgaaattcacaga

SEQ ID NO: 689736 - DNA, 651 bp, Homo sapiens
gagacgccctatttctatgtcattgttaactgtatctattgtgtacaagtctctcaaagtgtcttattgtagtgatgacatatagaagtatcagctattctagacatgtaagagaatgttacggcatcacacttatattggatgaacactgtactgtggctttaatatgagcttcagatataggaagcaagtcgttgaaatagaaaaaagattttgttggtaattctgggttggattcttaacattgaagacaaacgttgaagtattctaatgagtcgcatgtaatattgcgtaattatagagttgtgatcttgttaataaccctatttatgatctgttgtgtgtctgtctgctgtgcttctattgtgttatttaaaatcaaatactgttgttacaaagtgtcttggttcaggacaagcattctgtaacatcatgtaacagcctttcctgtacattcttggtgttagcctcctggcttctcttcacacacatcttgctaaaaaagaaggatgtgaaagaactaggtcagtctatgactttgcaatatgtggttatatagtatgcatttatcttgtatatcagtaattcgatggttatgagagatgaatccatgagggaatggagctatcagaactctaatgttccaggtat

SEQ ID NO: 689737 - DNA, 754 bp, Homo sapiens
tggtaccggcccggaagttagggatggaaccgggcgtgtacatcatccaatcctagcatgccctccgtgctgctggtcgccatgtggtgggtctccttctggatcagccaggcggcggtgcccgccaggatgtctctaggcatcacgacggtgctgacgatgacgcacgctcatggtctagtgacccgctcgtccctggcgcagggtcatcagacatcaaggcactggacgtctacttctggatctgctatgtactgtcggtgtttgccgccgctggtggagtacgccttgctcatttcaagcgccgatctacaggaagaagctagaaggccaaggtcaaggtctccaggccgagggcagagatggacgtgaggaacgccatttgtcctcttgctccctctctgcgtgccggcgtgcacgcaggagcgtggccatctcccgtcggcagcgccgtgatcccggggaacctgatgggctcctacaggtcggtgggggtggagacaggggagacgaagaaggagggggcaagcccgctcaggaggccagggggcatccgatgcccggctcaggcccagtcgacgcagacaccattgacatttacgcccgtgctgtgtgccctgcaggcgtttggggccgcccaagtgtcagtctactgtggctggcatacgccgatgtgagcacaggacgtcaggccgaccatcgcttgtccttggtcgcccggcggatgcatggccaggaaacttcctgggaggaa

SEQ ID NO: 689738 - DNA, 704 bp, Homo sapiens
  misc_feature (2)..(2): n is a, c, g, or t
  misc_feature (33)..(33): n is a, c, g, or t
  misc_feature (552)..(552): n is a, c, g, or t
  misc_feature (657)..(657): n is a, c, g, or t
gnggatcccccgggctgcaggcttgcccttttntctcaagtgtattgaattccatgttcagcaaatgggaccgttcccgtcttcaccctccctttcaacatggcgttgccaatgtacctttcagccacaggacattacaatccattctttccagccaaactggtcatacctataactacagttccaaaaatctccgggcctgacctaagggccctgaagtggtggaaaccattcccaagggaagtgggccaaacctatggctgagaaatccatgcacagggccatttcctgggagccacctactctcctcaactcatgtcctgcatgctgccaaggacattgctggcatagcagcgggctcagtctttagccccatttgggacatctactgggactctggggttaaacagctctgtgcctgcattgcaatgggaggaatgttcatggcgctcacctggcaaacccacctcctggctcttggctgcgccctgttcacggcctatcttggagttcgcatggcaaactttatggctgaggttggattgccagctngcacctggcccttttgtttgccacgctattgttctcatcatgaccacaattccaacatctacaagatgccctcagtaaagtacttatcctgaagataccgcattntctacctgcagccaagaaagaatggttggccctttgtgagcgcccct

SEQ ID NO: 689739 - DNA, 177 bp, Homo sapiens
ccctcagcaccttggccagctccttcccctccttcaagtctttactcaattttcacttaggaggccacccctgaccattctatttaacattgccatctgtccccatgcccaccatgctcatttcttctttctttactttcttctttcttttcttcaagatctcactgtcacgaaggc

SEQ ID NO: 689740 - DNA, 336 bp, Homo sapiens
  misc_feature (44)..(44): n is a, c, g, or t
atttagaaattcatcccctagaccttatacttgtttgtggtgtncctttcaagaccttattttttaaattaaaaacattgtttttaagaagatggggtcttccctctgtcatcctagccttgaagtacagtggtgtgatcatagctcactgcagtctcccaactccctgggctcaagtgatccgcctgcctcagcctcccaagtagcttggactacaggcacatgccaccatgcctggctaatttttaaaacattttttgtagagacaaggtctcgctatgttgcctaagttggtcttgaaatcctgacctcaacagtcctcccaccccaccctct

SEQ ID NO: 689741 - DNA, 347 bp, Homo sapiens
caggaagcgagcactcagcaggctaaagctgaggctcaacagagatatagtgatctctgtgcgcatttataatctggtccagaaggctctcatgcctgctgcaataaagctctatcgggaaacaaatgaaccagtgccaatacccggacctttaatacatgtacaggcggcttgcttctgcctagcgataccaagaggtctcagatctatgggagtcgccagattatactggagaaagaggacaacagaagagctgctgaagcaccattacctgaggccctccatgttcgcgtacccagaggaagcgctggcgattgggagcttaaccctgttcagtgctctgcttt

SEQ ID NO: 689742 - DNA, 149 bp, Homo sapiens
tactgatttttggatggaaaaaaaaaaaaatgtcttgtttttcccactagattgtgagctccttaagggcaaagccatgaattatacctctttgtatccccagggccttgcaaacagtaagccctccataaatattttatggtgatgga

SEQ ID NO: 689743 - DNA, 143 bp, Homo sapiens
ggtgatactgtggggggtgttggaggtcactgtaactctgctgtggttaaggtggggtttcttgtttcttccttctttagctgaccgtgctgttgcctgtctgccatgttgctgcctggtggtggccgtccaagacggggccg

SEQ ID NO: 689744 - DNA, 472 bp, Homo sapiens
gtcaggaagtgactcacaatgactcaagctaccacatactgttcattgtgaaatgccagttgaagcatatgtcctgtgagcttaggggtgctacaagttgaccactgcagcagtaaagatgattctgaagaatggcatgggatggatcctttcgaatgcacttgagcagcggtctccaaccacagggccacagagctggaggtgagcagcagctggatctaccatgaaagacttctgaatccaggaagagagactgactgggcaacatgttattcaggagatggggtctcaccctgtcgcccaggcttgagtacagtagtgctatcacagctcactgcagccttgaactcctgggctaaggatcctcctacctgagcctcctgagtagctgggactgtagggtctccctctgttgtccaaggctggagtgtagtagtgctatcacagctgactgcagcctcaaccttccagg

SEQ ID NO: 689745 - DNA, 394 bp, Homo sapiens
ctcatatgctatcctgggattgccttgtctgaagctatgggtctctttgtttgatggttgctttcttgattttgtttgccatggttaacaaattacgtgcgttgacatgtggcattcatattaattacggatgtaattctgtgtatcttactgtgagtccgaaaagctgtagatatgggtgtcgatgggaatgtacgttatttgccaaagtcgatttcagttaaaagatgaaaacgtttaatgttcaaagagaagacaaaagagaaagagagacatagaacggagaggtacgagcaaaacaagaacacaagaattagagagcgaaacagaactaacaaccgaactagagataactaacagacaggattagaagacaatgagaagagcgcgcaac

SEQ ID NO: 689746 - DNA, 443 bp, Homo sapiens
gcagcaggctgtttgctctttgatcaaaatgacaaggtcatgcggcagaacctggtgtattaccagtaccccagggacacgtggggcctttcagatgagcacttccagcccagacctgaagcagttcagttctttaatgtggccacactccagaaggagctgtatgacttcaaatgatccatctgccttggcctcccccagtgctgggattacaggggtgagcccccatgcccggcctctttttcacctttacacctgtctttttatcctcacatctgttttcaccccttcatccctgttttcctcatgttcacccttgttttccccatgttcatagctgccttttttaccattttggtttgaagggcagttttttctggcgtgtttttttgtttttcccaaaaaatcagtattattttttaaataaaaaaaacattcctaga

SEQ ID NO: 689747 - DNA, 312 bp, Homo sapiens
caaccaaaaccaaaaccaaaaaaaaatggctggcaccgttgcttcacacttgtatcccagccactttgggagcccgaggcaggtagatcgcctgccaggagttcaatgccagactggccaacatggtgaaacctcatctctattaaaaatacaaaaatgagtcaggcatggtggcagagacctgtaatctcagctactcgggaggctgagggaggagaatggcttgagcccaggagctggaggtttcagtgagccgagattgcaccactgcactccagcctgggcgactgagtggagcggaactctgtctcc

SEQ ID NO: 689748 - DNA, 133 bp, Homo sapiens
agccgcgcgtccagaatcatagacgagctcttccaggacaggttcttcacccgggagacccaggatacctaccactaactgcccttcagcctgccccaacggaggcctcacttcttctttcccaagtcccggt

SEQ ID NO: 689749 - DNA, 113 bp, Homo sapiens
atccggaggcagtcacggaatggagaaggctccctgagtagaggtcaagaaaccctgaaggttggtgttgtggctcatgcctgcaatcccaacactttgggaggccgaggtgg

SEQ ID NO: 689750 - DNA, 423 bp, Homo sapiens
  misc_feature (1)..(1): n is a, c, g, or t
  misc_feature (69)..(69): n is a, c, g, or t
  misc_feature (75)..(75): n is a, c, g, or t
  misc_feature (96)..(96): n is a, c, g, or t
  misc_feature (101)..(101): n is a, c, g, or t
  misc_feature (103)..(103): n is a, c, g, or t
  misc_feature (133)..(133): n is a, c, g, or t
  misc_feature (203)..(203): n is a, c, g, or t
  misc_feature (236)..(236): n is a, c, g, or t
  misc_feature (256)..(256): n is a, c, g, or t
  misc_feature (274)..(274): n is a, c, g, or t
  misc_feature (315)..(315): n is a, c, g, or t
  misc_feature (385)..(385): n is a, c, g, or t
naaggggcaagaagcatggccaccgaggctccagcttaacggtatttggaggtcagcacggtggctcanagaagngagggagctgtgtgccagggnggggngnaccgcagggggtgaactcggcgtgggaggngggcggccagggtcaccagcaggcagtggcttaggagcttgaagttgaccgggtccacccgaagcttgtncgcgttcaggtcgctcagggcggacagcgcgtngggcatgtcgtccacgtgcnccacggcgttggtcagcncgtcggccaccttcttgccgtggcccttaacctgggcaaanccgtggctcaggtcgaagtgcgggaagtaggtcttggtggccgggaaggacaggaacatcctctccaggncctccgcaccacactccgccatcctgcgcacccgacct

SEQ ID NO: 689751 - DNA, 284 bp, Homo sapiens
  misc_feature (5)..(5): n is a, c, g, or t
accangaaaatgaaaggaattgaaattaagagaagggagagattgaagtgtggcgctaagattgtgcaaaaaaagcagcatctggatattagaactgaatcaggtcatgcagtagcgctctgaggacaatgcccggcacaagcagcccctggaggtagtgctgcctgaaccattcaggacaaaaataaggagtatcgagagactcaatcgcctgagttccaggcggaggccaagcgccgttggcattattaaaatcagctgagtaaggtaagaaacaattatga

SEQ ID NO: 689752 - DNA, 459 bp, Homo sapiens
  misc_feature (121)..(121): n is a, c, g, or t
ggccgccatcgtgccagcccctcgggtgagtgtcggggccagcacggccggggcggtgggctggggccgcaggaagccgctctctggggctggccgggagggctccgctgaagagtccccnggggcggcccccctcgcacgtcacgcaccccacagcaggcaccaagggggaggagagaggacccccgggaaaaaaacacccggagcgccgggggggcccccgggggccacaatgggtgggtacacacaagcgcgcgagggacatccccagggactttcacgccgggcacgaggggcaccccgtggattagaacaggcgccgcgtggcaggagacacaccaggggcggggcgtcatacaacgaggagaacaacacgaacggagacagagaaaagggccccccaagaacacaccacggggggaggccccgacccaatactccttggggcgcccgggaacc

SEQ ID NO: 689753 - DNA, 839 bp, Homo sapiens
  misc_feature (1)..(1): n is a, c, g, or t
  misc_feature (179)..(179): n is a, c, g, or t
  misc_feature (234)..(234): n is a, c, g, or t
  misc_feature (268)..(268): n is a, c, g, or t
  misc_feature (298)..(298): n is a, c, g, or t
  misc_feature (301)..(301): n is a, c, g, or t
  misc_feature (305)..(305): n is a, c, g, or t
  misc_feature (345)..(345): n is a, c, g, or t
  misc_feature (353)..(353): n is a, c, g, or t
  misc_feature (463)..(463): n is a, c, g, or t
  misc_feature (465)..(465): n is a, c, g, or t
  misc_feature (476)..(476): n is a, c, g, or t
  misc_feature (501)..(501): n is a, c, g, or t
  misc_feature (516)..(516): n is a, c, g, or t
  misc_feature (536)..(536): n is a, c, g, or t
  misc_feature (539)..(539): n is a, c, g, or t
  misc_feature (811)..(811): n is a, c, g, or t
  misc_feature (828)..(828): n is a, c, g, or t
ntatcatccctggccttcgccaccgcatacccagactcaatatgcaagacaggcaaactggagatgagctattccaagttcaagaccaagagcctctctttcttgggcacctttattttaaaggtggcagagagcctccagctggtgacagtacaccagagtgagactgaagatggtgnattcactgaatgtaacaacatgaccctcatcaactagctacttaaagtccttgancccatacatgagagaaacctcaaattgctcctgntgctgctgcagatccatgagcagtgccgtnacnttcnccattcgatatcagctcgttcgactcttctatgatgtctnagtccctngatcattgtcctttacctaacagtctctaggattcctagactacaggctgacctctactctctggtcccagtactgcctccttgcccaggcctctctcactcttcatacncntccagattttnttctcagcattttcctttctctttnttattggcatcctgngcgtttcttgccctctactnacnactgattagattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgctctgattagtaagaactaagcagggggccacatgctctcaatggngacaataaagtgttgtntttttcttatt

SEQ ID NO: 689754 - DNA, 215 bp, Homo sapiens
  misc_feature (18)..(18): n is a, c, g, or t
  misc_feature (20)..(20): n is a, c, g, or t
  misc_feature (23)..(23): n is a, c, g, or t
  misc_feature (27)..(28): n is a, c, g, or t
  misc_feature (33)..(33): n is a, c, g, or t
  misc_feature (35)..(36): n is a, c, g, or t
  misc_feature (130)..(130): n is a, c, g, or t
  misc_feature (132)..(132): n is a, c, g, or t
  misc_feature (134)..(134): n is a, c, g, or t
  misc_feature (137)..(137): n is a, c, g, or t
  misc_feature (141)..(144): n is a, c, g, or t
  misc_feature (147)..(148): n is a, c, g, or t
  misc_feature (151)..(151): n is a, c, g, or t
tagaggatcccgaacggntnagnggtnnagagncnnaagaggagctggctactgaagaagaacacgaggaggagatgaatgccctgagaggccaggtgggtggagatgtcaatgtggagatggacgctgnancnggngtcnnnnggnnttnatctcctcctcgtggttcttcttcaaggtaaggccagctcctcccttgtgcctctaagcgatcc

SEQ ID NO: 689755 - DNA, 195 bp, Homo sapiens
ccactggccagagaggaatccatcccaatcatcaatgtatgtaagtcacccatggagttactaaatggtagattcccaggatcctaatcccactgtgtagggacaggaagcactcctgtgtccctgcctccagagacacccatgatcccactgcgccagagcaggaactccatcccaatcatcattttatgtcag

SEQ ID NO: 689756 - DNA, 248 bp, Homo sapiens
aaaatctacgtgaggcgcttagactcctctttgaatagatgatgagatataccagcagagccatatcatgtctatttccacccgagggaactacatcaatctacaaaccaagtcctccagctggtcctgctgctagtagtgtatggcttattttccatcccagatctgagaggtcttgcaagtctcttccctttggttgcccaccttaccatttggttaagtatatttgaaccggcgatccggcgtga

SEQ ID NO: 689757 - DNA, 598 bp, Homo sapiens
  misc_feature (469)..(469): n is a, c, g, or t
gggtagccagggagtggtctcgatctccggacctcgtgatccaccggcctcggcctcccaaggggctggggataacgagcgtaagccacggcgcccagcccccttcaccacttttaaccttcggataaaatggttttcatcatcaccggactcccagatgtagatgtgggtgtgtcacccgagaaagttccggaagccggggccagagtctcaacatttcactctcggagccggtagccggccacccatttcagagccggccatcattacccttacccagggcctaggagttttaagctcattgggctcgggaatcttccgttccggggtggcagatccgggctctaccactcataagctcggtagtctggggcaagtaattaaaccttgcttggccgcagtttccggaaaacaatcagaaggcaccggacacacagaagccctcaatatgtgagtaaccagggatggngtataaaggccagaatctgctccaggggaactgggagagttattggggtacccccaagaaatgcacttttccccttcccaaagagctaagaagcttccaagaacgagcccagaatgaactggtgtccag

SEQ ID NO: 689758 - DNA, 123 bp, Homo sapiens
attgggcgtaagtgataagttacaagaacaggcttttattcattggctatcgggtttttatggttctggtagacttcgttggattggtttctcaaaactcactcagtgggattaccggtctgg

SEQ ID NO: 689759 - DNA, 279 bp, Homo sapiens
  misc_feature (47)..(47): n is a, c, g, or t
  misc_feature (57)..(57): n is a, c, g, or t
atttcgaccaagacgaacgtagtgtagaaaggagaagaagaacttcntcggataaangggtattggatttcattggctttatttatgtttgagacagggccttgctctgttgcatggtctgtagtacagtggtgcaatcatagctcactgcagcctccaactcctgggctcaagtgatcctcccaactcagcctccctcccaagtagtgaggactacaatcacacgccaccatgcctggctgtataatttgcacttctaaggtgttcccaggagatgct

SEQ ID NO: 689760 - DNA, 113 bp, Homo sapiens
agatggtggtgaggggatgggatgtggtgagaatgacagtgcatgagtgaatggaatgagagatgtgcatgcattcatgcctccccacactgctgccatgccatggagacaaa

SEQ ID NO: 689761 - DNA, 618 bp, Homo sapiens
  misc_feature (159)..(159): n is a, c, g, or t
  misc_feature (163)..(163): n is a, c, g, or t
agcttcttaaggcttaggacctgaactggcacaaccttactttcactgcattctacccgttagatccagccgcagacccagcccaggttccacgtgggaaggggccctcgtgggacaggcgtggcaggagggatgggggccatctttggagactggccncganccagcttccttccccgctgacactgtgttcttggtctctgtgccctcggcatctagcagggtgcctgtccgagtcagtgctcagcaacacctgataatcaagggactggagggaaggacggtgggtccgacagatggacagaagggctccacactggctcccctgcccccaggctcctaccaccctgtttagttcacataaacacgactctctgctgcctaacactcctctatttttaaacctctcaagcagtgagtggtgcttaacattttttgaatcagggaccccttaaggaatctcatgaaagctgtaggagaccctctccctagagaagcgagcctacacataatcactcacacttctgcagtatattaatgacggctgcccttgactaagatcttaccacgtgccagtgactgtgaaggcacattgtgtacattacccgaactcttacc

SEQ ID NO: 689762 - DNA, 132 bp, Homo sapiens
aattaaaatcatttgaacaaaaaaaaaaggggcactctgattaaacggcattacagccggcaggacacctggggccagtgtggtttcactctagatttcacggtcgtcccaccccatttcttccaccccatt

SEQ ID NO: 689763 - DNA, 179 bp, Homo sapiens
tttaaagaacacgggtggtctcacgtgttgaccaagctggtcttgaactcctggcctcaagcaatcctcctgccttggccttccaaagtgctggaattacaggtgtgagcccctgtgcctggccatcaatgatacttttaaatacattttttactaaaagagacgaagaccaaggacag

SEQ ID NO: 689764 - DNA, 1137 bp, Homo sapiens
gctgaggcctactcacctaaggtaccaccccgtgagcttcccgcaacatcactactatgagatgtgtggacttgaagggctctctttgaccagaccatgaagctctggcgtgaaccatccgtgcagtacgcgactcgtccgggtgcacacgctcgactcaaggtctcactgtcccctggttgtccgtggtcgtctcgccaggttgcttctagggtcggctcgctgctgggccaggtcctcgagtgtgcctgtgcgaggtcactcataccgaaaggcagcttgagggtggggaccggggctgatctgtcccatctgtctgctgtcaccggacactgaggtaggtgacctgatcgtgcagcgtgctccttcttaccaatgatgcctctgatggctgctccccacgccgtcttttgcagcctgtccggacggcagtatgtccttgggacgcacaccacgggaccggctacaccatttcccctgacgtaccctgttttgcgccgtagcgtcgtgcacgcgaggaccgtgccgcgtgtaacaggcccgcggacgggatgacacgtgcccgctgcgttcaaccctgtcagaggatgccttgatgctcatcaatcactgattgccctgttgcccagctgtcttgaccacaagtatacagaaacctgctacaagtgggctcgaaaagccaattggagcggagagtcgccacggggggtcgcagggccccggtaggcaaccatagcagtgggaagaaaggcaggcgggggcagccacacaggagctcttctgcgtcaggcctgttgaccagcttctaatctcgtccaccccacacagactacaggcagcacctgcgggaggtcaaccggggagggcgtcttataagtgcccccctgtgcaagtcgtgtaatatccgctaggcccttaccagtcataggaccagcacctttgggacgaccactagcagacggaggtcacaacttccctggtgtggtagacctgtggcgctgtccctttcgggaacagagggccttccttcatggcccaccggggagcccaacacccccgaattcctctgcattcatggtcatttgggaagacacttggaaaccttaccaagatcttaaatcaccgggggtatcatac

SEQ ID NO: 689765 - DNA, 713 bp, Homo sapiens
atgatgaattagttttaatatgctcttgtgcttgcttgctaatttgggggtttttgttttagttgtgtaatcaatattcatagtgaaactgatgtgtattatgggatgtgaagtattatactcggaaattagaaaatatatatttctaatataacaaggcaaataagttttccttagttttctgtgcactgggatattttaagtagcattggatctggtctttaaaaattgatagaaaattggtagaaattcccaagggagtctattcttctattttttttaaattattaatgtgttaattctaattatgtatacttgtgctttctacctttttcatttattgttttaattagtattttttctctgttttctttcaaagcacttctgatttactaattaactctactgttttccaactcattaattttggttttaacactatcaacttttttcattccactttttcgtgtattagcttgtggaaattggatattagtaggtatattatccatgtcatgttatggtactgtttagctgtatcctaaaatttctgactatgatttccaagagaaagtaccatttccttttgatgctttaaataatgtctgatttaaatctgtggcgagcatgcgtgaatatacatctggatcatgaggctctgggctaaatgtcttttggaattcagtgcactgaagaggtttcctaaagtttaa

SEQ ID NO: 689766 - DNA, 286 bp, Homo sapiens
atgtggaactataagggatggctatatacagatcaccatgtctagctaaatgttccagtaatataacacatgcatttattagcctgtgatcagcagcggacagccttcaaattctcaggagtatacgggtctagctggcggaagatgccagagctgggctgacctaaaaggtctggtagttaatggcatccttctaccgcactaccataggcacgggatacttggaaaaagtctacccgagtgcccaagtcgtctactaaactaagttactaagggctatctcttt

SEQ ID NO: 689767 - DNA, 445 bp, Homo sapiens
tggggagttaagagacggagaatagtaacatgaatatgattgtgatagggtacgatgcagattcagacgagagggatcctggccaggaacatggctcaggcctgtaatcccagcgggagggtcacttaagctaaggagttcaagaccagcctggcaagggcaacatggcaaaaccccatctccgccaaaaacaaaaaaattagccgggcatagtggcaagcacccgcagtcccagctaccggggaggctgaggggggaggattgcttgagcccggcatgccaaggttgcagtgagctgagatcgtgccaccgcactccagcctgggtgacagtgtgagatcgcgtctcaaaagaaaaaaaataaaaagaaataggggaggggggagatactaacctaaatcagtacttaatcgttctttaggcataaagggaaaccaacatgaaa

SEQ ID NO: 689768 - DNA, 156 bp, Homo sapiens
cctaactattaaagtacagtccagtcagatgaaatacactcataatgtgcaaccattaccaccatccacctccacagtctttttcatctgtaaaactgaaagtctataccctttaaacaataacttcccatttccctatccccttaacccgagcgc

SEQ ID NO: 689769 - DNA, 243 bp, Homo sapiens
  misc_feature (234)..(234): n is a, c, g, or t
ggagttcagtactagccctggcaccatagcaagaccttatctctagaagaaataaaaaaattggccgcatgtggtggagcgtgtctgtagtcctagcaaggcggaaggttgcggtaggaggatcacgtgagagcccgggagttcgaggctaaagtgaactgtgatagcaccactgcactctggcttgggtgagagagtgagaccctgactcaaaatatatatatatatgtgtgngtgcgcgtg

SEQ ID NO: 689770 - DNA, 359 bp, Homo sapiens
tttttttttagacagtgtcggcgtgttgcccaggctggagtgcagtggcacaatctcggctcactgcaacgtctgcctcctgggctccagcgattgtcgtgccccagccccccaagtagctgggatcacaggtgcacaccatcatgcctggctaactgtatttttagtagagatggggtttcaccatgttggccagcctgctcccaaactcctggcctcaagcaatccacctgcctcagcctcccacagtgctgggattacaggcctgagccactgcaccaagccccagctccagattgtgagtttcagagacaggctagataggattcagactcagaactgtgagatttctgctgctc

SEQ ID NO: 689771 - DNA, 706 bp, Homo sapiens
gaggctcagtgatgtgcagagtgaggggctccttctcttgtgctgaggccctggctcttccgtcaggacctggatgtggtcagctccaccgttcgctgccgtcatcgccaccctgaggtctgcgggagcatgtgcagcggtggagcccggacctgatcatgcataatgctcctcgcaggggtcgtagagtcgaggtgagtgtcccacccaactggaaggatctgacgtggactgcatatcttactcgttgcgcactggctgactgcttgcctccccggtttccaggccttgtaagacgccgttggtggtggtgatgctccctgctggctgtgggaggaggagccccgtgtgctgcgtggaagccgggtgcggacggtggcatcctggatggccgtgcggactggtggccctcgtccaggccttcctagtgggacttggctggaaaatgctggaccccgaggtggtcagcagctgtcccgagctgacgctcaggctgctccttctcccgtgaggaagggcgaagaaggtcaggcccaggtgcccgtcgtatcctgtcccctaactccttgacgcgctcgtttcacgcgagtcaggtccaagacgtggtctcacacttggcatccgagtgcattccggaagttccgttgacttgggggccaaacggaagcgctgtcgcggaacagcgagggttccgaagcccttcatg

SEQ ID NO: 689772 - DNA, 193 bp, Homo sapiens
acctggatccacgtgtaaagtagtaagcatcgcaggttgcttgacacatttttccaaaattaccgggtacgccgagacatgatcccagtctcggttgactcaagagtgtggatgaagatctcagtaaacgggaggtggataaagtactaagaggtacatccagttttgttgcataagcaaacaatatcaagag

SEQ ID NO: 689773 - DNA, 978 bp, Homo sapiens
atttgggaacatttgacttccttgggcactcttaagtgcatactagatggcatagaagtaaaaggggcctccatgatgataggaaaatcagttactttataaaatattctatcaagaaaatccaggctatcacatagtctattctgtgtagacttattaggagataggaagcagccattggagaaacttgcacagctagctaatgcatctacattttggttctggggttagttatgaaatagttcttactatgacgtgttcaataacttcacataaacttcctagtactccaaaacctacaaagagatagagttaatgcagtatagtatgtatttatatatataaatagggaggtaagtatttctaatactgttcataggagctactagacaatctactaccagactaacccaatgtactgacatcaacacaaagctgaagtttcctactaactagaaggcagaaggcctggaagacacggctctctatgacaggtactacatcctactacccaatcccaagtccagatatatcacatcaaactcctaatctcgggagacagatctaggctacgcaatagtatactacgacacgtcaaacagccaggaacacaacttgtaagcaacacatagaacacgcacaacacacgtaacagacacaaacagacaatagaatgacatcacgacagactgacatatccaaccatgatataaagcccaaaagacaacatgagcaccacagaacaaacataacaacaacacagagaaactacaaggacacgaacaacacaccaaaaagcaccacgaagctacgaacagcaacaagaggcacattaaggacgtccacacaccgaggcaatgagcaaacaaaaaagcgaagaaacaagaaccaacagagagagagaggatcccgaaggaaccccacaacgccagacgtcagtaacgagcaaggcaagggggagcagagaaaaacgcaggg

SEQ ID NO: 689774 - DNA, 402 bp, Homo sapiens
  misc_feature (11)..(11): n is a, c, g, or t
  misc_feature (60)..(60): n is a, c, g, or t
  misc_feature (392)..(392): n is a, c, g, or t
tggcccatatngcgccacatataccgcagattaacaagggatgccaagctggtaagtcgngtacacggcatatgtggtgtacgttgacgcagacgcaggcgtggtggcggttgacgagtaaatgtagcttagggtgccgaacggcgtttatgccagtgctttggtaatctacgccgacctttagtcgcagccgcaaataataacggtgctaagggcgctaaggtggccaacatccacggggtaacggcggcaggggcagccacagcgccacaaccacacacacgggtgcgtagtaaaacatgggtaggcgcgtgcatgggggcggcgcgtacctgtggggtggtgcgcatttggctatcacggggttaccacaaaacaaaggtcaaaccggngcggttttgg

SEQ ID NO: 689775 - DNA, 269 bp, Homo sapiens
gacaacttgaagaagctcccacctagacctctttgcatggtcggggccagagctcactactgctgacgcagcactgctctctgcagctgagttgcctctaccaagtgtctttagagggttatgacctagagtagctggcctggagagaggtagcctccctgggctggatcattagggtctgactgtctgcagagaagatgctttacagatgtgtcaaagctgaggtaacgtggttgggggaggaaatccagacccaaagtgttagcagc

SEQ ID NO: 689776 - DNA, 329 bp, Homo sapiens
gacgaaaggcacgtgccaccacatgcggctaatttgtatttttagtagagacagggtttcgccatgttggccaggctggtcttgaactcctgacctcaggtgatccacccacctcggcctcccaaagtgctgggattacaggcattagccactgctcccggcccggaattttctttatttctatacattttacttccgttgtttttttcttttttgagacagggtctagctcttttgcctaggctgaagtgcagtggtgtgatcacagctcactgtagctttgacctcctgggctcaagcaatcctcccacctcagcctcctaagtagc

SEQ ID NO: 689777 - DNA, 420 bp, Homo sapiens
gtgattagcaggatctatactgggtcgagtctaatggatatagatatgaaatactcaaaagtaatagtcagctgtggaatcaacaaggagagaaagaaaaggactagtgctataaagaaatctttataacattcagaacattaaatatgttgcattgatttcttattaacaggtttaatacctccatctttctctaatagttttcagtttattagaaacagtatgtgaactttttagattaaaaatttccagcataggtttatcacttattatatccttttattccttgaaatggatgattgtcaggcagaaatttaggacaaaggagctggaaaatattcatgagactcaggcccccccgctattactcccactgtaaggtttcattataagcacgttaatctagttcaaagtttccac

SEQ ID NO: 689778 - DNA, 543 bp, Homo sapiens
aatgccatggctgtgtggagtgttcgatgccacaaagcgtaagagggcgtcatgtctcgcattccgtagatgatcctgggatatctgttcagcacgggaatagctgtctggaactttctcgagtatgttacaatgcgtgcattagaatatcattacacatgctctcaacctggatgcgattgaattgtactggaacagcgacaagaaccgccgagacctgaattttgatcgtggaggttgatatcaccgcgtctaggtgtcctgtgatgctggtggtatgtgaccaagcatccttcatgaggatgctcgtggtgtgaatgtaactctaaaactggatcccagaccatagcttctcttccgtcaagatggttgactccgagaggtcagccccagctgagctcagtcaggcaagcattgacacgatgcctttaagtacttactgataggtatgggctatatggcctcatcctgctttaatcgtctgtcccggtctcgtacaggctctctgaacagtgcagcatcagtagatgcaagctggagtat

SEQ ID NO: 689779 - DNA, 156 bp, Homo sapiens
agcagcgtcgggtgggtatggaggcatggtatgtaaaagcagccaagatattgacacaggaggaggttcattttagaagaggaaaaactgaggtgcagaggctcaaaaatttgcttaaggtcacataactaagaaatgccgcagccgcggcgctga

SEQ ID NO: 689780 - DNA, 1093 bp, Homo sapiens
gtcgttagccacgtttttgatgctttcttggtgtcactatcacgtataccgggtacgactctgttaaggggtagtcggacaggtgtaacgcggcagagtgaaaggtcgcccacttggtatggtcaatctctttagtgaacagagggggaacaccgtggctgcgtttctacctcttgtaaaatggccctttgttactgtcaaatgcttacgtgaagcgtttggcgcggggacgcgcgttggggtgggttttcccccttcgaattgcgtcagtcgtcaccacgccatggtccctataggctttccctttcgtagcgtggggtttcgaatggcaaagtataaggaagactaacggtcgggtgtgaatgcgcggattttatgagcgttcgcctgcgcttatggaagcagttgtcccgtggtgattcgagcaggtgcacgcatgaagatcgggtagtgcatatgcgacgggacaagttgtgctcgcctgggacctcttactcctggggccagtatggtagaggactggagagtgaaggggtaggaaagatggtcagaacgttaccagcactgaggacggggagctagtcaaaggagtatcgttgcttttgggattaagtgtttgtccttagtagtcaaggatggcaaaatgggtgcaccagcaataggaaagagtcaaacgtgtgaacccttggggtttggacagcccatgaggcccagctccccagtataagccatacaggtccaagggatcctcacagtgagagtggacttagagcacgaagtcgtggcgctgcgatctgagtgcgaccaagagtctgatagggcctagatgcagggtagacaatctcagcgccacagggcagtcctgaccactcttggcccctcaggcattatcccatttggaatgtgaatgtggtggcaatagatgggcagaggaccccaacctgggaacctttgttccctctagttagtggggagatctagcagcctaggtagcccacatgggtatttatatctgaaccagagcagacgcttgaatcaggcactaaactccagaaatatattagttgtaataattcgggggggatggcgaggg

SEQ ID NO: 689781 - DNA, 462 bp, Homo sapiens
cagttatacatggatgttccttctgcctcccagagatggctgcctgatactcagatccttaatacttctgggatctgattggctcagatttaagttaggtgtctaggtgtctacccaaattttccaggagtcttgcaacagcaattggcttctaaagcccactttgttggtggagcttggattatcagagcaattatgttggaaagcaatcccagtagatgtcatctaattggtaccatttggactagaggcaattagacggtttgcatatattttaaattattattgtagacatgaatctattactgtattttccacattttgagttactaaaaggattatattccacaggctttaataaataggtggatggatgatgatgataactttagtgataattgataattgctttaggttccagatgatattagagtaaatatagtatgctgtcatcagacatag

SEQ ID NO: 689782 - DNA, 1300 bp, Homo sapiens
  misc_feature (1300)..(1300): n is a, c, g, or t
agcggaggggagggacgcaggaaagagtcgcacggacgcactcgcgctgcgagcagcgcccgggcctgcgtggcccgggcggactgctgtgtgtgcggcagtcttcatggagtacccgcacagatggaggtactactgtggctgcagagtgtgacggctgctaactgcagccacctgctgcatgccttgtccccgccgctctgaagcggccgcgatcataagccgaaatgccgccaacccggatcggccgaggccttctctggctgggtctggctacttgagctccgctactagcggtcgcaccgtcgcgatccgaaagcgcagtgccaacatcgcacgcaccagatgctcgtgacacgtatcttgctcaatcatacgcgcggatgaccgtgcggccctcgtacccataggagattcgttgatcggcgggataagcgctgcgctcgacggtctcgcctaggactaattttgaacgcaaacattcgagccataccgccactagggccctccgcctcatctcgcaatgcataatcgccatctccggcaaccacgccaacaggctaggaccgctcgctcgccctcgccggaatgaccccagactgacttagcgaccatcatgtcgcttcagccacttgcgcactaggtggatagaactcggatgtaaccacccacaaacgcgctggccacactgcgcctacccggcaactggtttcaagacgccatctagcgtgtatgctgtggggaaccgcgtcggctaggcaagccgggccctgtgcgcaacaccccttctcgatcgtgcaggcacagttacactccacgaatgggtgaccttttccagcacccgcgccaccgcaaagctggggccttcatttgtctcggaaacatccaagaggtttcaagcaggatggcgtctcatccacaacaaggacgtcatcataccaccaccccgcccttggcgggaggtaaattaatttctctctgcgcattacacgaccgaaaatttaggcaccaagcaactagcgagtttgctattcgccaaacttagactatcaaggccacttcggaggacccagtatcatattacagcctacgcccgttctgaatgctaccacagttccaccattttgtcctccagtcagttgggaaaggaaaaacgcttacctacgaacagcacaacgccatcatgtataatgtggagcgaaattagactccatgaagtggcgaggcctacagggcacatctggccagagcaaaacagcatgacgctatatgggcctcaagaacccagctgccatctatn

SEQ ID NO: 689783 - DNA, 142 bp, Homo sapiens
tgttggagtgaggaatatcgaatcggaggagtgaagatagcgtccaacagcgccacagcgttccgcgtgggcacgtccaggagctgtccgaactgagcgagcaagtttggaaactttgcatgatgccatgcgtggattgcca

SEQ ID NO: 689784 - DNA, 166 bp, Homo sapiens
  misc_feature (96)..(96): n is a, c, g, or t
  misc_feature (149)..(149): n is a, c, g, or t
  misc_feature (158)..(158): n is a, c, g, or t
ccgcggccgggtgccctcctgccctcctggccatccagggattggttgtaagtggcctgttgcacattgtaacttctacaagtaactaacaccgtnagataatctaaaactacgaatactacctgattccacaagggtacggtgtattntccagtttnagcatctg

SEQ ID NO: 689785 - DNA, 425 bp, Homo sapiens
ccgctgacactctctatgcactggtaacgttgtggttgtcattggtttttcttgaattaagacagatttttaggtgtcttgggctgtgtgcatgcccatgcgtgctgtagagctaagatcctgcactattaagaagatattctcttttctatggtattggcttgttttacagtgaaagaatggatttctcagaactttatgctaaaaacatataggctggtgagccgtaatttaaaaaaacacggaagagaagttctgaaatcataataaatactcagcattataaactgatgtagtgcttttaagttagggtcattgtctttttgttgagaagacatgagctgttaacatcacttttgaaatgaaagacgtcttgtggcatttgccacttgagtgagacttttgtctctgaagtcactgaatca

SEQ ID NO: 689786 - DNA, 228 bp, Homo sapiens
tgctggctacatttaattgtttatttgatgtaaacgttatatggtcaacattaaacttgttttaaaaatatatactcaaatctggatctcatctctctatacctattcatagctactcctataggtaaccttttcaataggttctggattttttttccctgtgtttctttctaaaatgtgtaacatttatgtgtactctattatcctctgctgatggagtctttatat

SEQ ID NO: 689787 - DNA, 361 bp, Homo sapiens
ccaccatcaaggctttgaggaatgtagacacggctgacaccagggaatatacagctggcacagaggctgatgacatatagaactggctgcagaagcgcacggtcccggcgtgccacacaccctggctgacggcgcagatgcagagtccttgctggagttcaacgcggtgagatgtgcattggcttattaactgacgtggaggcggactctggcaagcagtttgtgcaggcagcataggacattgatgacgtaccatttgggatcactttcaacagtgacgcgatctccgaataccagatcatcgaagatggggctgtactatgtaagaagttgatgaatgccgcagcaactgtccgctggg

SEQ ID NO: 689788 - DNA, 342 bp, Homo sapiens
ccatgatcagtcctcattgttctcggcaattttcttttcagagtagtggcgcttttcgagccgcttccagaatcagctcgtgattgcaccgaacaagcagcacgagatcaacccacctctccggccacgcatcacaagtgtgccagtctagcactagtccgccccgggtgtcactgtccagaggcatgtcacgggcctgcgcacagccctctgggtcctcttcgattggatccggtgctacgccacccgacatggactcaaggtagtctaataatgcgtcttcgtctacttcgaccgagtcccactccgcatcgcgcgatgcaacaaagtgggtaccgagct

SEQ ID NO: 689789 - DNA, 112 bp, Homo sapiens
atatggccaggattcattccttagcacatatcaccactaacattttcttatacagtagatcccaagcatgctgcatgggcagcaagcatggggggtaccgcagctcgcacat

SEQ ID NO: 689790 - DNA, 424 bp, Homo sapiens
agatgcattcataataataataataaaacactgaatcaagagaagaccacttaaaatggagaaaaaattgtgacattttgatttacccttttgctacctctattctccacatggtactattgaaaacagcagcccacatacccagtacaggatccttcgttccagaggaaacagagcagttctctgccttttcttaccagtctagatgctccctgaaggactgatgcaaagtgcttttctatattttgcctgactcggaagtcagtcagaacagaaaagtgttgggcatttctcaaaaacagtgtaaggcaaacaaacaggctgagccacttggggcacaagtttacaatggaagcaaaccatagtgtacaaaaacctgggaagatcttgtgagagtggttctttgggaaattagggcattcaa

SEQ ID NO: 689791 - DNA, 208 bp, Homo sapiens
gaaagaacaagcagaagacctccggaaacggagatgggggcagaaccagcgacacctcagccccctctgaagaaaagggcccgtgcagaccccatccgcgacagtgatgaggcgttaaagaaaagaagggaggttaaagtaagagacctgaggaattaaaaccacggccgttttaggtctgtacccagttaccaggcagatgcatccg

SEQ ID NO: 689792 - DNA, 312 bp, Homo sapiens
ggtcgacatacatactattggtactttgatatttcttgtacagtatataatatatagtttgaggactttgatattttatctccagtataagatatatagatttcgtactttgatattttatgtacagaatatagtttgagtactttgatattttatgtacactttattataaaagtttgggtactttcatattttacgtacagtatataatacatactttgggcactttgatgttttatgtacagtatataatacatactttgggttctttgatattttatgtacagaatataatacataatttggggactt

SEQ ID NO: 689793 - DNA, 968 bp, Homo sapiens
gctcagctcttaccagtgggggcccaagcctctctgccatggggaatggccgctccagctcgcccaccagcagcctcactcagcccattgagatgccaactctactcctctagaccccacagaggagaggccaactagtggggcctggcgcagcaggacaatcccctcctcaacaacctttagctaacgctctctggcaggcactcaggcggcctttctgtcctccccggcagcactttttcacaggcagaacaaccgctcctattctgacgctgtgacccggttctcactgcatgaacgaacgcttggcttgcacgacaagactcggactccagcaccaaccatgtgacctgtcagactttgagctgactctgaggagcagctgcaggctaagcacaggcctgcacgggaactccagagcacctgactggggaacgctgggccccaatgcgcgcagcgcacctgctgacgctgcccactgggcaaccagcacacacggaagcaggcccccaaggcgccggccttcggactgcccccctgcacaagttgcgccactcacgcgctgaacagatgtcacgccacgtgaacgaagccctgcaacgcccccctgccagcagcccttcctgcaggatgggctcatgccctcacccgtggcaccacatcttgcacccagtcgctccgcctgccgcctgcagccgcgcacgggacagctcagcgacccacgcagccacatcatcccaactgatacgcctgccgacccacacccccccaacggtcgaacccgcccccgcacccgcgccacacccgctgcaccgcgctttgccacccccccaagcaacactgccccgccttgccatgccgctcatcaacacccctttccacccacccacacgggcccacttcatgacgcacagcacccatgtacaatgtgcgcccacttatacacccctcctctccccccccccgtc

SEQ ID NO: 689794 - DNA, 1145 bp, Homo sapiens
  misc_feature (354)..(354): n is a, c, g, or t
  misc_feature (356)..(356): n is a, c, g, or t
gcgctgttcgcctctcctcccgggagtcttcagacctactcccagaagaggagggaagcacagtatgaagactgtggagactcaagcgttagctccgggacgtgctgtaccgttcaggagccatggacccaagctgccgagaccctatcgcttactccccagcggcttccgccgatgaagtaaaaatgcggactctgaactgatgccagcgcctcccgaaaggggggatccgacccggtttgtccccagtagtcctgatggcatggctgtcaagccatgctgatcctcagggagtcatagcagggagcgagtggaacccgagtatattcatcgtcgtgccagcatctccacgtngntaagtacagcagtattaggcttccgcgctagtcgaagtgttgacgtcgcttcgcacatctgatggcagcaaagcaacttgtctggatagaatagcagaggctctatcctgtcaagtaagaagctacaacgggagcctttctgaagaagaagcgaacgggccagagttggggtctggaaaagccatggaagatacctctggggaacccgctgcagaggacgagggagacaccggtaggaactacagcttctcccagctgcctcgatttctcagtggttcctggtcagagttcagcacccaagctgagaacttcttgaaaggctgtaagtgggctcctgacggttcctgcatcttgaccaatagtgctgataacatcttgcgaatttataacctggcccagagctgtaccatgagggggagcaggtggaatatgccgaaatggtcctgtccttgcgatggtggcaggtgatcccatctatgattactggctgggaaactccgatgttcctcacgccagccgagagcctctaaggtggccagcaggagccgggaaacccgatacaatctgggacgcgctcacggggagagacccgggggacgccgtaaggcgccaaaagaaccggggaagcacgaagtgagcacatgcgcgatgtaccacagaggggcccaaccactgtggagaaaccgcaggaaggggtaacacacagacggggggacaaaacagacagcgcccgcattgcaaacgcgccacgcgaatagacgtaacgaagaacgcagaaccatatcaagc

SEQ ID NO: 689795 - DNA, 109 bp, Homo sapiens
ggttcccatgctaagggttgagtcggagctgcagccaccggcctactccacagccaccgcaacgcgggatccgatcctcgtctgcaacctacaccacagctcacggcaa

SEQ ID NO: 689796 - DNA, 139 bp, Homo sapiens
ttggggcccccccttcccctttttttgtcccccaacttaaaaagaaagaaggcttttggtctccctgggaggggggggagccaaccagggttttcctgtaccctgttttgagaccagttgaataaaagggcccccctta

SEQ ID NO: 689797 - DNA, 301 bp, Homo sapiens
gatcatgacaatgtcaagtatttgaagaaaattcttgatgagttggagaaagtcttggatcaggttgtaacctttattttccaaaaaaaaaataaaggaaccccagcttttcatatgcagcatactggtggaagaacagctcacctggtgccaaagacaacagtggacttggcagagcttgctgccttgacagtgtatcaatagcagagctgatctggcacctgccagttgggtttatttcagcaaacccactttaaaaattttattagcaaataatgaataaataggtttggagcctttc

SEQ ID NO: 689798 - DNA, 1070 bp, Homo sapiens
  misc_feature (10)..(10): n is a, c, g, or t
  misc_feature (108)..(108): n is a, c, g, or t
  misc_feature (175)..(175): n is a, c, g, or t
  misc_feature (595)..(595): n is a, c, g, or t
tcgttgctgnggatagtgttatataacgtctagcgaagctcgaagccgagaaagagacgacaaactaaagtacagataacgtctgtaccaccattggtcgcttgatgnggtgctttccctaccagatgtaccgcggatttcgtcgcctcaccccgtgttatatgcgaaactactntattattggtaaccgttcacctttggagtgtaggtgacccagcatctacccagcacaagcggatcaccgagagctactcaccgatgtcaccacacataaattcgcgcgaatggtgcctttcacaatgtgccccatagactggatctaattggtgcacggcaagattcccacttgccctttctaacggcaaaccaggcgcttcccacatgggccatattaacccactgactcggtcagctggcaactccctgtttccgtcgtccacaacaaattggaatataccgctggcccccctggaccattatttgttcaacccggcgcagcacacaggaaaatgttaatcctgtccccacaacagtaggccaccactactatgtccgctgtgcggagcaccaccaagtcttcatattggcttgcttnccgccactgcactcgcccgcaaccaggataataattgtggcacgccgcgccagaaaaaatatatccaaccctgtgtcgcacacgtgtccaccaacattcacagagtccctcttcttgaagaacttccacacgcgtacatataactctctcttcgaacacagttaattaagtatccacttttgaaaccagcagtgatagccctcaccccttattcaatgcagagcccttgtatatttcaccaattgtgttgaaaacagaagactctttcggccaacaggtaatacttctatatgcgaacacttcaacctttttctaaggagtacccgtattaccaccaacgggctgtaaaaacacatcacctgtgcagaccacataccatgatgaataagagaaacctctctttcttgatgtttcaggcttctacacccgggaatccagggcccccagggttaaacactaatccccccacataaca

SEQ ID NO: 689799 - DNA, 409 bp, Homo sapiens
gaggacgggaggctcaggtggcctcatctgcaacccagaggaccggggaagagcagtggcggagacaatgggggggtgtctgtaggagagtaaatgtgtacactgccgagggggaggtggcagtcctgcagcttgtgccggagcatatgtgagggcaggagccggcccaggctgtggggaaagaaaacaaagggcctgctgagatttccgccagtaggagctacggaggaccgagcgagggagggaggcacggcgggagggagcaccggaggcaggcgtctcagaggtactatccctgccaggccctcgatcccctcgtcccagcaaacagccaggcagtggccgactcggccttcctctgcgctctgggggcatgacctccgaagagtcggggctccttcaccctgct

SEQ ID NO: 689800 - DNA, 663 bp, Homo sapiens
catttgtttacttgaaaaatccccctcgagggtgagagaacctctgagggggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccataggtggatcatgtatattttacttctaaaggagagaatgtcaaaaaggtctgcatttttttatattctatatattaaggaggccaatcctaaatggtctcaagaggaaagactgtctgtcattttcggaagtaggatactgtgaggaagacccaaaagagatatggatgcttcctcgctcaagaggcctgagcttggaccttttcctctctgcttggaatctggaccaccacctgggaccaaccttcagctgtggaacccttataaaagagggcaccgtggccctgattgttccacgaacctgaagggagcacagatgggcctaagggcctcggggaagcctggtactcttggccttactagtggaaaaccctggcttgtatcaagaaaacccagaagcaaggttggccttgagaatccccgggccctggtccc

SEQ ID NO: 689801 - DNA, 150 bp, Homo sapiens
gctatgtgtaggtcaagtattggcacagcctatttttgcagatagagattatccaccatttaatcgtgtagcgatggatggaatagcgatacgcatcgatgactggaatcgcggaacacgggaattccatattcgggacaccatttttgc

SEQ ID NO: 689802 - DNA, 927 bp, Homo sapiens
agcggagtgctccgcggcgtgtggagcgaggccttgttcccggcgttgagccgccgtcgcctgcgcctggcctcctcagcttcagacctccgtgcaaggccgcggccactcgggcgttaggaccttgtcctatggagtggagcagaacgggtgatactaaagatggtatcatttggtagaatgtttgtacaaccatggcgaggaagttagcagaagagctattgtttagagaaatgaaataggggtgaatattagaatagatatttggaaaagggttaagcaaactgtaatgagttagtaagattgactgaagcagaacatatggacagaacattcttagacatggagagagagtagtgccttgagaactgggccgcaggggggcaccattagagagtgctgcgtggcagatggacgacagcaggaatccaagtcatatagtcttcggtgcaccatggacaacgtgttaaaaagtgtgttaagagactagttggacggtgcttgtgacggtgtcccaaattggacacgtttaatgagggtattggaatggctatgtggaggagatttaaggttagcatggagtgtataaacgggtgacaggaagatggaattgattggttgtatggcctaattgcccaaccagatcaagtgaaagcaagggtggttccaggtggtggagaggacaggggtagaattcgcaaagtgtttcacataaggcgttaaagattgttagggcaatagtgataagaaaggacatgaacaagtgatgcagccacggaaaaattggttggttagggttggtaatcaccaatttcaaagccttgggaattttgggatttggtagagcttttcttgggttttggattgtcaacaatttgagaggagaagctttgggaaaagccttgtcgagaggagtagcttttggga

SEQ ID NO: 689803 - DNA, 450 bp, Homo sapiens
ggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggctggactttctccttcagaattaccaaagttggcatcagtggcaaattattgggttcagagcctttatcagacatattctgggttcgaggctcctcatataatacatggtgcgaacattatatttccactcattcagatggatgcatcgcgccaggcatccagtgcgtgtggggatagggacccttgaccattaacagtcctgaagaatgttgggatgacagagttacgacgtcccacatgaatgcaggtctcctccaatatgtgtaca

SEQ ID NO: 689804 - DNA, 554 bp, Homo sapiens
cccccggccgtaccctcaccccccggagtggggaacacttgaataggaggtccagaaagtacttccagcctttggattcctcattttccccttatttaaggaacctgagcgcccagaaggtagagactaagaaagggaagagagaaaacatcaaaccttcagtgtgcagatttcaggtgtagccttatttagtgagttcaggacagtgaaaaataatgagtggaattacagtttataagtagttccagctgcatgatagcttgtttccttgtatgatgccattcttggatattaagaatatagtagtttaaaacaacaaaagaagtgaagattttatttggccaccatttgttacttcaggcaataccatttcttagattttttttttcccaggttaatgatttcctggtaacagggttgcttactttaattaatttttttggctgtttctatcataactttatgcatatgtgtttgccatcaattctaggctttcccatttcacaactatttcatgttaaattctaatctagtacccaaggctgaaacattta

SEQ ID NO: 689805 - DNA, 110 bp, Homo sapiens
tggaccagtatgacagcacagaggaggtggtcagcacagaggagggtgacgttagcattacccccaacctcattttagtcgcctaaacattgcctggcctcctctgtgct

SEQ ID NO: 689806 - DNA, 814 bp, Homo sapiens
agcgggactcggggtccagagctatcagggcgtctgcggcgctccagagagcctgcgggtgagtgagcgctccgccggacttcccggggtcagctcgtcgagggtctaagggccagtggtgggggccgcctacccgcggagcgacgatgcggacatggaaccccagtttcggcaactggcagtgcttgtggcctgacccgtacgagaccatgatagtgatccaccctctcccttcgacccatccactaaggctgtccgtggtatagatcagggaagggactgggttggtcacgtaggtcatctagggtaggcgtatactggcgcgtagcgcatggatccgatggcgtcaattgtaacgcccagactgttgggtcacagaccttggaggaggagggggtagaatgcttctagagatctgggaactctagtgtggtccgatctagagacctggtctgctgcacgggccaccctgcgggcatcgaatgccaaggccactgaccggggttgaacgctctaagaggctgaaggctgcttcttgggatggcccaagctggggccctaacaaggcctctgtccacagccccgagcctgaagatgagggggagccggggcggtcgggactggagcttgaaccagaagagcctcccggctggcgggaactcgtccccccagacaccctgcacagctgcccaagagccaggtgaagcggcaggaggtcatcagcgagctgctggtgacagaggcggccacgtgcgcatgctgcgggtgctgcacgaactcttcttccagccatggcagaatgcctgttcttccc

SEQ ID NO: 689807 - DNA, 521 bp, Homo sapiens
ctgcagccagctcagccccagctggttcagcagaggcaggatgcagcacgctcatcttcagatctccagcggaggttgaggggatcgtcagtagagatgctgcaggatgtgattgacgtcataaaaaggagtgaaagctgggccttgaagaagcccaaatctgtttcccagaaactaaagagtgtattccgagtgcccgatctgagtgggatgctgccagttcttaaaaagctgacagatgtccagtactactgggtggacgtgatgctgaatccaggcagtgccccttcgaatgttgctatttttgtggatcagagacaagtgaaaactgtacgcccctgcccctttaagaattcaaatccatgtgatttttctgcttttggggtcttcggctgcccatatttctcttcggggaaatattactgggaagtaaatgtgtttggaaaaattgcctggatcctggggggacccagtaaaataagtagtctgaataaaaggaaaagctctgggtttgcttttta

SEQ ID NO: 689808 - DNA, 236 bp, Homo sapiens
tccagtacccgagcatgattgaatgccttgcagggtcgacgtgtattcactactgcgctgcatgcctccctggactaagtatccgtcgacacgtgagcaaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcct

SEQ ID NO: 689809 - DNA, 1888 bp, Homo sapiens
  misc_feature (73)..(73): n is a, c, g, or t
ggctaccggtgacggtggaagggcgtgcgtcaggtttcagttcagcatgggatctgtgaaagtacctcgagtnacacctctccaagcaaatgcgcgcagctggaggcgactgtgggtgctcgaggtgttggataggcgcgacgggctggagagtggcagcatctctgaacagtgtgagtcatgccgggggcgcagagttggcgcaaagcggttgatgcgtatggccctcaggatgcaagccttagagaagcctactgtctccagggtcagtgtcacgcatcgcctgttggtgacaggtgtctcggaactcgcagtgatagcaatctatgcgcctgtcgagggaccgatgcacagtgcaaggaaatcatggtcacatgtcgcagcataggaaaccatcgtaagccagactgcagggaaggcttgactggtgagagaagccataggcatcgctccaaggtctcatagtcaccgagtgccccgaaaacttgggtctcgccccagaattggagacacggcaattggggcgtggcacggcgccgtagccagttccgccatgctacataagaagtcaagtccccatgggatttgtgtgcgcatgggatactcgcggagaccttgtgccacaagagaataagcgtcagatcgtgggactctcctggaggacacctcgataggtgaatacccgagggcggggtgggggaatccataaagcccactcaagagggaaacagggcgtaaagaccattgaggtacgcagcaaggacatgtctgaaggttccggtgcgttacaacacaggcacattgggggaaacaccagaaggaggttccaaacgaggcattgcttcgtgtggtcctcgcaccacaaggggaagaggcaccgcccaaccatacatgtggacgtcgagccgggggaacatgtgatcaccaaggggaagggggaacgagccttatggttaacggcaaaggaatacacggttgaacggaattgcacctcgcctttgctggaagccaaagggcaacttgccggtctgggaacagcaaaaggtttaacccattgtcccaaagcgagtcgccttgcggcattcggcccggggctgtggggcatggggacgcgaacaaggggacatggagcgggaagcagcaggttgcacaggaaggagccctgtggcgaagagagagactaccgaactgtgtgtcgcctcggtagacaaccgggagggcacttcgcacaaaggacgcggagactagcgtaggaaggtataggaggtgcggagatagagacacggagcatccgcgtgggaacccatagtggggccccgaagcggattgctctgggcgtgggtgagattgccacgtgtgaaattgacagcatgggaagcgaacgcacccgcacagacagcctccgcagggaacaatcgacacgctgtgggacccctgcggagacttgagaacaactccaacggactacaaacggagaaacggacccagggagacgcagactcgaaaagacgaagtcaatacgcgtaaacgccaagggacaccacccatggtgccatacaacgtgtaaaaataaacacaggagagctaacatatgcaatatgactaaatacaaggaaaccaaggaggcagaaaaggaaaaacaccaacagccaaaccagggaagccaagacacaagccacacagtgtaacacgtgaacagcaacaacgaagaagtcgaaagaacaaagcaacaaaaaaaaaactaagatagccaaccacacagcacaacgacacacaaacatagacaaaacatagacctacgacgaacgcaacaaagagagagcagatcagaaacacaaaacaagaagcatacgcctcaatcgactgtattcgaccacatccaatcaac

SEQ ID NO: 689810 - DNA, 143 bp, Homo sapiens
cctggtttagtcgtggctgccaaagtgctgggattacacggcgtgagcatgatacccagcctaatttttatatttatgtagtaggcagagtctccctgtgttacccaggcgggtctcaaactcctgagctaagccacggtcaa

SEQ ID NO: 689811 - DNA, 234 bp, Homo sapiens
  misc_feature (185)..(185): n is a, c, g, or t
gactgtctgaccagtgttgaatgcaattctcctgtctcagccttcctgagcagctgggaccacaatgccctgtgctaattttatgtatttttatgttggagacgtgggctcaccgatatatggtcatggctgtgtctctgaactacctgacctcagtgtgatctagcctgcctcaagattcccanaaatgatgggattacatggtgtgcagccacctgaccccatgcatttttt

SEQ ID NO: 689812 - DNA, 413 bp, Homo sapiens
gctcggtccactcttgtcctgggcaattagagctggtgctgtccgcccttcagtccccacaggaggccctccatacccccgatgtccccggtatggtgctggtcgatggtgaactatgatgccttccgatggccaggaggttatccgtgggaaagctcgtcaatagtgatggttcgtgtgagacccaatggtcattgtggaatatcgggacctggatgccccagacgatgttgatttcttttgagccgtcccccgttcctcagtcctggagcatccatacttgtactaccttgtcctatgaagctcttattgcccaggctggagtagctcttattgcccaggctggagtagctcttattgcccaggctggagtagctcttattgcccaggctggagtagctcttattgcccag

SEQ ID NO: 689813 - DNA, 1215 bp, Homo sapiens
gcatctttgcgacgttgccctacgtcgcgtgcaaccgccgtcagagacctctcaccgaccagtgtctaacgcccccactaggtgaacgtccgcgagactgactcttacatatctaacacgcaagccaagcgtagttggctacacgaccaatggcctggtaccacctagtattcccttgggagccgacagtgattgacgcagtgcctgcggacctattatgcaattgcagccctagggctcgagtacgagcaaggcccgcagttaggacatattggggcactcgaatacgtgttgagcgcagtgtgtccacccaaaggcattgcaccccgaagtactatataggaacgcaccgtatcgcagcaatcgagacatcgcattcagtcgtctggtgcacagtgcggaacctagtagagattccgttacatatggacacggtatctcccctgcgcgtcggggaaacttactcacttgcaagtgacacggttagcacggcaagaaccgcatcttcccgtatatgattgccagcaggcaatgccgactgtgtagagccatgtagcctatcgtgagcctcaatttcgcatgcttactaggacacgcggatatgccttgggtgagtcctcctaagagcgactccagaaagtgactcttagtagaatgcctgattaccattgcgaaactcctagtcgaaaggggacattcgaggaccttggcaaagaaggggatgcgtccgcatgaaaggcacaggtggcaggcccattctccattctagacacacttccagtcggatcgcgtggacacttatactttgccttcacctattcggggcacccaaaaggttgtttgtaagcggcacgtagagatcgacctccgcatggtgtggggcgttgggtaaccattaaccccattacgaaataaccttacttcccctcgacttataagtgggtttgggcgcgtatgccggaacaccgtttcgcggttgtgcaaaggctacagaggggacatattggttatggaggactaggaggaagctaggcaccttggacgccgaccatagacaaatattcccctttaaattagcaaaggcgcgtcgcaaattggggcaaacagagaaaccccgcggttgggcgcgggatacacattatgccacgtgttggtttcgaacctacgcaagcagttcgatagccaaaaacgttaagccattgacacatacaggaa

SEQ ID NO: 689814 - DNA, 887 bp, Homo sapiens
gaaggatctggtgcccgcgctgattgctagtggagtggaacacagacgtgctcatggagggcgtgaagactgaggtggaggacacactgaccccacccccactcggatgctggctcacctttccagagacagcccctatgtcccttgcgcagccagggtgcatgttggccagctgtgtgtgcagtgtgcatgtgactctggagcctgactatgcccagtctttcgaggacagcaaggcaaagcccagagccagcggcctgtctctgcacagcctgggtgcattgctggaacctagctcccaggtccaatggcacctttgtgacacaggctcatggtcgtatacctcttgcacttgtatccttggcaaaacacacgcatattgggcgcatccacttgccttggtgaggcacctgggtggggcatttcacccaagagccaccctccaggataccacaacgcagactgttcataacccaattaagcacccgttgtgaggcgtgcaaaaccagcttgccttcgggtggcaccccggaagaaaaggcgacgaccgacttggcccacttgcggccttgggagccctcgaaggatggtctttgactttgccgcccccccaaggttggttccttgggcattggcttccaaaatgcggggcttgtacttgtggttggctacagggtcgttccactttggtggtaggactatcataccgtattaggtactaacgtgttgaaggcccaaggtacgacgacgcgtggacgcccaacatgtcaagggccccacagtccctgagtggtaacgctaatcttgggaatgtggcccattcggccaaatggtcagagaggatttgaaccttggggaaacatttgggataccacgggaggaagaac

SEQ ID NO: 689815 - DNA, 109 bp, Homo sapiens
cgccgcgtgggggcggcggcggggtggagaagggtcggggcggcagggccggcggtggcggcgattctggacgcgagccgggcccttcccgtgatcgccccagctgcgg

SEQ ID NO: 689816 - DNA, 388 bp, Homo sapiens
atccgattaaagctcagtacaacaccatcacttaatcagtgcacacatgtcgaacagggttccctattttacgggtataatttatatcatattttgaaacaatctccacaatttatagaccaattccaagtatttccagaaatctatctatcttgaaccatttgacagtacactgcatgatctagatataccaacaaccccaaatacttaggtgaacattctctataaacacggacactcacaaatatgaccgtgatacgatcatcacaaaatggtacacttcagcactgatcaattattacctttctaatcctcaaacaacattccacatttgccaactcctttaataattatcctttaacaggctgggcgtgtgatagcttggagg

SEQ ID NO: 689817 - DNA, 450 bp, Homo sapiens
  misc_feature (80)..(81): n is a, c, g, or t
  misc_feature (98)..(98): n is a, c, g, or t
  misc_feature (164)..(164): n is a, c, g, or t
  misc_feature (252)..(252): n is a, c, g, or t
  misc_feature (265)..(266): n is a, c, g, or t
  misc_feature (279)..(279): n is a, c, g, or t
  misc_feature (287)..(287): n is a, c, g, or t
  misc_feature (289)..(289): n is a, c, g, or t
  misc_feature (330)..(331): n is a, c, g, or t
  misc_feature (360)..(360): n is a, c, g, or t
  misc_feature (375)..(375): n is a, c, g, or t
  misc_feature (403)..(403): n is a, c, g, or t
  misc_feature (422)..(422): n is a, c, g, or t
  misc_feature (424)..(424): n is a, c, g, or t
  misc_feature (437)..(437): n is a, c, g, or t
  misc_feature (443)..(444): n is a, c, g, or t
tccccatcagcggtgcctttattatcataaacattgggagcaaataaatggtacagaaagggcaaacaggcccagttccnncttcaggagaacttcantgaataaagcaagaaatcagggtgaggaagaaaaaggggagccatggcctgagcctggctggctgngccccataagtcaaccacacagcccagctgcagctgccttatcctccaaggcaccactggtccagctctcctaaccaggacacagatngcatcttggtatnntttcttgcctctntatgcttncncacgcctagtacagtgccttgcatgtagtaggtgctcaatnnatgaagaaccacgaggatacaagtgggcnctccaagaaaccatnaacagatgttactttacaaggaagaaanctcttgttttaaggagggnanttgctcaaggtcnacatanntagcaa

SEQ ID NO: 689818 - DNA, 514 bp, Homo sapiens
tccataatgtgtgccagatcccaccactgcactcaacctgggcacagagtgagactccatctaaaaaaaaaaaaaaaaatacaaaaaaattagccgggctggggggcatgaggctgaggcaggggaatggcccgaactaaggaggtggaggttgcagtgagccaagatggcaccacggcactccagccggggcgacagggcaagacgggtctcaaaaacaaaaaacctgggtagctcaaggtgtctcttaagtaatttaccgattaagttaaaaggctattatatcaagaattccggcataagtgaaatacaatttaactccaggtagagtcactgggggagtggtccaggacagagactccacaatgactaaaaatgatacccttcgtggctgggcacaggggctcaggcctgtaatcccagcacttgggaaggctgaggcgggcggatcacaaggtcaggagttcgagttccagccgggccaactgggtgaaacacggtctctaccaaaaat

SEQ ID NO: 689819 - DNA, 626 bp, Homo sapiens
  misc_feature (168)..(168): n is a, c, g, or t
ctagaccagttcttgcctctcccagaaccccaaagcatcatcccagcccttccatggctgtactgacacctatccctgggacaggctttacctttcttctctgagatgtcagatctttcccctacagacagggtggaaaagagagccggcgcagcgacacttcttctncaagcacgacacccgtacttcctttgacaaagagggtccctattgcctgctgcagggaatcggaaggcggaaggacctggagcgcctgtggcagcggcacaccttcctgcgctgggcaccctgtgagatagagttgcgccagcaggggcccctggaatcttcttaccaggctgatttcaggccaggcccaggactcagtggcctcccccagcacctcatccactttgtgcaggtccagccttcccataccaggaccacctaccagcagaacttctgctgcccatcccagggtggccactatggcagctacaaggtagggccccaggcgccggtcactgacgtactgcctgacctcccagggatcccaagacccaagctgctgcagcactaccttcatgctggggtctctgagtgtctaaactggtccagagcattaaacaaggacagctgaaaaaaaa

SEQ ID NO: 689820 - DNA, 444 bp, Homo sapiens
ttatcaaagttaatttaaaggggttggggcccttttattttggttttaaaggcttggatatttcaaggtaacccccaatttttgacccccataggtagaaggtaaagcttgtttgttcgttcaaagcatgaaagggaaacttatagggaaattcggcccagatagaatgccggcccgtcaaaccaaattgtttgcaaagggggggcaccagggcccttggcgggctgatttttaggtaggaaatgggggacccccccttttaatgaccaaagggccttttttaaaaactgggggcctctaaaaagcgggccagtttttttccccggggggcatttgtttttcctttaaaaagactgtttttgggccagtttttttgttgagggggggcccaaaagttacaggttggcccctttttagttgaaaaaaaaggggatttttttttta

SEQ ID NO: 689821 - DNA, 1544 bp, Homo sapiens
  misc_feature (486)..(486): n is a, c, g, or t
  misc_feature (1057)..(1057): n is a, c, g, or t
ggagagcgaagaaggaacgctcgtgactctctctgtgaagacggctgtaggccaaagtgaaggctttaacaggtcacatgaaggcgagctgtagagtaggtgttccataggcagtagaaaggaataagatctctgcatcggtcaacccactcattcgcagggaccgaggagtgtaaagactaatcgtcggacttcccgcgtacgagcaagaccaggataatccatcgagaacgcattgctgcacaggacgaaacaatgctcgaggcacctacagctagtcattctaacgtggtcgcggctcgagcagcatgatgatcgtgtgcactgaacgaaaaactcagaacgaccagaccaagggccagcttcgttggtatccagttccgttcgagagtggttgtaataggaccgaagacaatacgccaacccaggacttaaacagcaacggcgtaagtagaaaggcagaggactggggtagtggtatcactntggatttggtcgtgccaagggggttccaaggacgctcccttgaaagtttccgtaacacatgaacatgggactgtatcgacacgtaaatggcgtggcaggtagtggttctcccgaagcgttggaccgtacgcgtgtatgtgtactcgacatgggcgtattcgcagaagtgcattgtgggcacacaacgcaacacaccctcgggggacgtccacgtactagaagaggcatgaacggatgcaaaaaagaggctggacactgtaaaactctacgtttgaaacgtgagtacatgaatcagtaaattactttaagtgattcagtgtgtaatgcgacctcaaagttgaggaaaaaacaaagaggccgaggaaaaggaaaaaagaaacacgtgcttgggggaagggcaaaattgctaaaaaatagttcgggaggaggataagttgaagaaacaagagaaaggggtggcgcttctaggaggaaaaatcgctgcgaccggaggaaaagttggtgccccatgaagatattccatcgtaatgctcctcccccacagttgttaaaccacggcaacgcctgggtnttttcaagttgtttgttcgtccctttcccaaacagtgagctggtggggtattacacagaaacttctgtgctgcacagcgggaggaaatcttcttccaccagcataggtgaaataagttgtagtgaaagtaatccgcggcagcagatgttgagctgtggtctaccaaaacatgaaaaggggccccaggggtggataaaaaagcggccgttgcccatgttgtaacttgataatacggatgcgtgcgggaaaacaacacttagtgtgacacaccaccacgaagtctttttcgttttgtaggcacgtacccaacaaaaggtgtggtgggtaataacatcctcctgcaccgccagaggttcctacccccctctataattgagagggagtcacgcttcgagcacaaagttataaacgttcatcatcaagcgagatttacaaaagcccccaccagcggtgtgttattacaacgcccgttctgggacaatgtata

SEQ ID NO: 689822 - DNA, 461 bp, Homo sapiens
  misc_feature (10)..(10): n is a, c, g, or t
  misc_feature (213)..(213): n is a, c, g, or t
  misc_feature (229)..(229): n is a, c, g, or t
  misc_feature (394)..(394): n is a, c, g, or t
cccaccacantgcacagacccctccacattatgccacacacggcctagacgttgtgtttcctcagccattttccctctgctgccccagtttactctgtccaaaaccctaaggttcttctctcacttgaacacagacgaccttgcttgggtgatgagacatcccctttatttcttcctctaccgccggccaccccctgtcactctacaagcagntcagccgcagcactgntggagagctctctctttatgcacaaatctcatttcaccacgcgcttccagcagtttcacctgcggctaacattcaccagcatttctgttaggatatttagatggaggttttattttcacacttggattcttgctctgtaccaatatttgcctccttttttgtgantgaactgggtttttctgacatgcccaccctcccactcaccgtatttcttccttggtcccttctctcc

SEQ ID NO: 689823 - DNA, 212 bp, Homo sapiens
cgactggtacgagtagatatgatatgacgcggtctcattttgttgggtttcggaactgagtgcctgatttagagggacgggcggggcattcgtatatggcccctagaagtgacattcttgtgaccgggccagacggaccagaacgaaagcatttgcccagaatgttttccttaattccagaacgaaagtcggaagttcgaagacgatccgat

SEQ ID NO: 689824 - DNA, 1542 bp, Homo sapiens
gactggcaagaaaatgatcgagagtctcctctggtatcatgcctagctaacagtgtgggatgagatagagagggtagatcaagcgtcatgatctcccgttgtgggaccgggttccgaacggagtaagtcaagcaagccgttcagcaccttcagcaaccacgcatgagcatgagtaggtaactaacctgtgtagctttgtttcaaccctccaattcctcttggaaaattcatattcgattcttagttcaactaattatgtagtttataccactgggagtggaaggtaacaaaaggtagttcaagtgcaccatgacctctctcgtggcagggtgccgtggtaacgttaacttagacgtgagctgatggatgaccgcagtcgaaaaagcttgggcacattccagactatgatgtgacagagattccatcaacttggaatcatgacacataggcacatgaaagacagagagacagctgccagtcggacgacactgtgctgtacttggcggcgcggcgaagacaatcaacagtggagctgtgggcacctggggcgcattttgaggtgcaatagcgttgttggaccgatagaagcggcccccctatgttttcgtggcgcaaccccgggggcagacagaggccctgggcattgtgcccctccttcaatgattccgggaaggggcaagaaggaaaggagttgcaaggacagaaaggcctcggcgagcgctacgcacggggtgataagagcccgtacaccgtgtggaaatagaaaacggaatggaacctatccgaagaaaagcagtccaaggcagagcctgggccaggcaaagaggaaagcccctttacaaacacaaaggcccaggactggaatggaggagccggggccttcacaaaggagaaaggacacgcaaacaggaaaatggccttagaagtggaccctgggcattacgggcagacgagccaccaacggaaacaggcgccccttggagaggcccaaagagcacaagcacttggacaaaccggcaagggctacgcaaaacggccatggcacaacaaggaaaaaggcgcccaaaccgaatagcgccacgctggtttgccacacaagcaaggagaagacacggcctggggcgtaataccttccaccagaacgacacaggccaaacacaaggcaacaagggcagaggaacgccgatgccaccttccaagagccccaagaacaacaggcttcagagcgaaaacgttaggccaacgcaacaaacaataaggaaacaaaagtggccaacgccacaggagatggtactagctaaaggaacccaagaaggaagaaaaggtctgacgaaaagcgccccaggaaagggagacatcctacaaccaggcggccaacggcccccacataccataggacacaaaccatgggcaggcaagggagatcaaggaagagacaggtgcgcgatgagagctacagagggaaagaaacgcgcgatcggacttccccccggaagcagagtcatggcgagtgagcgggccgcaaagcaacaaacaaccagg

SEQ ID NO: 689825 - DNA, 190 bp, Homo sapiens
ccaagtagattaagacacacacacacacacacacacattataaaaaaagataggtaataatatactgctgaggcttttatatttaacaaggtcagcccatttttaaggccttcaagataccgcgctgtatctaactgtttacagagaaataccacatggttttttgataatgagaaatttaaagttgaaa

SEQ ID NO: 689826 - DNA, 147 bp, Homo sapiens
atgtcggcaggctggtctcgaactctgacctcaggtgatctgtctgcctcagcctctcaagtgctgggattacaggtttgagtcaccgtgcccagtctatacttcatatttcgtgataagcaatcaactagtacaacctgccggtgg

SEQ ID NO: 689827 - DNA, 111 bp, Homo sapiens
ccttatatacacctcactaacactctcccctgtttgcattttacatgtataagaaaagcaccacctccatgagaattcacgtgtggtatagagtggtatcaggggtggtat

SEQ ID NO: 689828 - DNA, 391 bp, Homo sapiens
ctattccagggcccagttgcagacattacgcaaaggacataccaccctggggttagttgagtggcctgaggccgggacagcagtgaccgctgctcactgtcatcgagatccacagctggctggagctgggcctgaagactccccacctgttctacacccctaggtaacaggtggataagtcacaactgtaactgtgacagtataccagaagggctaacaggtcttcaaaaaccctgactagaacaactttagcccaacccctgtgccagcctgccaggtggtgcaccctgtggacatccctgttggtccctgaaccaatcctgccacctgaggtgtatactacttggggatccgtgcacgttaacgattactaggactatgcagaaaccag

SEQ ID NO: 689829 - DNA, 409 bp, Homo sapiens
  misc_feature (1)..(1): n is a, c, g, or t
ngggctgtaggaattcggcacgagtttttgggatttgctcctagagcccggttcatagagggtgcttctgagttatttgtcgttcgtctccctcgttgttctgaatgttcagtttgtgtatgctggggaaatgagcacagtatgtaggtgatgtgtctggtgaatatttgtggtaatagaacatatggtaaacgtagtgtgacccgacaatctctgagcccctgtgagaaggctttataaaattgtgggagtattaaataggggggtttatagtttcataaagaaagctcatcgagagtaaggaccattgtgaatctgagtggttgtattacgtgtagagaactgtgaaatgtgtgtataaaatatttggaagagtggaaaagaggtggaaagtgggggggggtgaggc

SEQ ID NO: 689830 - DNA, 213 bp, Homo sapiens
ttaaataacctgattggggagggcggtaagggacggtaaggtgagagcctgtttcaccaggaaccttcgcctggatctaaacaggatttgctttcagattgccggaaatcctgcggtgaattagaggcctgccccgctagtcatgaggtgacccagtgactgctacaaacgctcctcctgtgcatcctggacttggtacacccgccttcccca

SEQ ID NO: 689831 - DNA, 901 bp, Homo sapiens
atttttttttgtttgtttgtttgtttgtaaacacacacactaatttgagaggacccgttagggttgtctgagcccagccaccttgagttttttagtactgtgtttgtcaggctcttcccaggcctcaggtttttgtcttttgtgctgtgtggggatgcattgctgcctgttattttattgattcttttgtgccggtggtttctgagcatttcaccttcaccatgtgttttacaaagaaactggtttggtattattagacatttttcaggcacgttgcttgtgcaccaacccttgcgttggcttctgtgttctggtgtttagcttgttcccggtgtgttgcacacttaattctcgtgtttacaagtttgttctattggcttgtttcttactttgttaagattagtttttcttattttcctttcagttaattgttgttccacagttacccgtgttatttctcgagtttccatttattacttgaagttacttcattgttttataattagttgccttcttccaaaggccttcacctttggacagaggttcaatcctttgatgctccagcacaggttgacgttcacttaatttgtcacttttccagttggtttttctctattaaggaagacatttttctaattggcttttccatgggctgtgagactgtgtgaagccgtttgtgtggtctccatgtaggtgctgtgttcccggcaccgccttgctctgaacatggtaattccaggtgctgcgcttggcaaaggggtctcgccaaaaggctgtgtgtgtgctgttgtgaacgtgtgtgtcctttgcatggttgagcttgagtgcttgtaaggcttagcggacttgggtgtttgttccatggtccaactggacctaattgggctcttaagcccataca

SEQ ID NO: 689832 - DNA, 738 bp, Homo sapiens
gtatctttcgctgtgacgagctacggcaagaatctgtatatcgcagactgtacacgatagaattccgtggttgctctcgatcttgcagtttccaacggagaccggatgcttcccaaccccacgatagcagatccggctgtatggcgatcaccatcggccctgtctcagatgtccgcaaggccataactactgctcagtgaacaagtggcggcgctgcacccacctatgcttggccaccccatgggagcaggacctgccgttgccctgacaacaccttgggagttagactgtagtcgatacggaaatgaagacaagagtgccttatttcctttccgaagtatttcactagcatagactctacttgaagtcaacttggtccagattgaaaagtgtcctctggcctgaggtggccactaggcccagacccagtccagcctgagcccctaacaactttgccctcactgttccccagaactatgcaccctggacttctctaatagaaaagtctccacccctacacaaggacagaaccctccaccctacccccaacctcagacagacttatacacccctgagtgaggattacatgcccatcccaggtgtcctaggaccttttgccaattactagccccccagtggtgaacagaactcccaaattttgagttgcacccttacacctgtggctttatgagctcagcctcgctttgaggtacccaccgtctgtcagtcacttgacta

SEQ ID NO: 689833 - DNA, 141 bp, Homo sapiens
ggacagtggatttcgtacttctgttgcactacagaattctaaagttttgaaaatgtgggaagatgtgacatagaccgtggtaggatcatggctttggcaaagaacttctctggccacaggactgcagaagcggacagagca

SEQ ID NO: 689834 - DNA, 308 bp, Homo sapiens
catagctagctactgtgtgataggcaaggtaaagttattatggaaactcaaatactataagatgtgtcaaggtatttctccagaattaattgcaacgcacgtgctgaaggattttaatcagcttctaaaattttcttctcaataaggcatatgttttgattacttagggaagattcctcatttttatttgccctttatgcatttaatccacatgataggacattaaaaattaatataaagaaaaatcgtgctcatactgtacatctgtttctgtgcttggaactacttgttaatagcttttatcgaag

SEQ ID NO: 689835 - DNA, 232 bp, Homo sapiens
  misc_feature (62)..(62): n is a, c, g, or t
  misc_feature (66)..(66): n is a, c, g, or t
  misc_feature (68)..(68): n is a, c, g, or t
  misc_feature (83)..(83): n is a, c, g, or t
  misc_feature (202)..(202): n is a, c, g, or t
agagaaagccaaaacacattatgatgccaagaagcagcagaaccaagagctgcaggagctgncggnanctgggagcagctcangaaggaaaacaaagagctgcgagctgaagctgaacggctgggcatgagctacagcaggctgggctgaagaccaaggaggctgaacagacctgccgccaccttactgcccaggtgcgcanctgggaggcacaggtaagaatttggctggc

SEQ ID NO: 689836 - DNA, 410 bp, Homo sapiens
  misc_feature (209)..(209): n is a, c, g, or t
cacgaggcgtcaactgcggcttgtgcctcggcgatggcgacgcgattggcatcgctaggatcgtcttggtaagcctgttcagccttcttcagggcgagctgcgcatccttttgcttgctgttcgcgatgtcacccacggtgcgcgctaccgcttcaccagccgcctgcgcggcggccatcatatcggcctgctcgctcaatacattagncaaatccgggttcttgcccactgtggagttcgtggaagcggtatcccggttcagcgtcgtcaaatcctgtttttgatttgccgtatcggtaattgtgatggtgccggccgaaaccccggcttgcgcgagaccttcctggctaccgctgtcactctgcgggatcatggggctgatgccaccagtgtttttccccgaagtcgg

SEQ ID NO: 689837 - DNA, 907 bp, Homo sapiens
cgcgggctaccaagtgtatacaaccgagtccgctgtgtgcgcaacgccgtggtaatgccgctggcggcgccattccactaggcgtcgtgaacagcaacccccttaaggtaaaggtgggcggtgaaacactggccggcaacccaacgggggggctcttaaccacagccagcccccacctggggcaacccccgccccccctggaacaaagcggggccctgtcagaaagaaagaccggggcccctgcacttccaccacaatctcgagagacccacagccccttggagctcgcacactcccgcgatcggcaacacaccttcaaaagggctaacaccccccaagcggtgttgggcacactccccccagatcgctgggccagggaagcccaccgtttttctgggcggatcacctcccgagacaggtgtgctcacagcacaaatatgcagcacactggttgtgcaccgcccccgattcaacaccctggctgcaacaaccctgcgcggggaaacatgcgaggaaaaacacaaacactgggccccccttcctggacccatggaaccacgacattcttgagggagaggaaccctctttatatgggcgaagtagacacaaaatttcacggagaatgtttaagaacaagccgatgtctcgagaccgcagtgcagtaaccccgcgcgcagctctctctggagtgcagacccccagtgggtgagaaggcaacaccacccggcgaacacagtaacaccctgtgggaacggcgctgcacctgttgcacatgattctatggcgccacacagtacgtagttgttctcctgtctccccccaaagcccaagtaatgtatgcgctcattatcaaacccatacaaacttgcttaaatttcctgggtaaatggggagggcgaacaaaaaa

SEQ ID NO: 689838 - DNA, 549 bp, Homo sapiens
gagcagatcagtcagtccgacggggataagaagcccatggtggacgccagtcacttcctgccggccggagacagtgtcgcgagaaaatgattttccttctgaagctcccatctccttgaatctctctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgatgggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctagctggaacaccccacccaaaatgactgctgc

SEQ ID NO: 689839 - DNA, 933 bp, Homo sapiens
  misc_feature (849)..(849): n is a, c, g, or t
tttctttctgagacagggtcttgtactgtttcccaggctagagtgcagtggcctgatcttggctcctggctgggcccaagtgatccaccgccctcagccttccaacgtattgggattacgggaatgagccactgcatttggctaagtttttgtttatttttcttctctattcttccaaacttatttgattagtaagataaagacattaactgctgttgacagtttccatttttaattagtaatcaggagcatttgttgtatttttcgtcttgataatcagaataagtgttaagtttcgtgcaataggatcaatagcgtttctgtattccaacatgttaatgctggctgtaagtttcacttacatatgttgctttttcgcacggttcgtccttctgttcatagactagaaatgtttaatgttattcttccatggttttacaagcgggacgcccagttgaaaggacgatccacgtcatttgaaaatcttacgtgggtatggactacactaatcatacttgaatcagtctactatgctcgacatcctaactctgtagaataattcatcaactatgtacgccttcttataagcaattcctatgaaccatttctatgatatctatacgaataagctaattatcctgtgccgcgagcgctggtggttcgcatctcgtcggtcccagctactcttgcgagatgtgtctagagggcgtgtaggtattatttctgcaggctacaggtagtgtacatggaaccagccatgcccggccgtagcgtgagacccctctctctatctgaaaaatgcaataaaagaaaattgccctggctgtgtgtggcacgtccctgtgtgtncccggtctgctacgggagctctagatgacgggaggtactcgcttgaccccgggagtacgacgtttggcatgctggcgcttgaga

SEQ ID NO: 689840 - DNA, 514 bp, Homo sapiens
attttccatttaaaagcttgttattgtggaaaagcttctctttttttttatttaaagcctggatacaacaaataaacggcggaaattcggaaaaaggtatgaatggcgcacttcgaatgttgcaccaggagcttgttcttagccttcataataatttggaaaacagggtgaccatacaacgcggcctttaattgattactataggcacgatgatacgatagagcaaatattcaagccttcaactaaaagactcatgtcgtaactttacccgttgacttagggggctcaaggcctggattatgcctttgaaaaccgaacggcgtttatacaaaacacgtggacgcattagcaactggtgagataactgacaaggtaacgatttccgctggctctttggggcaccaggccactaacaacctatgtatgagtcagagcagccatatgctgttcttcttttttcgcatgaaccaacgagagaacgctcataaaagcacccagagtgaagcgacaaccg

SEQ ID NO: 689841 - DNA, 117 bp, Homo sapiens
gggggggggatttttttcccggggggccctttttcccccccaaggggccttaagtccccccccccaggggaaatttttttggggtttgtggtttaaaaaaggagaaagcccggtcca

SEQ ID NO: 689842 - DNA, 1034 bp, Homo sapiens
gagccgtggcctgtgtcttcccgagtcctgctcgttggtcgcggcgtctttaagtggccgtcacgaacaccagtggtggaataattcgctaccattgtgagattgatactcgcttcgccgccgttgaagttgtcagtgaggtgcgacgcgcgatgattctacgggcgcccggatgagacgtggcctgtcggtggttgtgtccctctcgtctacctcctctatgggagactcttgcggtcccttggagagggcctcattggcaacgtccatgacacctccgctggggtgggcctgctagggccccgagccgtcccaagcgtggcgctttggtgggccctattgttggagcctccggtgtcggtcggggaatatgcctagtttcgtggatatttggaggacacccaggagtcggcgtacgggggcgcgcaccaggagatcggtgcaggctggtgcacaaactcccaaaaggctagggggggcccgggttttagacacgccgggcggcgcagacgaacgacggctcggccccggacaagcctggcggccgacgggccccctgttgtgaccaaagagcacgggtaatctacggagttggccgccaaatgagaggaggggcccccacaagccaaacgagaggcagggcagcaccatgggaggctgcacgccggatgactgacgattagacccgtggtagagtaaggttcaccaaccgccggggtcgggcaacagggcagcgtcggcaaaagaatgcgccatcacgtaggtgaccggcccccaagcgaagaaggaagggtcacgatggctcccgtgttggactaggtcctggcaactggtggaatccacgcctcgggtcgtcgtcggcacatggcaaggtgccgctgtgggctcacagcaccgacagacggctggagcgcgggcacccgctcgggccgggggggagcccagaaccacaatcaccgggcggcggggaccctcagggacgattcctggagagagatcccttgacagccggaggctactccaacaaacagggc

SEQ ID NO: 689843 - DNA, 374 bp, Homo sapiens
acactgcctcagaccagcccgtatggcttcctgtgacgcagagatcaggatgaacgcacctgcagaggatgtggacacagagaggtgacaccttcccccagggactcaggaagccatacgggctggtctgaggcagaacagcgtatagacagaggggtcagtagtgccgaccatggcatctccagacgtgacccatccccatggtttatgggccggacacgcaccccgctcagctgaggccccatcatttgtctctcttagtgtgtgtgcctatgctttgggggtagtgggtggaggagggagggtctgtgctaggcagttgacaggaaggggaatgggaccggaaggggcctaagagggggaagggttaggat

SEQ ID NO: 689844 - DNA, 123 bp, Homo sapiens
gtggctgtctagaggatcccatcaaatactaaaaaaaaatcccagtaatcacctatagtatgatcattgcttttggtttcttcatttgtttttgagacacagtctcactctgtcacccaggct

SEQ ID NO: 689845 - DNA, 184 bp, Homo sapiens
gcggccgcctactactactactactgctctaattcaagcttataacgatgtacggcgacatggacaaagagagaaactgtaaggaaagacaatcacaaacttcaacccaaatcaatctgactggtccagaaatgggggactgtgatagagaatctttaataaagtggcttttcccaccaaaaaa

SEQ ID NO: 689846 - DNA, 91 bp, Homo sapiens
acggccgtgtattactgtgcaaaaagcccatattactatgatagtagtggttattgggagaactggggccagggaaccctggtcaccgtct

SEQ ID NO: 689847 - DNA, 221 bp, Homo sapiens
ttcccctgacgcgacgacgtctgacgtgtacgacgtgccgtgactccacgacgcgggacgacggctggggccgttgggggcctggatggctggggcctggttaccttggtgccgtgccgacgctctctctggggggctgccgatcactcttgggggacgctggactcagactgcccccgtacggtgcctgacccaccccacgggggtacccggacgctcga

SEQ ID NO: 689848 - DNA, 184 bp, Homo sapiens
  misc_feature (125)..(125): n is a, c, g, or t
aggatccttaaggagagagaactgaggagcacgatgtaacagacagaagcgggggtgcggggacagggaccgtgacccagagcacctgggttcgcggggcgcagcaggccttggcctgcccactngatcgggcctcagagcaggcggcaggcgttgcccacgcctgtcagccatgaggtgtcaa

SEQ ID NO: 689849 - DNA, 838 bp, Homo sapiens
  misc_feature (698)..(698): n is a, c, g, or t
  misc_feature (809)..(809): n is a, c, g, or t
tgtgtaaaattggcaattaggaaattatgagacgagtgttttggataatagatggaatattaaaaatatgagaagataagttagtaagattatgaggtaagtagaaagagaatatatatgccccaaattgagaaattagatatatataaaaaatataaagaattagtatgaagtaatggtgggagtattaaaagataagttaattgtaaagattagagagtagaatggagtgaaaatagggagaatagaatatagtgagaagatgatggtatattagaggaaacaatggtagatagaagaagatagtaaggaagataaaataaaaatggaataaaaaaatagttgataataaataaaaaatatatgaagaataagattgaataaatttatgttagaaggtatatattataaataaatatagggaagttattataaattaagtgagattaagtttaagggtataagtaagatatatttatataattttatagaaaaattaggtaaatgataaaaatatgtggatttaaaagagaaagttaaagagagtatatgagtggaaaatattatataaaatgaatagaggcaaaaagagttaatatttaaaattatgataaatagaatatgagtaattaataatataatattgatatcagaataaatgaaataataatgagtaaaatgatataaatgagtaatantgtatgtagttatatagaatatatatatataggatttatataataggacgataataaggatttaatgacagcagaactatactctaatatggaagattaatagagtcaggntataatatagtatagacgattatgtgtct

SEQ ID NO: 689850 - DNA, 407 bp, Homo sapiens
cgactctacaggatcctctgctgtcttggaatctgacattagagggtagcgaaactttacaatgtgtggggcagcctggtgtggtggctcaggtctgtaatccagcactctgggaggccaagcgatggcggatcactcgagccctggagttcgagaccagcctgggcagcacgatgagaccccatctctacaaaaattagctggacacggtggtgcacacctgtggtcccaccactcaggaggctgaggtgggaggatcacccgagcctaggaggtcgagactgcagtgagccatgaccatgccactgagctccagcctgggagacagagtgagaccccgtctcaaaacagaaaaaaagtcaccaggcatggtggcacatgcctgtaattgcatcactttgggaagc

SEQ ID NO: 689851 - DNA, 539 bp, Homo sapiens
  misc_feature (44)..(44): n is a, c, g, or t
  misc_feature (500)..(500): n is a, c, g, or t
caggataagaccagtgttggcagcacagtagggtgactgtagtnaacaataatttatggtatatttcaaaataactaaaagagtggaattggaatgttctaacggaaagaactgattgatgtttgaggtgatggataccccagttaccctgatttgattgttacacattgtgtgcttttatcaaaatatcacatgtacttcataaaaatgtacaactattatgtattcataataattaaaaatgtaagaaattaaaaattcaacagcaggccagatgtagtggctcactcctgctgggaggccaaggtgggtggatccgttgaagccaggagtttgagatcagcctggccaacacagtgaaaccccatctctactaaaaatacaaaaattatccaggcacggtggcatgtatctgtaatcccagctactgggaaggctgaggcacgaaaaccactcaaacctgggaggtgcaagttgcagtggagctgcagtggcaccantgcattccagcctgggcaacagagcaagacactgtctca

SEQ ID NO: 689852 - DNA, 225 bp, Homo sapiens
cagtcgtcttggaacctgcgtgtttgcctcacggttcatcggacaatatctatcttgtgttgcgtaacagtggagctcacttcattctctagcctcgtcttatgttattctggacttagaccggaattactatgccctttcatgaccttcttcacttatatcgtgcgtcttacatagctcttctcctgggttgtcacaacagatcttgacttgttgtctcgtgat

SEQ ID NO: 689853 - DNA, 332 bp, Homo sapiens
tgagtaagtcaatcttcgtgtcagtgctttcattgatgcttattcattctttgaattctcgcctctccccttatacaatctagagccctaatattctctatgtcctggagctcgtcgcaccttacccaaaacacagctgaatattcaatgacttcttctggagtcatgccttctacttctctagctatatttacaatatcatcacgagcccacttctcattagcttcgataaactggttaaaatctctcttattccaattggtacatccctatgttagaagcttctctttatcctctaactcttcatcattaagggattcagcttcatcaat

SEQ ID NO: 689854 - DNA, 183 bp, Homo sapiens
cctccagcaacatctggcccagctgatcatgttctccgaacgctttactctgctcccaggatgctgtgtggtgtggtgttgatcatgttctccgaacgctttactctgctcccaggatgctgtgtgatcgcggtgctgatcatgttctctgagcactttattctgctcccaggatgctgtgcg

SEQ ID NO: 689855 - DNA, 110 bp, Homo sapiens
  misc_feature (58)..(58): n is a, c, g, or t
gcagttcagggtagacttcttggcaatactgcaggatggcttccttggtatcaatgcnggtttgggtccctgatggatctgaatcccacttcccattctgggaagtataa

SEQ ID NO: 689856 - DNA, 240 bp, Homo sapiens
aggagaactgtagaaagaaatgagaaaatcagttcgtggattgcattgtggatcaaatctgagcgttctcaacttggttattgtacacaaaaggagagaaggatattccatggactgactgatactacagtgactcgcagactgggccccaaaagagctagcagaatcacgcacacttttcaatctctctaaagacgattgatgtccggcagtatgttagtaagaaagcccttaaataaa

SEQ ID NO: 689857 - DNA, 114 bp, Homo sapiens
cgaggacagctgaactttgaacctctaacattggttccaattcagaccaaaatgatcgatgtggattctcttacagacaaagagtgcgactggctcaacaattaccaccacggg

SEQ ID NO: 689858 - DNA, 828 bp, Homo sapiens
gagatcttgtccagcagctgctggctgccagagaggcgccttcaggagacccagcgcttacagccaatagcccaccatgtcccaggctggtgctcgaggaagcccctatcatgaaggaagcgcccccctgtgatggaggaggacctgaagggggtcctaggaaacctgaccaagaaccaggaaatcagagtcataaggacctaccaggtcatgcgagacgtgtgagcaagctggctcggcgccccgtcggttgttcagttccgcatccgcgctgaggtaccgagactgtctttgatgaagtccgaagccggacctcaccaggagtgtcttcggctagacgaaaaggtgttgccgccactcccctttgctgccagaatggtcggtaatcatggagccttacccaggaactctgttttgatgcgcagaagcttgcatctcccctgctgtctctggggctgcacaaccttgccccgcacaagtccaggcggcttcagccaaggtctcctgcacccagtacctttggaagcacctgtgaaagatgggtgccctgtggggacccaaggttgagtccactgggtattactatgaagaccaacttgacaaagggtagctgactggatcagtgctccggaaaagcaattcctgacaattacgcgtgggggggcgcccaatacagaggagtatcttcggcatggaggggtcacactaaagaaaccgggtccgaattgggtgcgcgtgacacaaaaaaagaacccgcggggtacgggctcgtggaagaaacgagaggggctcggggcagaggggcccaaccgacaagggacatgtaac

SEQ ID NO: 689859 - DNA, 838 bp, Homo sapiens
agccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatatgtgatgttccttgtgtgatgttgtgcaacagaactacatccgaaacccatatttggtgggcaaactggtagaagtcatgtttatgaccaacctgctgttcagccacgaacccagaagtttctgaaatgattgaagaaccatcctctctccacaagttgtggtacttcctgatgaagtttatacgatgtggagcatacggaccacaggagtttatgacaagtcccaatccgtcattaaattgccatttaaaagcttggcaaactttccccg

SEQ ID NO: 689860 - DNA, 399 bp, Homo sapiens
tgcggattcctgtggggaaattcggtcagaagaccagcggaggatccctgtggggaaattcacaacgatgcggcatctgacttcctgactctgaaggccaaatgagatgcacctggccctcctctccccactccccagcatcaaagacagcatttccagcccaaacaccttcagagcagccctggcgagaagagaggagcaaggaactgactccaggtgccgcacttgagtctgtctaacccaacattcagaatcagacatccccgttgccttggggtcagtccccaccccaacctcaaaggggggcggtcaggatgtctgcaagtggtgctttgtgctccagcaggtgcacccggactccacgatgtctgcctaacttccaagcccagttttgcagcc

SEQ ID NO: 689861 - DNA, 600 bp, Homo sapiens
tcagaaaagaaaataactttccagttatcagaatataggtaccattgtcctctaatatttaagaacatgaaaaatgggactaaagatcagaaggttattttagtgagccaccacacctggccactttttcattttattaatggcatctttttaagagcaaaagatcttatcctgatgatgtctaatttattgaaaaaaaatttatggggctaatgctttatgtgtctaagaaatatttacctaccccaaagttgtgaagactttctttgatgttttgtcctaaaggactgacagttttagcttttacatttaagtctatgacccatttcaagtagacttttctgtgcagtgtgaggtcaagattgaggttcatttttctccatgtgattatttagttgttcaacaatattaaaagagtattctgttcccattgacttacctggcatctttgaccacatacatgtgggtctatttctggactctattctgttctgttgatctattttctaccctgacagcataccatactgcactgattattgtagctttataagtcaagaaattatgtagtcctcaactttgctctccttaaaaaaaaaa

SEQ ID NO: 689862 - DNA, 861 bp, Homo sapiens
gggcaggagaggttgtggtgctagttgctctaagccatccagtgccagtcctcgtctgctgcatgcagacacactgctctcgccagcgccatgactgagcagatgacccttcgtggcagccctcaatgggccacaacaggcatgggtaacgccagatcggctacttaccccagcaggttccctggacatgatcctctccgcctctcgagataagatcatcatcatgtggaaactgaccagggatgagatcaacgtatggaattgccatagcgtgctctgcagagggtcactgcccaacttgttacgtgatgtggtatatctcgctcagatggccagtttgcacctgctacaggctaccttgggcatggaactcctgacgacctactggcgatctcgacaacgaggcatccaccactgaggccgagttgatgggcccataccaaggcatgttgctgagctgtgggccttctcgctctgagcaaccaggcacgatggtactctggactctgcgagcattgaatgaccgatcatagctactggaatacccgtgggctgtgctgcgaaactacaactagtccaagcgcatgatgcagccactacagcagctggcgatgtctcagatgtcccgctgtctcgccgcatacacgcacggcaaccctagtcatacgtacttccttgtgcgctgggacaatgctaggtcacaggtcactggaaccctggcgtaaacctggcaacgcgtcgaagaaggcaaatcgacaatttgggtccaccacaggcgtaatcgttgacaccgagcgcgtgaactgggacttctaccaagaattgggacttccattctgctgccttaattggcagggcaag

SEQ ID NO: 689863 - DNA, 199 bp, Homo sapiens
tgcagccctctgatgttacagaatgagtcaattacatggaattctttcgaggattaaatatcagtgcagtgcgtttaccacgtgaacccatgtaatccatgagaggctgacaaggttttggttactgctgaactctgtagtgacctgcgtttccctgactcagatgcccttgtagttctcacattgtacagagtctcta

SEQ ID NO: 689864 - DNA, 622 bp, Homo sapiens
gccattgaagtacatagaggcccagattgtcagcaccggggcaggtgaaagccgaacgggcactgggcgactctgggccttgctgcggaaaaataactacaacgtgggcaaaggagatcctaagagagcgactaggcgcaatgtcatcatatgcattctttgagcaaactatgggggcaggagctttatgacgaagctcccacttgctgaagcaaattctaaaaagcatctaagaagcggtcctagaggcggaagaccacggctgctaacataaaaggaaaatttgaagatatggaataagcgagcaggggccgctatgaaagagacatgaaggcctatatccctgccataggggcgacaaaaaagagagtcagggagcccaatgcaaccatgaggcccggcttcggactttgtgctgttttgatacgagcaccgcccaaaaaataaaggaaaacattctggcctggccatggctgatgcccgcaacaaactggaagacacgtggaataacactgatggagatgaaaagcaggcttatttaaacaaggtttgtaactctggaagaaaaaaaacgaaagggatatttgggcgcaatcttgcgtaacgaaagcctggatctagg

SEQ ID NO: 689865 - DNA, 223 bp, Homo sapiens
  misc_feature (81)..(81): n is a, c, g, or t
  misc_feature (123)..(123): n is a, c, g, or t
cgtgaccacctgtgttccagtccagttggcatcattttcagcacagcatgcaactcacttcccagcatcagccatttcaanaccagccattcagccattttcgcaggggccgcaaatcacatncatcacgtccatgtcagggcatcccacgcgtgcaggacacaacagcttccaagccaggcacctctcaccaccatcaaagccattcccatcaggccacatt

SEQ ID NO: 689866 - DNA, 333 bp, Homo sapiens
atcctccccccttgtagctggggctacagctcccagcccccctggctaaaattttttttttgtttagacggattttttatgttgccccggctggtttcaggctcctgggctcaaatggtcctcctgcctcagcttccaaaggccccggcccagttgtagctttgtcccctgccctcatgccccaccaaaggttttataccttttaatgaattgactttcataaattggttatgttggtgggccagtttttttagctggaaattgtaaattccccctgaaatgttttttcatgccgtttcccttaacttatactcccataaaggatggttttgg

SEQ ID NO: 689867 - DNA, 117 bp, Homo sapiens
atccaccattaaccttccctctacactatatcatactatcacaatactaataactactagactatcctagaaatcgctgtcgcctatataacaccaagccccagatcgaggcgggga

SEQ ID NO: 689868 - DNA, 329 bp, Homo sapiens
  misc_feature (164)..(164): n is a, c, g, or t
  misc_feature (192)..(192): n is a, c, g, or t
  misc_feature (322)..(322): n is a, c, g, or t
  misc_feature (326)..(326): n is a, c, g, or t
atggtcgttggggtggttgtcatgtgatgggtcccctccaggttactaaagggtgcatgtcccctgcttgaacactgaagggcaggtggtgggccatggccatggtccccagttgaggagcaggtgtccctgagaacccaaacttcccagagagtatgtgaganccaaccaatgaaaacagtcccatcgctnttacccggtaagtaaacagtcagaaaattagcatgaaaccagtttagcattgggaggaagctcagatctctaaagctgtcttgtccccgcccaggattgacctgtgtgtaagtcccaataaactcccctnctcntca

SEQ ID NO: 689869 - DNA, 848 bp, Homo sapiens
ggaatcactcagagggttcctgctgttggcggtgccttggtagcctactcgcgctcgcttcgtcgtttctagctgcgcgccagtgagcccgtgtcggagtcggcggtggactcgccgtgctgtgtcggtgcgggcgccgcgcatgtggttgtggtaggaccagggtcggcctcctggtgccctttctccttcctgttgactagtgctgctggctgggtgatcgcgtgagtcgccgggttgtctgtccatgtcttgcctcatacgtgccattgcccatcgtctcgtctcataccttgccgcgttcgttcagtcatttgacgtccgggttgctcctcttgtgcgaggtggcgccttgctacggatgcgtcacacgtcgctccgcgggaccctgccgacttgttcttgcacagtcgaccgcatcctggtgtgggggcgaggacctaccgtaccgacgacactctgaacggatagcgaccgccgttgagcctgggacgctaacttacgagacgacgagcaagacgttacatgaagttgtggaagtcacaacacgtggcgatgggatgtatggtagccactctcgtaggctattcacgtctcgtcgcacgtgggacttaccttgatcgtataaagtagacaacgcatatacatcagatagaactagtggacggagtgccatggggagctggtgccgactgtggtggtggcatcttgtaacaattgtgaatcagaactattgctaaaaccctcgcagagtccagggggaactatccccctggacgccttgtctagggggggttgcttcttctccgtgactgcatggagatcctcataggcccttaggggaaagg

SEQ ID NO: 689870 - DNA, 384 bp, Homo sapiens
gatcaggccaatgacactgtcccactactattcatgcgcaatgtctgtgacagccacgatgaagtggtctgcaccgaaaacctcacccccatggcagaagcacttgccctgtaattccaaggcaggcctctctgtaactgatgaaggacagatcgattgattccacaccagctaccactccacaggcagatgacatatccgccctgatttgcaaaaaatgcacgctgttctagcatctcctgggagctgaggcagaccctgtctgttgtctttgctgccttcatcacggtgcagggaacgccagagtggtccctcttccggatgttctcccgaaccctcacggcgccctgccccctggcttcagcgagccgagtctctgtggac

SEQ ID NO: 689871 - DNA, 331 bp, Homo sapiens
  misc_feature (72)..(72): n is a, c, g, or t
gcttagtactctttccctggctcttttatatcatgtttaatcactgctctgttttctcatctatgcggtaanttagcgggataaatggatttctaaaattttttgatttcgtgttctctccatcccaaacctcattgtggctgtattttagtctcctccattaaacttttcctagagctgccaacagctcagtaatgaatttcgagggctacttactgccaacccccattgcacctacatttgttctacaaaaccccctagatggccctccctctggtagctctgtgtgtctacaggtattgactggtgctgttcactctcatcttgggat

SEQ ID NO: 689872 - DNA, 199 bp, Homo sapiens
tgccagatcgcgccactgcattccagcctgggcaagcgagattccatctcaaaaaaaaaaaaaaaaaatagtgtgaaatgtgcgatgagggaaaagtgtttcagcacttgaaataccttgtaactatttcatttatataatattatgatgcacctgagatcatcaccatgcctgaaaattggggcacacattatggagg

SEQ ID NO: 689873 - DNA, 796 bp, Homo sapiens
gaatttgagagcacaattggttttaagctcccaaaccaccggatcacgccacaagagactgtgcgaagggtctgctaatcgagcatcatacattctgtccgagctggtgtcccctgaagcccccatccaagggcattcttctggtgatgggctccaagttccggtacagtgggaggaccctggcacagactcgccaggcacagcgccctgcattgatcgggctgcacccttctttgagcgttcttccagcaaacgttgtacagcatgtcccgcagccttgatggagccagcagttctgccgcccaaggctctgcgtcagccgagagaccacggaatgcgagggcctgacggtggatcaagcgggatgagtgatggctgatgtctggtggcggcaacggtccagagggctgagtgagggagaggtctaggattccaaccccgaatttgggatcttacagttcttagacaagccataagatgtcgttgcgtgatagcactcaggtcgcagcatcaatagagcgtccacaatgggaccctgagaggaggtcgcttggcaagtcagcatcttcatgccaccgggcatcgaagactggagaatctgagtaggcgcggggtctggccctacctctcgggggtcctaagcatttcctcgcaacggtgaaccctgtagagaggggaaagatcggcgtcaaatcttttgggccgtgacctgggaaagggattttgagcccacactaggaaaggagttgaagctggaggctcgaatgcagatctgatgtgctggggaggctggtac

SEQ ID NO: 689874 - DNA, 970 bp, Homo sapiens
ctggtcacaacctggccagacaggtccacaaaggatcgatgttcagggtggacctgtctggtcacaacctggccaatcctcacccgtttgcagttgtccccagcacggcgacagtggtgattgtggtgtgtgtcagcttcctggttttcatgatcatcctgggggtgtttcggatccgggctgcacatcagcgaacgatgcgggaccaggacacggggaaggagaatgagatggactgggatgactctgccttgaccatcaccgtcaaccccatggagacatatgaggaccagcacagcagtgaggaggaggaagaggaggaggaggaggaggagagcgaagatggggaggaagaggaagacatcaccagtgccgagtctgagagcagtgaggaggaggaaggaggccccggagacggccagaatgccacccgacagctggaatgggatgactccacactcagctactaaacccgcactcagcgcctgctctccagactctctcccagccccacgggtccacgatgtacaaaatcattttgaccagcaggtctgcagacccttcccccactgctcaaagtcctcccgtgcttggtgtgtgggaccaccggctccaccctccccgccatcacattggcagttttgctagaagctggcgctttctccccagggcaggggccccacagcaacctcagaaccccaagtgtgtcctggagttcctgtcggcaggagaggacaccaggcacctgggaactcagagaagcggacttgagcgactgtcaccgaggtgaaaaatactccacgcgcagtacccatttccttatttaaagtttaatttttccccccatcgcatgttaagggacacaggggttatgttataggccctttatatgacgaacaggtaggtctcggcacacccaaagacaaggcgaggagcacccccaaaggtggatggcacgatgccacaggta

SEQ ID NO: 689875 - DNA, 101 bp, Homo sapiens
ggaataatccttgaaattttgatttttggaaaaaaaagttttttttcttttgttgaaatcccctgttacccttgtttgtaacctgataccgggtgttttca

SEQ ID NO: 689876 - DNA, 1207 bp, Homo sapiens
agcggctctcttccgtcgccattgtaagatccagctccatacaacgctccgactggcgcgtgctgacgcgacccggactgcgcgccagtgaccccctgccgacagttccgctccacttacggaggatagtgaacgagtacagcataatatagaggaagttcgcaatgagggatcccacagactcaaacgtcgagtcacagaactcagacatgcgatgacggtaaaaactgtgagtaggaaggcgtatgacgctggtgagtacaacgctggaaaaaggaatctagaacaggaaggtacctttgatcgtccgacgtttgagcgagcgaaccggttggtcaagagcgtgcagcgaattctagagatcacaggagtccgacgtcagcttggtgaacgcatcagaggagcgagtttggggagtcccgtggctgtgttcaacacgactgcctgcctaggtccggtgttgaacttacaggtggtcttacggtgcaaaccttgagagataggcaatcagcgatagaacttgggaattgcgccaggaatttcgaatgaggcaattcccccacacaaaggggtcccaagaagtcctttcacctacacgggtgagccacgaaaccgtcccgaaacaaggattcctgtaggcgtggaactgtgagtcccgcgcatgtacgtgtcttgtacaccgaacaaagatgcacaagagcaaactaatgatgcgggagcctatcggcggagccaggcaattcgggagacagacttactttggacagccgtttcgcaccaatgggcattagccagaggagaaagccgaatatgcatacagcacaaggcaagggacctctggtgcgccttgatttagcttccagcacttaaatacctttggagtttggaacaaggaaggccacaagcgtttagagcaaacaccacccgtgcggtgtacaaggaaatgaggggccgacattaccccaatttcacaacggtttagggggttcctagggggcgaaacagcctggtttgaccagaacatttccaacaaagtgtgtttgggccgaacaaaacgtccccagcaagaaagataggggctcatttaataaacggggccaggcgcgacagcctatggcgaaaacccgaaatcctcagaagacgtacgcgctttgcggaacgcagcctgtggttgtcccaggcgaccggccgttgtgcgttgcgacag

SEQ ID NO: 689877 - DNA, 717 bp, Homo sapiens
agacaacaaaaagaagagaaaaaaaaaagaacctccttggaaaaattaataggcttctgcgtaagtggattctctatgctaaatgctctctcgtgctgtctgtctgtctgcccatgtcccccagcccacgcacggtgcgtactctgatgtcccaaattgtctccaactccctcagcgaggtagaggctcaggctggagagaggaggcgataaagtatcccctttgctccagtagaggtccctagagctctttcgtcgtcgaggcacctttgtagaactatgaatgggaggcatgctaaacccagaccctcatccagtggcaaccccggataaagaaaagcttgaagcccgcaacccgccagggaaggctcactgaatacccaccgtggacaagaagcatatgagacgaggtcgcgccatgtaaccccaaagacgcgtacgacacatcttgctcagaccccatggagagaacgaccacactggtagacaagcacggatggcatgccatgaccagagtatggacaacacacaaaatggacaattgacccacgggacatatccaacatagggcaagtagggacaccgaccaatgagggaacaaaacacagcagcaggaagtggactacgtcagaccatagcaggtatgacaaaaacccgagaacgggagaaacacaaaagagaagcaatcgagtaggacacaaagaaatacgagaaacaa

SEQ ID NO: 689878 - DNA, 348 bp, Homo sapiens
  misc_feature (9)..(9): n is a, c, g, or t
  misc_feature (81)..(81): n is a, c, g, or t
  misc_feature (95)..(95): n is a, c, g, or t
  misc_feature (109)..(109): n is a, c, g, or t
  misc_feature (135)..(135): n is a, c, g, or t
  misc_feature (212)..(213): n is a, c, g, or t
caggaggcnaacggatgctgcctgactgcaagttgccggcgacgatgcccttggtgtgggtccatgttcccatgccactgncattgcctctcaantggctgcacgcacngcaggtgcagcagcatgccccatgtnccgccaggaatggaagttcaaggagtgaggcccgacctggctctcgctggaggggcatcctgagactccttcctcannctggcccgatggctgctggggacagcgcccctgagctgcaacaaggtggaaacaagggctggagctgcgtttggccatcactatgttgacacttttatccaataagtgaaaactcattaaactactcaaatccca

SEQ ID NO: 689879 - DNA, 808 bp, Homo sapiens
agtggtggctcacgtctgtaatcctagcatttgggaggccaaggctggtagaccgcgagtcaggagttcgagaccagcctgaccaacatgtgtgaaaccccatctctactaaaaatacaaaaattagccaggcatggtggcgcatgcttgtaatcccagctacatgggaggctacggcaggagaatcgcttgaacccgggagatggaggttgcagtgagccgagatggcgtcactggcttccagcctggtgacagagcaagacccggtcccccaaaaaataaattaaattacattaaatatacacctacactaaggaaaaataccaccgttgagaaggggagggcactaggtgttgtgagcaagtatttggcaggaagaaggaagtaggagttcagtggtagacatagtgaattgtgcagtattgtgtatgacagcaaaaacacaagatttttagttttaaagacaaaaacagaagcgaagaagtaaacatggaaatcacataatgtacttatgggtagatcctaaaaattactacttataaaggccaggtggttgattgcctgtaaatccccagcaccttgtgggaggccaaggcacgggcggatcacttggagggccaggagttccagggccagcctgggttaatattagcaggaccccatttcttaaaaaatcttcagttcacacaaacacaattttgttaacctcttggtgaaacgttgcgcaaaaacaaggcggggaaaccttttggcgcaaaagatcagggacggaagctcctaaagaaggggggggcaaaagggtaaccag

SEQ ID NO: 689880 - DNA, 494 bp, Homo sapiens
atatatcggctaaatccctgaaacagtggtgagcaagtagtggcctgaaaaaatgaagtatgagagccaattccggctaacaagattagtagtctcaggccattctagaggtcaatagagtaattatatggtactgaatctcgagtcatcccattaaacctaatggaattaggtagattgcagtcaacagactggaacatatttggatctgtgtcatcacccaaatttcatgtcacatagtactccccagagttggaggtggggcctgatgggaggtgatgggatcatggaggtgaatcatcccctttggtgctgttcgtcatgatagtgagttatcatgtgatggggtagatgacagagtgtgtagcgcctcccctttacctctcttcctcctggtccagccatgcatgtaagacatggcctactgctgctgcactttctgacgtgattgaaagttgcctgaggccatacgcagaagcagaagcgacttgatg

SEQ ID NO: 689881 - DNA, 222 bp, Homo sapiens
tggcggtattaataaaaaccaatttattctctaccctttcaaagattaagctcaaaggggggactcatctgtggaagacagaaagagagccccttatagaggctttaaatagctttggattatttttccgaggtcacctttactttctggaactcatggcttcacaaaaaagctgattttaaaatatttctaatgaactgattaaggggggaaaaaaaaaag

SEQ ID NO: 689882 - DNA, 334 bp, Homo sapiens
  misc_feature (3)..(4): n is a, c, g, or t
  misc_feature (8)..(8): n is a, c, g, or t
  misc_feature (22)..(22): n is a, c, g, or t
  misc_feature (31)..(31): n is a, c, g, or t
  misc_feature (44)..(44): n is a, c, g, or t
  misc_feature (49)..(49): n is a, c, g, or t
  misc_feature (68)..(68): n is a, c, g, or t
  misc_feature (84)..(84): n is a, c, g, or t
  misc_feature (105)..(106): n is a, c, g, or t
  misc_feature (110)..(110): n is a, c, g, or t
  misc_feature (112)..(112): n is a, c, g, or t
  misc_feature (120)..(120): n is a, c, g, or t
  misc_feature (124)..(124): n is a, c, g, or t
  misc_feature (131)..(131): n is a, c, g, or t
  misc_feature (134)..(135): n is a, c, g, or t
  misc_feature (139)..(139): n is a, c, g, or t
  misc_feature (142)..(142): n is a, c, g, or t
  misc_feature (145)..(145): n is a, c, g, or t
  misc_feature (148)..(148): n is a, c, g, or t
  misc_feature (152)..(152): n is a, c, g, or t
  misc_feature (158)..(158): n is a, c, g, or t
  misc_feature (168)..(168): n is a, c, g, or t
  misc_feature (175)..(175): n is a, c, g, or t
  misc_feature (186)..(186): n is a, c, g, or t
  misc_feature (210)..(210): n is a, c, g, or t
  misc_feature (217)..(217): n is a, c, g, or t
  misc_feature (244)..(244): n is a, c, g, or t
  misc_feature (258)..(258): n is a, c, g, or t
  misc_feature (263)..(263): n is a, c, g, or t
  misc_feature (273)..(273): n is a, c, g, or t
  misc_feature (325)..(325): n is a, c, g, or t
tgnngttntaaatttgcatttnatatttcanaattcctgtaagnggggntaggcaggggggaaacccncaagtttaaatccccncacttacttacttactgcccnnccgncnctttcgcnaagngggattnatnnttcngtngcnggnccanaacgcncagcttgggnacgcagnggcccaggccncatgtaatttcccccccccggaantgaacgngctgacccatgttgatgtctgccttcntccaggggggaaancaganatgctacgcngcccccttcaaacgggttccccgggttggggggaaagggccccgccaaactntgccactga

SEQ ID NO: 689883 - DNA, 523 bp, Homo sapiens
ggtaaaatggtataaattatctgagatggagtctggcccatcacccaggtcggagatgcagtggagccattctcagctcatggcaacctccgcctcccaggtccaagcgatgctcctgtctcagctgcgcgaagagatgggaccacaggcacataccaccacgcccagctaatggtggtatttttagtggagatgaggtttcgccacatgggccagtctggtctcgaactcccgacctcaggtgatctacccgcctcggtctcccagagtactgggattacggccgtgtgagccattacgcacctggcctggtcccacttcttagtcgcccctgcatagggatgccagatgacatacagatcaccacttacacttgatttccagataaacaataaataatgttttagcataagcctttccctaataccacatgggctttccggctactaaaacatgatttgtggtctgaaattcaaatgtaactgggcatctcatatttcatgggctaaatctcgtaactcca

SEQ ID NO: 689884 - DNA, 192 bp, Homo sapiens
cgcattctcaacgggtgcacgatatcgacggtttctacgacagatgtcatagatggcctcattcgtctaccatgaacagcacaatcagagtgctccagggctggtgtggagttggtgacggatgagaattgtcggagctcaacttacacgctgtggaaagctgagcgcgccgcggctaaatggaaaactcct

SEQ ID NO: 689885 - DNA, 1656 bp, Homo sapiens
ggctctgaaccctgaaaggctcgcgcatgcctactacacaagtataccctgtgtggctctggaagcggctgcagctgcgggagtggcatctgtatccctgcctgcccgcgcactacctgcgctccctggatcggactgatgctggctgcccactcccgctgcctcatagtgcctccactggcgcgccaccttcaccgactccccccccccgcaccgcggcgctgcgcagctgtgtgcgcccgccgtgccccttccccctcctccttcccccccgcactccccagcggcccctctgccgccgccgccgcacccccgcactccttgccccccccctactctcgccccccaccccaccactcctctcccccccaccgcctgcccacccgccgctgcgccgcccccgcctgtctcgccccgcccacctcacccccgccgcccccccctgcccccccccccctcccctgccgcctgtcccctgccggcccccttgccaccctccctcccgtctcacgtgctctcccggccttcgccacctcccccctccctcaccacccccgcccgcgcgccccttcctcccccccccgcgccctggccctgcacccccccgcctcccgcccccgcgctctcccggcccggccccccaccttgccccgctcggccctccactctcatccccaaccccccccccccccccccaccccctcccccccccccccaccgcatgcacaaccgtcctgaccccacccctgccggaccccttccatactccccctcggagcctctcccctctcccccccaacccatagtctgcagtagcaacaaacgcaccaaccaacaccggtcccccacgacctccagccaagcccgtccaccaccccccccctcccacccctccccccccccccccccccccccccccccccccttctccctaatatcctcccccccccccccccaccccccccccctctccccccctacccactcccaccccacaccccccccccccctcccccccccccccccccccccccaacccccaccttactctcccccacctcccaccccatccaccccctcacctaccactcacatcctccccacctaatcccctccatctcctccgacccccaccccaccccctcaaccactccctctcaccccccacaacaccccaatcacacctctctgccacaaccaagaaccaccaccgacccccgctcccctcaccatccccgaccaccccgcactctccccgtccttacctcccacatatcatacaaacaatatataccaactcctcctagtaccacccccttcacctcaccccgcaaccctctcgtaccctagcccagcccgccaacaccaccccccctttcccaccatccctcctcacactacacacaacaccgcatcacgacgacccccccacaccaccctcctccccccccctcccccttcccctacctccctcgtccgccctacccaacaccacccatacccgcccgtgtacaaccccctccacccaccaaaccactccatccatccccccacttccatcttctccctccccacacaaccacacacacccacatgatcccatcacctccgcacctaccccccccgctcgctcacccatccacacccatccctctc

SEQ ID NO: 689886 - DNA, 397 bp, Homo sapiens
gagaacacctcgtgctccctaccagctccagtacttggtcctgccagagactcccccagaacttgtcagcccccgggtcctagaggtggacacgcagggtgaccgtggtcgtgtcccgggacgggctgttcccagtctcggaggcccaggtgcagctggcagtgggtgaccagaggttgaaccgcatagtcatctatggcaacgactccttcgtcggccaaggcccgtcagtcagggtgaccgcagaggacagaggtgccccagcggctgatgtgtgcacgatagtactggggaaccagagccaggagactctgcggagagtgaccatctacagcttgccggtgcccatcgtgattctgacgaagccagaggtctcgaagggaccgagggacagtga

SEQ ID NO: 689887 - DNA, 603 bp, Homo sapiens
  misc_feature (492)..(492): n is a, c, g, or t
taacaacacagtattaatgtaataggggcatgcaagaacaacaaagtccttgacaataaccgtggaacacagacatagagtgctggatccacatgggggggagtgtggaccaagtactgggcctgaaggctggcacttgcttactttaacacatggagaagtgcctctgggtggctgttgattaatagaaaaggagctggtctggtatgacccaaaaaaagcaatctccacattcacatgtgaatcctccaagcgctagaacatgcaatagctgctcacgacatccacctcgaggtctctaagtttcagagtgatcactggaagcttgacagggacgcgtaacgtgatgggaacaacagcttagagatcaacgactttctaaaagacatcggaacgcacgctggcgctacaagtgtgggttgccacccatttgaccgaagaactatgcgaggccttgaaatgctggcatttagaaaacaagacaatcgtttnatcatgggggccagacttctgcagcaggtgaaggcactgtgcgctctacccaatggacggaaattaagcaggcgcctgtaagtccagctaagcgtttgaggatctaggaga

SEQ ID NO: 689888 - DNA, 306 bp, Homo sapiens
  misc_feature (12)..(12): n is a, c, g, or t
  misc_feature (138)..(138): n is a, c, g, or t
  misc_feature (141)..(141): n is a, c, g, or t
  misc_feature (279)..(279): n is a, c, g, or t
actctactaaanttgggagaagcaatgaaataacaaagaaacacacagagccaacataggcagagtgattttaaggagacacactgatctgtaagcctttaagacttgcctaaagctgcataaacatatagaaaaatncanaggaaacattgtttagaaggtgaaattcagctgaccatgaaagccacagaataaaaaaagcttcactttcttcctcttttacatattgggcttttatataagatcttggttttaaaaagaggcttgttgctttttaantaaattttcaaagatgtttccaatctg

SEQ ID NO: 689889 - DNA, 400 bp, Homo sapiens
  misc_feature (362)..(362): n is a, c, g, or t
aggagtctattactggcatttatttcagagcttgtgtatgagtgcaggaagacaatggaagcagaagtgaagggatcctccagctgacttgtggaagagccagtggggaattttttttttttggtgaaacagagtgttgctctgtcgccaggttggagtgcagagcaagactctgtgtctaaaaaaaagaaaaagaaaaagaaaaaaaaattagagagagaaagagaaagagaaaagcgtgtgctcacattacattgggtgtcacagaccaataggcgtgttgggctcccctttgtaatgaaactttaacagggactccaacgcagatttctccccagacaagggcattttatttccaagangcttgggtgcttagaggctgcagggggaaaaacaatgt

SEQ ID NO: 689890 - DNA, 327 bp, Homo sapiens
aggatcgctctttcgaaaggcacatatttgggcagaggaggtgagacgattctttagtaggcttgatgcctcctggcaataaagggcatccaggcatagagatcgcttagcaaaaggcaggcccaccctagctgattagggcagagggtgaggcagtctggcccgttggacccttcggcctactctgccctttcagtgcgctgggaaaggggtcagctgtgttcattcagaccactccccgcttttagaaccagcaaggtggcaggcattcgacagtggcctgaggggcacaggcttctcccaacggctgctagtcgaactatggcc

SEQ ID NO: 689891 - DNA, 96 bp, Homo sapiens
tatttctgtgccagcagccaagaggcagtttctatgaactatggctacaccttcggttcggggaccaggttaaccgtcgtagaggacctgaacaag

SEQ ID NO: 689892 - DNA, 768 bp, Homo sapiens
aaaattaacaattttaaaatgtatcattcactagcacctagtacattcacaatgttgtgcaaccagcacgtctgtccagttgcaaaacatttttatcaccccaaaagaaaactccgtacacgttaagaagtcactttccattcccttctcccttcatcccctggcaaccaccaatctgcattctgtctctatggatttacctattctggatatttttttgtatttatttattttttgagacgaagtctctgtcacccaggctggagtgcagtggcgcgatcttggctcactgcaatctctacctcctgggttcaagcggttctcttgcctcagtcttccaagtagctgggattacaggcgcatgccaccgtgcccggctaattgttgtatttttagtagagatggggtttcgccatgttggccagactggtctcgaactcctgacctcaggtgatttgtccacctcagcctcccaaggtgctgggattacagacgtaagccaccatgcccagcctggatattttatttagttggaattatacaatactgtatgtgaccttttgagtctggcttgtttcaattaacgtaatgtttcaaggttcattcatgtagtagcatgtataaatactatgtaccatttttatgactggctgaatgatacagcattgtatggatatactagctatatccattcatccattggtggacttaggtaataatggataggtgaatatgacatttgtgaacaagtatgtattgagtgctatt

SEQ ID NO: 689893 - DNA, 715 bp, Homo sapiens
tcacatgatgagatttccaaccttttagctcaccaaccttgcttctgcctcagggccttgccctttctgtgcatctgcctgaagctctccccagttctgcagacagctaccatttccatattcaggtcttcagtcaaatgtccctggtgctaatgagttcttattgatgaccatatttaaaatgcaggtatacacatgcacatgtatgtacacacacacacacacacacacacacacacacacacacaatctcccttctgtgctatatttttcacagtgagtgttctccatcttacatactaaatatttcccatatttgcgtgtgtctccgtgcatacatagtgtgtgagtccatgaattcggggaatccctcgtgcgtcgtgtattctcgtgaatacatgtcgtgtgctcccagtctccagaacgagtgtcggggcacttagggatatccataatctatctaggtgaatcgagtgaagtgaggtggtggccagtcgtgccacaagagtgtctaggagtatcacacaaaattcattttccatcataggcactataccgtgcagtctaagagttatcgtgttataaagtgtgtccccttaattatcacgtgtgtctccttcccgtgaagtgaagggacagctcagatgtgaggacaggtcgtggtttatcttgcttaagtgatatcccagcatctactagaggctgtgagagatag

SEQ ID NO: 689894 - DNA, 237 bp, Homo sapiens
  misc_feature (201)..(201): n is a, c, g, or t
cgactctaagatccatgatagcgatagggttgctgtcagctgctcaatctccactagctccaagcatggatacgtgtgagcacagctgtctgtgtacttcaggtactcatttaattcaactcaaaagtgaaaatagaacagattccgtcacttcaccagatcccaaggctcacatctgcataatgcttatatcccttatgnaggcaatgatacacacaggcctcatcgcttatcaat

SEQ ID NO: 689895 - DNA, 297 bp, Homo sapiens
  misc_feature (14)..(14): n is a, c, g, or t
atgtatgtgtacangatacccttttctgttccttgtgttcactgttgcttttacaataggtttgttttccttttagatctgtttactggcttaagtcattactttccaattgtgatttcctccatcctatttcttcttactcctttttttatttaaaggagccctttcactatttcttttagaatgggtgtagtattgctgtacccttcgagtttttgtttgttgaagttattcctcctactattttgaatgatattcttgctgggtagagtattcaaagctgcacattgttccctt

SEQ ID NO: 689896 - DNA, 298 bp, Homo sapiens
aaacctgcgtgtactgcacatgtgtcccagtgcttaaagtataattaaaaaaaaaaaaggttctgtgctttatatgtaattcttatcccaggtaaaacaagacaccagtaggatgtgagaaaaataattgtttctacggaaatatggatgggtgaagtaataggatgtcggggataggttttaaatactccagaacaaaattcagttaaaagaagatgggcataatatggataactgtggaagcgggatgataaaatcattaggtttatactatcctctctaggttacatattacggg

SEQ ID NO: 689897 - DNA, 153 bp, Homo sapiens
taaaagcccccccccttttttttaaggagaatgggccagtcctttcccaagtccccccaggggaggggaaagcattgcttttgggtaaattatgtaatgcaaaatttttttaattttcgccctaaaacttttttattttgtttttttttgaaa

SEQ ID NO: 689898 - DNA, 140 bp, Homo sapiens
gacgtagcccaactgaagtgcatacaaattcatattagagcttgttcatcgagttaaaagaagagctgacccagatcccatgaagaacactgtgtaaattatttggtggtagcagatcatcgcttctacagatacatggg

SEQ ID NO: 689899 - DNA, 829 bp, Homo sapiens
ctgcttgtgtgctcgttgcgtgctggacctggtacctcttttgtgaagcggtgagcttgacgagactcctgggcgcatcgccaattgggggggactgaaaagcccaatggaaggattctaagactgagaatcgacggattcatataatatttgacaggtggcgtgggcgaggcaatggtgttcgttgtagtctgctatgttgcaaggaatccagaggcaaatacaaccgatctttagatacacttgattgaaaggccctattgttgaacagtagcatgggtagtttgtcaaattgagggtcaccactcaagattttcctgatctatgtagcggtggcaaccaaaaattcatagtgaagacagacacacgcttgcagcaaggattgggtaaaactgcagaggcatgccgaagttcatcttgtgcttggtgttccacacatggcgcgtacggtgaggttgtctactgaacataagggaagcttgtttatctattacctcgaagaaacgtctgtttcctttgaatggaccccaggtatgtacgattctcatattaggaaagactgctaatttgagggttccatcccatcatccttgactacttacccgatattagttcactctattctttcatttctccccttctccgcattccgtttgtgtgtaacattcacgtaaacctggtattattgtgctcaagctatatttgcattttgtaactttatctaaaaaaaaagtgccaccgtgttttgttttcggactacgacattcatgtttcggaactgcgatgcgtcaaacacctctgtttttgttaccattcccctttttcattg

SEQ ID NO: 689900 - DNA, 1004 bp, Homo sapiens
  misc_feature (506)..(506): n is a, c, g, or t
  misc_feature (520)..(520): n is a, c, g, or t
  misc_feature (534)..(534): n is a, c, g, or t
  misc_feature (546)..(546): n is a, c, g, or t
  misc_feature (594)..(595): n is a, c, g, or t
  misc_feature (625)..(625): n is a, c, g, or t
  misc_feature (631)..(631): n is a, c, g, or t
  misc_feature (651)..(652): n is a, c, g, or t
  misc_feature (674)..(674): n is a, c, g, or t
  misc_feature (697)..(697): n is a, c, g, or t
  misc_feature (699)..(699): n is a, c, g, or t
  misc_feature (756)..(756): n is a, c, g, or t
  misc_feature (807)..(807): n is a, c, g, or t
  misc_feature (919)..(919): n is a, c, g, or t
  misc_feature (973)..(973): n is a, c, g, or t
cggcggccatcgccgccattttgggctgggaggaggcagcggagggactcgctgcgcagtgagagcaccccgtggggggtggtccgggcgcggggagaggccgggccgagtgggctacctgaagtggcggcgcgggagacggcgggaagtgggaccgggggccagggagggtgaaggttggagtctcctcggccgagcccggtcctcaaaccgtcccggcagccccgcagcctcgcctctcacagagtgcggggttcttcggtaattaccgcgtgtttcccgagaccccagaaggggagaggctggtgaaacggcttccctctgcggtctttccacaggggcgcggatcctgaggccgagctctgccagcttccctccccacccccattcggcctgggtatggcggcgaggcccgcacagagggactccacttcgactggagacgtgggggcgacgcagacttcagacgctggcgcgcgggggagggcggaggtcgcaggtctggncacaagtcggcgtngcagtcagctggangctcgagagcgnagatcacagtgcaccacttactcgctacacaagcgcatctcgcgccgnntgcaaaacacacctctaactactgtagcancactantctctggagcagctagaganngcacttgaaacttcacagctcngtgctgaagtctctgaggtctgncntcaaatctctacattcagccgattctcggacaactgactagcatgtcgcagcatctngtgaacgctaaatatgctgccatttctgagtaacgagatagttgcttaagntgagaaatcgatgtcgtcgatagacgatacatctatctataatctcattatctattattatattaaatctctctaagaacatatatcattattattgtagtatatttcagtnagttttttcacatatataatattttctatgtctttatatatatttgatcatatnagtatttattatcacaaaacattatatcatt

SEQ ID NO: 689901 - DNA, 714 bp, Homo sapiens
  misc_feature (689)..(689): n is a, c, g, or t
tcctagcaacccggggaattctgatcttgtctagagccagatccaccctgtgagaaatgcagaccaaccgatttgggctttacctgcagatctgtccttcataggacaggctgagcccagctaaaggtggacatctaatggcctcaccaaataagccatgggctgtgaaagggttaaccggggtcccctgttactgcagtcgtgagtcccctaacataacgattctgaacaccatagatacacatggaaaacgtgtcttggggtcgatcctagccactatttctccattctgcaaggtggaacaggaaaataaacatgctcgtaatccaaaaatattcactgatgaactcaccacttataaaattagtcctcccactaaaaaattccctccctgcctaagagcccaacagaagtcctaacccgctgctccctgtcagtctgggtgattgtgaacatttgtttgtattttcatcttattgtggaatttgtggaaatgtcaagttataagtcttgagaaagatacaagaagctccaggacatgatgcagaagaaaggctgttccctggccgagcccaagaacacgaaggacccagctagggagtaaagatgaaagcatggctgttttgcaaattttaaattttgactaaccatctaactgattccagcaaggatgaaggataaagataaancaaaatctccctctacaaaacacct

SEQ ID NO: 689902 - DNA, 185 bp, Homo sapiens
  misc_feature (124)..(124): n is a, c, g, or t
ttttttttaaaattactagtctacataagttcactccaaccttctttggccctcataatttttttcccagccttcattctcaaatttaacacctgtcagacattttagcgctctcatccttcantccctagtttcggccgcctccttgctcgacctgacaaaggacttagtatgcagccttggcg

SEQ ID NO: 689903 - DNA, 186 bp, Homo sapiens
  misc_feature (39)..(40): n is a, c, g, or t
  misc_feature (138)..(139): n is a, c, g, or t
ggagcaggagaagagtttaagttttattaaaatactatnntggcacaaatctttaaaatatataaacattatgatataaacagtgtttcatggatcaaaatataactccagaccaagaccagtgaccagcagggaggnnagtgaccgtagagcctgagggcctggctgtggcaggggtggggacag

SEQ ID NO: 689904 - DNA, 166 bp, Homo sapiens
cgcatgtggtcgaaggtgactcgttccggcgcaactatgccgcgcgcgcgcggcctcgatgctcatgttgcacagggtcatgcgttgttccatgtccatcgcgcggatcgtgctgccgcggtactcgtatgacgatggccggtgccaccgttgacgccgatcacgc

SEQ ID NO: 689905 - DNA, 306 bp, Homo sapiens
tggaggcccagttcccccttatttaggaaaaaccaggaattttccaggacccttaaggggccatgatggcaacagatttggaacctcagcctggccagacacaggccctccctgtttcccaaaaaaaagggagccccctgttctgggcctgcaaaatttgggttttgcctgccaactgcactgatgctgccccttatttttttggccaacccttccctccccttggccccagacacccagggctttttttaactttgttgcaagtgcaataaatttgacccagtgccccccctggccagaacttga

SEQ ID NO: 689906 - DNA, 197 bp, Homo sapiens
tcttgtacacaatgctttcagcaataccgacactcttacctgatccacggctacccttgctcaactcgataccgttccttcctagtaaataatctttataagcgctactaactagcgtatttgcgaagctttcaatctacataccgttattataggcacacaaaagcgcctttatcatcagtcgccttctcgtccct

SEQ ID NO: 689907 - DNA, 173 bp, Homo sapiens
caacctcaacctaggcctcctatttattctagccacctctagcctagccgtttactcaatcctctgatcaggggtgagcattcaaacttaaacttcggcctgattcgcggcacttggagcagtaggcccaacaattctattttgaggctcaccttagcattatttctatatct

SEQ ID NO: 689908 - DNA, 623 bp, Homo sapiens
  misc_feature (9)..(9): n is a, c, g, or t
tgtgagtcncgatgaaatccctctttagtagtgctcctgtgccggaaggtgaggagcgagggtccgctctggctctgtcagcaacggggacccggtcggttctcgcatcgttcgcagtcagtgtttcaagtgtgcctgataactcctctccttctgttccatcagctggtcatgctgtctttggattgcctgcaacatttgtgctgaaggctgtgcagactcagctttcacacgttccactgaggaggaaaaggaagaagaaaaatttgtgtggggttatctggttgcctcattcttccttatacacttacctgtcatggttgtggactgcatatgccttactcagagatgacctcggcaagtaagacacacctttgtggatcttgctctagttaaagggtcccatgttcatccagtcaagttatttcaatttttggagcttttgaggccatctaatctcttaactcactcctcaccttcaatctccttttctttttctgtgagagtctggtctgtctggggaattgcatcagtcatagactccttggatttcaagtatgtctgcagaatctcttcagcctgtatccccttcctcggttcctcatagtactttttcttcaggt

SEQ ID NO: 689909 - DNA, 497 bp, Homo sapiens
actcgcggaaaacacctttcccttctagtaatgagagacttcctcttggtaatagaagaaattccctgactttatttacttattaatatagagacagagtttttgctatgtgttgcccagtgctggagtgcagtggcgctttcccggctcaccgcaagctctgcctcccgggttcacgccattctcctgcctcagcctcccaagtagctgggactacaggcgcccgccaccacggccggctaattttgtttactatttaaagtagagatgggatttcaccatgttgcccaggctggtctcgaactcctgagctccagaaatctgcttgcctcagcctcccagggtgctgggattacatgtgtagcccacctatctttcggtctctcttttttttaattacaaagggagacaggggtcccactctgtcactcaggcatacgggacagggttgccatcagggctcacggaagccacgccatcccagggttaaggtgatc

SEQ ID NO: 689910 - DNA, 866 bp, Homo sapiens
atgacgccctctcggcagctcttcccactctgccacgcgtccttttcctgcaccttcgccccgcgtacctactcctgccccgccctgccattcctctcccctcccttctctctgcgatccctccctgtgtaggccccagacgctcattctcccactcacatggtcttcatcttgtccatggcactcaccagtcttatccctattcctcatcccttgcccatgtgtcattgtcatcaagagccccctcggaggatgagggagtagcgtagtggacgcagcaacaactgggctcaccccacaagcagaacttcgtcaatccatgaggacaactggggacggccttcgagcgccagcccacatgtgacaactggcagggactgcggcttcctagacggaggagcaccacgctgagctcactgcaccatggacctccagcggaactcagacgtactggcacgacggagcgctgacccatgcatccatctgctaccaatgaactactggcaccctctgaacgccggtccatgactccctgtccacactgcacgcctggacccgagaagaccatcgggcaccccccgtctggccacacgcgccagtaagagccaaacctagatgcactacatgcccaatatctcctggcatgaccgagcgaccatatgccacgcactccacagtccagggacagcgatacataccgcgtccgtaacatggaggagcacaaacctaccgcagacatgacccaagtggattgatacactaacaagataaaacgataccgcaagagcaaggcacacagcaccccacctacccccctgacacgaagcccagggaaacaaccaccaaccacatcactcacgacaaca

SEQ ID NO: 689911 - DNA, 456 bp, Homo sapiens
cactttttttccttgtgaaatatatcctttgtaaattcctagtagaaagcaaattgctttttatttatccttcttggcatttataagaatttctgaatctgtgaattactgtctttcatcagttatgaaaaattctcagcaactattactttagtattgcctctccctcattttgttaccttctccgagaacttgtaggacatgtatgtcaacttctcactttgcaggcacgtatctttttttttttttttttttttgagttggagtttcgctctgtcgcccaggctagagttcagcggcgcaatctcagctcactgcaaactccacctcccaggttcaagtgattctcctgcctcagcttcccaagcagctgcaattacaggtgaccgacagcacacctggctaatttttgtatttttagtagagacggagtttcaccatgttgtctagactggt

SEQ ID NO: 689912 - DNA, 93 bp, Homo sapiens
gacaccaaaaaacaagcgggagaggcaacattgattggggccgacggacgagagcgcaccaggaaacacacaagggaagagaaaaggcacgaa

SEQ ID NO: 689913 - DNA, 428 bp, Homo sapiens
aacataacgtacagtattcgttatggcccttaatgtgttagacccgtatggtgcgcagccctaagtatatggtttgtcagataaaattcaaaagattcccttcatcctcagtaaaaggaaaagactagtccttgtcacagtttagtattatcacgtggcccagtaaccataaccagtctctcgtatcacgatggtttctcttagcctcttatacagtgttgatgtaagctttcatgccgtcatcccgaaatgtcccttccatctcgttccaggcatatcacttgaccttgctcgtgaagtccaactatccgggtccgacttgtacctacgtcgccagcagttgcttgattgtagtggtcatgctttaacaacatcatgtcattccatgtcccggtcaaagtgtgactaactcactcacaagctttctc

SEQ ID NO: 689914 - DNA, 398 bp, Homo sapiens
cgaagaggaggagcaagaacgatagttcagaaaacagttccccctgcatgaaaaggactctgcagatagggtggcgcagccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggagttgaactgaatgaccgactcttggcagccaacttttgcctgtccctctcccaaacactctttttgg

SEQ ID NO: 689915 - DNA, 186 bp, Homo sapiens
gagactgttacccctagctgtggtcccgtgcccttactattaatgactctcaacgtcagggtacccacagatgctggaactatatagctgggctcaaagtactttgaattatttatgagcccactgctgctgctatagcgtacgggttagacaaaaaggtttgagcagaaagaaacgtgctctcta

SEQ ID NO: 689916 - DNA, 243 bp, Homo sapiens
gcttatttcgtctagcataatgacctccagttccatccatgacatccagtcaccctacagtgagcactagaactcattcctcctatctagctgtaattttgtatttgtcaaccatcctctccctatcctcccttcctcctcccctgcccaggctctggttaccactattcaactttctatctctatgatatcaatttatttagcttccacatatgagtgagaacacacattactactatttgt

SEQ ID NO: 689917 - DNA, 240 bp, Homo sapiens
  misc_feature (21)..(21): n is a, c, g, or t
  misc_feature (205)..(205): n is a, c, g, or t
  misc_feature (207)..(207): n is a, c, g, or t
ctttcccttgcttcataaggntcgttactctggtatcagttgctggactgggattttgggcatttataaatgtttttattttggatatcactgaatcacagacaatttcatcttagttaaaaattcatctgacgtgacacttgtctaaatcttaaaatattaaattttaatgtataaggatgttaataatctttatattttaagngnctatggaagtccaagtctgggctaacttaggtc

SEQ ID NO: 689918 - DNA, 472 bp, Homo sapiens
cagctggcaccatccccaggaggctttctgcttctgcaggaggcccaggaatttagcacatacagtcttagccatatgcttagaaaagaggcaggaccacaattaggattgactattgtggacgaggtgatgaaacgcagccccaaaggtgagatttgtttaccactctgtagccacggggggacacacatctgccggttcagaccataaattcattatttccaaagagtgctagctgttggttggaggggccagctgggtccacagtttttctgggggcagacatgactgtcccctttgggggtttttttggttttttgaggggaggttttacaattctttaattttggttggcccttttcggggttgaagggttcttttgttggtgaaaactggggtttgctttccaggaatttggttttgggccccatggtccttttccatttccaggggctctattaacgtgggggcg

SEQ ID NO: 689919 - DNA, 309 bp, Homo sapiens
gtggttttccgctattccagcaccagtcatctttatgcccttgagctgcagggcagtcactatgcgtgtcttggtctctaagagagtgggctctgtggctgtctccttgaaggttctccctgtaggttctgattagaattggtgctcttggaatattgctgttaccatcattttagggttgtgtagcatcttattgattattggaactcatgtacaagttcccatgggaaactaatacaggaaatgtcgtgaccagaactgtctaccagtagctaataatcgatcatcattgtgaagtatcggaagctt

SEQ ID NO: 689920 - DNA, 183 bp, Homo sapiens
caagatggtcctagcagtttccatcgaagaaacatcggatatcaccccaggcccgcgtcaagagctgtaagcctcttgattctccgcggtgtcgttggggcttcttggctttgtaaagtagtcagtgcgtatctcatttttttctctctgacacctattttagacacatctagggaaaagctt

SEQ ID NO: 689921 - DNA, 103 bp, Homo sapiens
ccccaaaacggggtaaaaactgtttgtgaactgaagttcctcaaagggtcatttgtatgagaggggttcatggccaatgaataaatgcccccttttgcctata

SEQ ID NO: 689922 - DNA, 157 bp, Homo sapiens
tactgaactcactcacactgcaatttggaccagtctatcatctttatataataactagtgtttagtattagtaacatgaaaacattcttcctccgcataagcctgcgtcagattaaaacgctgaattgacaattaacagcccaatatctacgatcaa

SEQ ID NO: 689923 - DNA, 711 bp, Homo sapiens
ggagcggtgggcgaaccagcgtcgcttaattgtaaaaaataagactatgcagattcatatattactgaatcataaacaccttgtcttcacagtatgagtgagaaatatatgaaatctgcatagtcttaattgtaaaacaataaagaacattccttaagctttaaaaaaaaaaaaaaaaggggggtttttaaaagtatccccaaggggccaaaggtgacgcttacccagtttttttgaaagggggtccctaagggggggataaaaagataggcactgggccgtgtataaaaacgtggtgaatggggaaaactgcttagttcggaaatcttggggacaggaccctaacttcgggggtgtgacattacgtgggaccaaattacttacggagattataacagctcttaaggtaattatcaagttttcaagggtatatgtggtcacactaggcgggcatatgatggggggctggaaaaagtagggtaacgggagtatgcattctatgaaacttttatccacgggagctaggttaaaaaaaaggcacaagcataaaagacgacgaaaagcaaagaagaaacaaagagcagagagaaaagaaaacgagaacaaagagagatgaaataaaacagaaagaaagacaacagaaaggaagggagaaagaaagacagaaggagataaaaaacaacaaaagatataaaagaaacgaaaaacaag

SEQ ID NO: 689924 - DNA, 1578 bp, Homo sapiens
  misc_feature (350)..(350): n is a, c, g, or t
  misc_feature (410)..(410): n is a, c, g, or t
  misc_feature (513)..(513): n is a, c, g, or t
  misc_feature (549)..(549): n is a, c, g, or t
  misc_feature (623)..(624): n is a, c, g, or t
  misc_feature (644)..(644): n is a, c, g, or t
gaagaagtagagaacaccattcggggaagaatgtgatggtggatgcgtgatcgctgatgatgggtgatctgcagtttggtctgaccgaaaggagatattgcgacatgggtgcaactcacaggagagccctgggtcctcgtgggcgcagatcgagctgtgtagtgcggaggagcacagaggagctcgtcgagtcttcgggagagggagaatggaccaaagagtatgtacggtaccgtgagccgtggcagatccaccctatacgcgtcgtgcgccacaggccttagggcacgacaaggcaaaattcgcataggaagttgaagatggttgcgcatgcgaaaggagtacgcaantccattactacatacctctgcgtgcgcgcctttacacgcgatttcatacgtgaaacactntcgggagggacttgatcctgcgtgtgcatctcaactggggtcgtcccctactgtctcctcatgaactagtgcggttggtgtcacggaattgagtgtcctagcntgctagtgacagagctcgaagccctgtctgttcccngaccgagctgcttgggcccaggtgtaaccatgcgaatataaacgtttggcccaatgcgaagaggagagtacacnnaattgatccatatgccttgngtggtcatcgggagggtatgacagtctggcatcaccacagacaagagaagagtaccaggcgatgccatcccagtcggcgagatgcgatgcgaatatgtgggatcatttgtgggcttgtcactgatgggccccccaggctgaaggaccagagaaggccgagtagttgtgggacaccatagatatggcgccaaagaccttacacattgggtgtcaattggcagggagtagtatagggggagtttccgatttaacaggcccataggttgccatctcgtacttttccactagccaactccaaggacgggacgagccagggtgatttttggggcttcccggaaaagtggaatgaacatgaatgcaaagcctgggacgaaagcaattgagagtgcggaaatgggaaggcgaaggtggggatacccatttgaatgcgccacttagtggagacagtggagaagtcggattggcccggtgggtccgaatgggaagggctggtaaacgggcggcaccactctctgggacaaagcgggggtggaaaacgataacgtaggaactgatttcaagttagccctggtaacgcggaacatgtggcgcatgcagggagaaggggggggacggaggtaacttgggcgggacacggtttgtctgctttaattcacagaggtgatgatacagaagggtcacatctccggtgggtacaaaggaatacaacacaacagaggagggtggtgtcgcgggtgagaaaagagataccacaggagagagagacccaagagggagatcaagcgcagacacacgagaggtggttttttagtacgacaaaaaggggggcacgtaataaaagagggggcggaataaaaataacaagaagcacagtggcggccgagtatcacacgggcgcggcgctggaaaaaccacatccagttgcgagcaaata

SEQ ID NO: 689925 - DNA, 131 bp, Homo sapiens
ttggtaccatattcatcatttagtggaataactgcatatgttcgaatttaagttctcttctacgagtactctgttgctacctggggtatccgtctagtagtcttacctagcagtgcatgcaagcgttgtgc

SEQ ID NO: 689926 - DNA, 742 bp, Homo sapiens
ggcctgcctactctcctatgccagctctggctccacggacccacggatatggtgcaacgggtggctggcgttggggcggctggtgacagttgtcgggagtgtgcgccctccagtgcccaagcctgccttctccgtgcccccgccatgtgcccaggtggcggcgagtcatgagctggatgctccgtgggaatcagacgtggcgagccaacaggagcagacgcccgagaagcccagtttaaactcatatcccaggcatatgaacgtgctttcagatccaatagaaaagggatgtttatgaccaaggcggagagcaggcaattaaagaaggaggctcaggcagacccagcttctcttcacccatggacatctttgaccatgtactattggtgcgtggtggaccggcctggctagagagagaagaggcacgaatgtagtacaccagttcatctgtaactctatgaagatctactatacatggagtcacgaagaaatcggccctccagaacaaatgtaatatgtagagaaatgtgaaggtgtaggatgggcaagaagggaatcggtggagacagtgcccgcatgtgcaaggggaaggaggatgcaagatccacaatccaggcagatcgagcacgggccatggcaacaggacagagtccagaaccggtgggacatttcgaagtgcacaagggaccaaggatgacagcggcaattcagacaccacaagggaacccggatgcagaaggag

SEQ ID NO: 689927 - DNA, 845 bp, Homo sapiens
agtcaaccatcatttccccggaaatggcatcgatctctggactgttgttactccttcttcctatctcctccttctcctcctcctcctcctcctccaccatgcccggactgatttatgtatttttagtagagacagggctttcactcatatgggccaggcagatctcgaactccaaaccgtcgtgatccacctaccttggcctctgaaagtgctgggataccgtggcctctgaaagtgctgggattacaaggcatgagccaccgcgcccggccccgttgtttccctatactaagaaacgcagtggtctctgaagcctgcaggggcaggccagccctgcactgaacgcctgttacttgccaggtggacagaaggttgctgctcatttgagcagtacctgtcacccctcctcccactgctgcggctgttaactcatcttcaggtctcaccaccttctgcaacataacactaagcatatttataaaagttactatcacacacactctttcatttactcttggagagggtaccaaacggatagctgttactgtctcacgtagggagctctcatggcctacaggctttgaccattctgagacatcaaactggagcaacattccgaacgccgttccttataacgtgtctccatcatctaacctgggcgactgacagatgggaacgtgctggcaacaaatgttagcaccaagcctggatccctggcgagcagatcggccaagacggacttggaaggacctggaaagccacaagagctggcacatcacccctccggcacacctaaacgagccagacagacaagaaactaaaacacaacacaagaccatatcacc

SEQ ID NO: 689928 - DNA, 179 bp, Homo sapiens
tgctcatgtgccacagcatttatttatattgaaaattgtgggggagcctgtgtggctctgtcggttaatgggcccgattcttgattcttgatattcttgatttcagctcaggtcatgatctgagtcgtaagatcaacgccagaactgggcttcaagctcagtgcagtctgcttgagagt

SEQ ID NO: 689929 - DNA, 574 bp, Homo sapiens
agcggggggcaaagatggcgggggtccaggtgtcggaggcctttgctacgcggtccgaggctttcattgcacaccgcggctaatgccgccgccacggctacagaaacgacctggcagagacgtcgcggcgacccccgtcgcgcgggtacccgccgagtgtgggctccatgagcagccgacagcaaagctgcacggctgcggcggatcgagcgctgggaggcgactggtgcactgcttgcggagtcggtagacgagaagctgcgaatcctcactcaagatgcagtgtatgaagtacagtggtttacccgcagaccttcgcgcatgtaatgccggacgcgcgtggtaccagtatcttcgaccaaggaccgttgttcctggtcgaggtcatggcgcgcacgtccgctcagcggagcccgagcccgagcccgaacccgaacctgaacctgcgctggacctcgcggcgctgcgtgcggtcgcctgcgactgcctgctgcaggagcacttctacctgcggcgcaggcggcgcgtgcaccgttacgaggagagcgaggtcatatctttgcccttcctggaa

SEQ ID NO: 689930 - DNA, 133 bp, Homo sapiens
tggaaagcacgcataacagctgtaatctcatcggataccctggagccaatgccttgggatcgcctgaagtgaagtgtagagcatccaccaaatagttgagtatctaagatgggccatgcgtggattgccagga

SEQ ID NO: 689931 - DNA, 113 bp, Homo sapiens
ctgtgagctcattgaggacaactttaagtgattctgaaacagacataaatagatggtgtctcaatgtgttacccaggcaggtctcaaactcctggtctcaagcaatcctccca

SEQ ID NO: 689932 - DNA, 122 bp, Homo sapiens
aggggggaaggggtgggcgggggggggtttttgggtttgggccccccttcccccccccccccctcccctggtcccccgtccctggggcttttttttttaaaaaggtttttaaaggtttttta

SEQ ID NO: 689933 - DNA, 170 bp, Homo sapiens
actgactggcactctgctcgcggtcgacgtgccccttcaagtttggtgatgtggctgccactgcttggttttgtgtaagagaggctgctgccaccattacctgcagtaaaccttctcataggggctacgatcggtactgctaggggagcacatagcgcccatgggctgtg

SEQ ID NO: 689934 - DNA, 827 bp, Homo sapiens
  misc_feature (43)..(43): n is a, c, g, or t
  misc_feature (50)..(50): n is a, c, g, or t
  misc_feature (108)..(108): n is a, c, g, or t
  misc_feature (120)..(120): n is a, c, g, or t
  misc_feature (130)..(130): n is a, c, g, or t
  misc_feature (156)..(156): n is a, c, g, or t
  misc_feature (452)..(452): n is a, c, g, or t
  misc_feature (481)..(481): n is a, c, g, or t
  misc_feature (747)..(747): n is a, c, g, or t
  misc_feature (749)..(749): n is a, c, g, or t
cccttttccattaatttttccttcaagttttcctccacatggngaatccnatttcctaaaaaccatttctttattttgcaagtttttgggacttcatataaaatgtanccatattggaanaatattcttncttcagcttctaagtttttcactaancaatatgttttgctgatacttacattcatatgacagtaatagttgatttattttaatggctatatattattccattgttagaatacaccaggatttatttttacttatttttttgctggaaaattgggtgtcttttttattttttgatataacaaacaatgttgtaatcattttgtatttacttcctagtccactcctgtaagtttctcttgagtacatactagcaatgaatatgctgagtcactgcatatacatactcacaactttattctataatgtaatattctataaagtanctgtatcagtttatactttaaccagtaanggacaagattttctgttacttcccatctttgttaattattacttttagactctaacttttatcaggctcatggatgtaaaaagcatctcagggtggttttaatttgcatttatctgctcatctatgaagatgagcttcttttcatataattatgagtcattatttttgttttgccttcttttgtttatgcattttgcttgttctatgtcttatttttcctgttgatttttgggagttcatatatattctaaatgtatatttattcncntatatatatgttgtaaatattacagtttatgatttgtcaccttatgatatcttccaaatagagaagctttatattttg

SEQ ID NO: 689935 - DNA, 893 bp, Homo sapiens
  misc_feature (4)..(4): n is a, c, g, or t
gatnaaaggcgcggcgagaagcatacggcgggaagcagatatggcattcccttttgaccttgtatttgccatagtcgccctcgtggacacgcgctcggttttacacaaatacgcgtggggactttcgtcttaaggggctttttgtaaccccggggttttgctttacgcccatgtccgtcttggggcccgtggggtatatccccccattttccgggctcccccaagttctggccaaacttccgtaccaaattatctctggcttgcaaatcctcggaggggccagcaatctgggtccccccctcagggggccccccccgggtcaccacacactgcatgaggttgggcatttctgagcccgtgcctcagaaagttgacgctcccctcccgcccttggaggatcgacccgtgcttccctctcagccatttggaggcccccctttggaaccccccttcgatggaggtctgatggccccccctaccgccccctctccaaatggtacgccagctctcacgggagtccctgctgcccccctgtaaatctagagcatgccaccacaccccggccacgagggacagcccccgcgcccggagtatgagggcctgctgtcaacaatcacaggtccagactgcgagggctgagattgccccaccacccccctccttgctggaaaaaaccatgcgagggaacactttctattcctggtgcaagaccctggcaccaaccagcaactccccaagccgcacaccatcctcaaagccccccccccgcccgataatcgatagccaaatggtgtgtgagacccaagacacacccactttgctaggcctaagcccccctgaaccggggaccccttggggggccggaggcccaaacaaaaattccaaactccaca

SEQ ID NO: 689936 - DNA, 588 bp, Homo sapiens
  misc_feature (4)..(4): n is a, c, g, or t
aagnaagcagctgtataagtagcttttgtcattattggtattggttggttggtttggttttggttttgtggtaaagagcaagaggaaggaataggaaatgaagctgactcattaaagaaactacaggtcacaaaaacacagacgagtgcttggggtgggagctttcacacatgtgttttgttctgcatcactgtttttcagcttctgctccaaaggagaatacaatgagttttctagaagtgagcttcacttctgaacccatagtgatttgtacgtatatacataggttcttggatccagtttcatattgcacatgcaggaacattatataaatgagtgccttttattctcacacaatgagtcatagcatggtcccattgtaggcctgttaacttcatgaagttgacggtagcctttaaaagatacacacacacacacacacacacataggagatttcctcaaagttttggggaaacttttacagtgtatcatgtgaattcagatttacctcaatactaagaattatgtttagatatgaaaaaaacttgttttgatctcaggtagaaaaatagattgctttgagtttt

SEQ ID NO: 689937 - DNA, 255 bp, Homo sapiens
acttatgcaccattctgagctgtagagtagatgtgggtttatgactgccaagtagcccagtacagatagattttttatcactgaagaggtggactcattgatggagtcctgtagtagtttcagtgtgagatacaggtttttccaccatacatctgtgcattttctctttaagtgactgttgaagaaatttgtgtgcatagttactcagttattatgaactgtcgtatcctgttaatgcatattgctcggtgactc

SEQ ID NO: 689938 - DNA, 1211 bp, Homo sapiens
gccatacacactgctgctatggatatgctgggaggacctggctatcgaaagccagtgctagtaaacagttgcatcatcattgcagatgcagcatattaccatgtatcccaaaccgccaaaaagtatttacctggttttttacgatcattagatgcaacaatatcttcaaaaggaagcaaggactagcaaaattctcgaccgtatactgcaacttacaacccaaggctcaatcactattgcaaaccacgcatatcttctatagcatgacatacccaagacagcagctcacgcacagaaagtaggaactcaacctggtggcatgaccagacattcaacacgacgagcaaactgacagactgcaacccaacataccaacagctatctggcagctgatggaagacaacactatacgaacttgttacggacctcttctcacgtgatcgactgtcgttaaacgccaaatcatagcaaatcctaatcttgtcatgaacctcctcccggttagaaagaataggtaggcaccgtgcattcactctgcatcctgacacacgcacaggactgggaccctgctcgcaatactgcacgaaccttactgtaaaccaacgccaagcactgcggcgactgaccatatgaccaacagcacagacaaaagaaaacacaacgccaaccaaaggacaacccaacaaaaacaacaaaagacccaaacactaaacagagcaccaaaaacaaaacacaataaacaaagaaccataactcacccacaccctcgcaaccacatcctaaatagaatcaaaacaataaatgacaaagaccagcataaccacacacctaatcaaaacaccacaacacacaacacattctcactcaccaaatacaaacaacaccccaaacccgctccacaacatgcaccttcacatcataccacctgccaatatctcacacctcatcacccacctatactcgaaccatcctcacattagcctcattaacacataacactactcaaaactccaccacatcaacaacacacaccacacccaacaaaacacaaaaacatcacacccgaactcaaatatcaaatctataaacacaccaaccatcattcccaccccaaaacaatacacctactataaaaaaaagacttatcaatcaaacacctaacacaacgcccactacctaccaacacaataccctctccacgaccgtctacc

SEQ ID NO: 689939 - DNA, 230 bp, Homo sapiens
atgccctttgaactttcccatttacgcaaatacttggaagcagaggtgccataaaactgactgggttgctccaaagggggtcattctctttgtctttcttcatttgtaaatgatttgtttatatatatatttttctttaagggaggaacctgaactgtagtctagatttcagtgtagtggaactgagaagctcagtctgtcacctgtttatgcaacggacagtccggttt

SEQ ID NO: 689940 - DNA, 84 bp, Homo sapiens
  misc_feature (62)..(62): n is a, c, g, or t
tgcatgttaaataggtcgcgtcaatcagtattcagttcacgatgttaaacaagtaaccaatngtctattaaatcatatttcact

SEQ ID NO: 689941 - DNA, 784 bp, Homo sapiens
  misc_feature (766)..(766): n is a, c, g, or t
tgaaaacacccgaacgatgcgtgctgtgccgtatgggagttaccggattgttatgaaaatattctgtgctctacactgaatgttgactgctaaccacacgacttatgtggaaatgctaacccgcatcgcagtgctattagtgggtcagcgcctttgcaaggcgattagtccttgacgatggaaacctgtccatggatcagtgcccttataaaaaaacccctgatagctccctccctcataccaccatgtgaaaacacagctggaaggtgacatctgctacccaaaacagggccttaatcagaacctgtccaacctcagccgcgatctaggactatcacacttcagaactgtagaaagtaagtgcttgtcgaacaagccaatgcaggatcctgttaaagcaggacatatctatcaagacgctctacctacatctatgattctggaggctgacagatgattatcactgactgacagattaatagtgcccacaggagtatatgaacgacgcactgtgttatgaaatgatgaagaatatcagcggcttaaagattgctacctgaccttgcctataatgtggtcacgcgtacccgaactcacttctagctaagccagcttacctactctgacactgtatcacgaaatggctactacaacacatggtgcagctgcccaatagagagattaagctccttcagacgattttatggatgtgctgtgctatacattgagggagcctgtcagatatgtgcgattatgtgatgctcgngctctatagtgcatattc

SEQ ID NO: 689942 - DNA, 1570 bp, Homo sapiens
  misc_feature (504)..(504): n is a, c, g, or t
  misc_feature (582)..(582): n is a, c, g, or t
  misc_feature (614)..(615): n is a, c, g, or t
  misc_feature (1219)..(1219): n is a, c, g, or t
  misc_feature (1262)..(1262): n is a, c, g, or t
  misc_feature (1264)..(1264): n is a, c, g, or t
  misc_feature (1358)..(1358): n is a, c, g, or t
  misc_feature (1367)..(1367): n is a, c, g, or t
  misc_feature (1379)..(1379): n is a, c, g, or t
  misc_feature (1386)..(1387): n is a, c, g, or t
  misc_feature (1399)..(1400): n is a, c, g, or t
  misc_feature (1402)..(1402): n is a, c, g, or t
  misc_feature (1404)..(1404): n is a, c, g, or t
  misc_feature (1409)..(1409): n is a, c, g, or t
  misc_feature (1415)..(1415): n is a, c, g, or t
  misc_feature (1569)..(1570): n is a, c, g, or t
gaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacangttctaaatgataaagaaagtcacatcaagactctgactgaacgcttgttaaagatgaaagaatgggctgctatgctnggagaagacataacggatgatgataacttggnnaatagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattactgaaacagagcttnaatttgaacttttagaaaaagatccttatgcactcgatgttcnanatacagcatttggcagagagcattccccatatggtccctcaccattgggttggctcatctgaacagagctttctctctctcacttgtggggtcnctcgatctnacttgctcgggnggggganngtccaggccggnncncnggccngttccngaagggatccggtgaagtacgaccatggcccctgcgggtcttgccagacgacaaagtgtttgccggaatggttgcccccaagagaagtgtgtggtgggcatattttggggcaagaaaaatttgtccaggtgtattagttattcactttatgtgnn

SEQ ID NO: 689943 - DNA, 1048 bp, Homo sapiens
  misc_feature (232)..(232): n is a, c, g, or t
gcgtgagaatgccatgagcagcacagtctctcgccgacaccctgtacgaggcgagtgcgtggtaagtcctgcacgtggaaccagcgcatagcagtccgcaagttcctgagacgattggtggacggttggcatgatcaagtattgaagcgaacgagtgactccccaagaaaggacaatgcagcatttctcgcgagcaccggatcagggcttaagatctcacgtccccggcccntatagttctctgctcgtgtgtcctggagggaccagcagcactgtcgacgaagcgctaagagtcagtggataatcaccctcaacattggagcatacgatggacgactgaaaaaaatctcatacagatgaactaatacaatatgtgtgttcacacgaaggctggcacaaagatatgctattgactggcgtttgatggacctcaaggaccgtctctgagtcagaggctaggagtttcgcacgatgatccgtcggggcccacggttgaaggtaagggctaggaacagcttcctcattctccttgacgtacatcgagcgacagacgcaagaaacattcggtggcctaacaggtggtatgcaggtcgagaggtcgcagcaatccaaggttccatagatgagagaagggtgtctattgtcttggccttgtggacttgtatgggtcaacagttgcaaaggattgaccatgatccgaagtggaagctttgttgtcagttgaaccattcaaccctgtgcttgtcaagcattctttggggtgtccatttgctcaaagaaaaaactggtcagaaatgtcccttggccttatgagtatcgagtgaagcaccatgggggcaaggcccccaggcgcctaattgtttcaaagggccaccattgggcaattgacattgcttatttacgccagttagataggcaaatgccacggtgcgaacacaccggcttgcttcgaaggcttctgggctggcaattcctaacaacccaactcgacccactgacaatatgccctttgggcctgccgtatcccaggatggtgccgcaaatgagg

SEQ ID NO: 689944 - DNA, 236 bp, Homo sapiens
attcatggcggtgagccatcgcgcccggcagcattttaaagaaggattttgggtatagaattgacaggacttgatatattaaattgggttgatgaagaggaaggtggtgaggattactgtgaggatagtgatgagaggttgggagaaatggtgtagggaagtagagtaataattttcagtggaaaattatgctttgtaaagatagtgattggatgagatcatctggggagaagaaa

SEQ ID NO: 689945 - DNA, 951 bp, Homo sapiens
  misc_feature (951)..(951): n is a, c, g, or t
ggatgaggatacacacacacacacacacacacacacacacacacacacacacacagagtgtgtgtatcctctatatccaagaatattcagatagtgctccaagatgctccaaacattttttcgtgacccaccaactagtgacgtgtatgctcaagagaggattagtgcgacatgtggagaatactctatcaatattatctacaagatgtgagatagctgctcacacatgtaatgtatattctagtgcaataatatatccaaatatacaaaaaaaaaaaaaaaaaattttagaaaacttttttgcctccccacgtcttttaccacaaacgcgggtgttgctactaggtggcgtgctggtgcgtggtgtggtgtgtgctgcacgcccgcgggtgggtggtcgcagagaaaatcctactatcttttattactacaaagaacccctcttgtgtggtgcgtgctactattgttggctgctattattattagtgctaacacctggtggtcataccacagcagcactactgtttgagtcactcatctacgcggggaacaggcaccagacttatgtggcagaagagagagaaccgcgatgctagatggagggaaagcacttttatttcatattaaacccccgcgggagggtacaaatattctgttgtccccgggggagttcttatccacctgtggtgtcgttgtacaccacacaagacgaggcatcaggaggtggtttccatcaatattacaatcttacaactatcaacactttttaaattttcagcaattaatttttcgcccctttagtgaacttaactcccattttgggtatggtcggcacattcggcggcgttgtggcaagcggcctagccaataactcttttgaggctaaccccactttctttttccccttccacaggaaaccgtgttaggggggatacccccctggtgtacccn

SEQ ID NO: 689946 - DNA, 122 bp, Homo sapiens
gggcaaaggccaagaaaggagaggtagctttatttacaaccagagagtctgtggctgactactgcaacaggcttttatagaagcagttttttcaccgagccctaaaagtaatgaaaatgaaa

SEQ ID NO: 689947 - DNA, 408 bp, Homo sapiens
cgtaatttgagcgaggaggtgatccgaggctgggaagaagggcgttgccagatgagtgtgggtcagagagccaaactgactatatctccagattatgcctatggtgccactgggcacccaggcatcatcccaccacatgccactctcgctcttcgagtgtggagcttctaaaactggacatgacagcgaatggcttcctccacttagctccctgttcttgtgatctgccgtgcgcgggatcgtggtgcctcctagacatgtgcacatagagtccattatgagagcttttccgtgatgttccacatccactttgtatatgacatcgtgccctggactgaagtgtgttctggtcactccagctttgcttcgcgacacctcgtgtttcctcgttccccgtttctcctcgct

SEQ ID NO: 689948 - DNA, 230 bp, Homo sapiens
ggggggggttcccaaggtcaaaaaatcgagcccctcctggcccccatggtgaaaccccgtttttcctaaaaaaacaaaaattagctggggaggggggggggggtttgtagtcccccccccttgggggggtggggcaggaaaatccctttaaccccgggggggggggttgcagtgggccccgttcgcccccctgccctcccgccggggggcagagcaagaccccgttttta

SEQ ID NO: 689949 - DNA, 163 bp, Homo sapiens
accgaatgagggcgacacaggtactgtggatgtggatcgagatgaaagaaaccatcatagcctttgactgggcaaccaaatggacagtcagtttgctgtgctgcacggagaggctccgcaggatctctgtgtctttctaccacgtcaaaaacaacgggaagat

SEQ ID NO: 689950 - DNA, 704 bp, Homo sapiens
  misc_feature (221)..(221): n is a, c, g, or t
  misc_feature (464)..(464): n is a, c, g, or t
  misc_feature (466)..(466): n is a, c, g, or t
  misc_feature (481)..(482): n is a, c, g, or t
  misc_feature (484)..(484): n is a, c, g, or t
  misc_feature (489)..(489): n is a, c, g, or t
  misc_feature (492)..(492): n is a, c, g, or t
  misc_feature (498)..(499): n is a, c, g, or t
  misc_feature (505)..(505): n is a, c, g, or t
  misc_feature (512)..(512): n is a, c, g, or t
  misc_feature (517)..(518): n is a, c, g, or t
  misc_feature (578)..(578): n is a, c, g, or t
gtcagccgatgccctctccacaagctgcaccaggtcaacacaactgaatgtggccaccggtaaggccggccaagcctgtcagtacgtgaagagacccccaattgccgctgcagagtagccccccaacctgtccccccagaaagacccccagccccctctgtcctgactcaggccctgcagggttcccaccccagggaatgagggaggggactcttgtgcanaaaccccttcttcccagcgccttccgcactcggagtccgggtgaacggcttgtggttagctccaaggtaggcctccaagttgtgctgggaagcaatatcactgcctagccttctctgaccacagactttgtgaccgttgacctatgcgagtggtgggagaatcagttccaggcaataatccccacctgttcctagtgataactgggagggggcgtttctacacggccgacctgtcgccaggananaagcatggcccctgnncncccantgngcctgnntgggtnccggccncaccnnaagtgccagcatttggacttttgcccctttttttcccttgggccggctgtcccaaccaanctgccatggccaagggccgaacccgtttgacctcagccctgctccctgtgcccagggaccaacgaccagcccctggggctggcagggaggagctccaggctaataaagtggagaaactgtcaaaaa

SEQ ID NO: 689951 - DNA, 646 bp, Homo sapiens
  misc_feature (298)..(300): n is a, c, g, or t
  misc_feature (602)..(602): n is a, c, g, or t
  misc_feature (625)..(625): n is a, c, g, or t
  misc_feature (640)..(640): n is a, c, g, or t
  misc_feature (642)..(642): n is a, c, g, or t
  misc_feature (646)..(646): n is a, c, g, or t
atggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggttgaagagtttactagcctcaagcgtgaactatgtagaagcggcagtagacccatctgacaatatgcnnnaattgcgtggtggttgtgcgacaacgcccacacagcaccgtatacttcgcaggtgtctttacaagcaaactttctttcccacccaccaggtgtatcacaagatggctttcgtgacataacgctctccacacaatttaggtcaagacgaattgttgtagaggtcactccacgaggctcgtgtgctcgacaagattcgactgtcgcgaaatcgtagacacacacacatcgtccacaccattatattagatagatgcgtccaggtgtacgctcacactacatcacaaaacaacacaaatcaatcnaacattaacatattggccggganggagaagggggtggngngggn

SEQ ID NO: 689952 - DNA, 217 bp, Homo sapiens
tactctcgggcctgcaggtaggacgtggggaatattctggggctcagagtgttgtactcgtacaagaaggatcatagatgtagtctacaactgcatctaataacgagctggttcgtaccacagacctggtgaagacttgtatcgtgctcatcgacagcacaacgtaccgacagtggtacgagtcccactatgcgctgaccctgggccgcacgaaggg

SEQ ID NO: 689953 - DNA, 143 bp, Homo sapiens
gcggccgcctactactactactaaattcgcggccgcgtcgacgtgtgtttttctcatttataaaatcggtaaatttaacgccctgggccaacaacgcttgtataaattgctactttccttcacatttttttaaaaaaaaaaaa

SEQ ID NO: 689954 - DNA, 160 bp, Homo sapiens
tcctcagtgatctccagctgtcacattgtcaatcgccgtgaccttgccatatttgcagcgtcaggccggagaccccgtgaattgagccggtcatttcacgacattggaaagaaagtcaggccaggcggcatccggatcaagccgcagataggccatgccc

SEQ ID NO: 689955 - DNA, 1075 bp, Homo sapiens
  misc_feature (19)..(19): n is a, c, g, or t
attttgttggccataattnagactgttacattttatatagtgtggtataaaatggggcatggatttatactaagtccatggagttcagtggaaggggaatgatttaaaaaaagttgtggttttctaaataatgtggcttgaaaaataggtgtaacaggacttggtcagaaacgcagaggctgttcaagtttagctccccaccagatggaaaataggttaaattctgtaaagatttaactttaaccacaagagggcacaactggagagcacaatttttttggtactgcagtaaaattgattacctcttgagaagtgttctttttaaccagctataacaatagagttgagtattttcacccatggtttgaaaaagtgccagaaggccacactggcccacatctgtaatcccaacactttgggaccctaaggtgggcagagcacttgagccaatgagttcaagaccagcctggtcaacatgatgaaatctcgtctctactgaaaatataaaaaatagccagtcatggtgcatgcctgtaaccccagctacttggaggctgaggcaagagaatcacttgaacctgggaggtggaggttgcaatgagccaagattgtaccattgccctccagcctgggcgtcagagcaagactctctgaaaagtaccagaagcatttttcaggactgcctgtgtgtcttggtgattatgttaaccaactgtgttcaaaagaagtacccatgaaatgcctccagatataagggtgtttttttttacccataaagctaaactgcaaatattaccctagaattaactcttgtcctgtgtcaaaaagtctagtttggactctggactgtaaactgtcagcttctctctgacagtctcgaactggtaagaacagctcagttaacaggcaacggtgatctgctacaccttccaattttcagggccaatatctcaagttctcaagcacgtcggtaacataagcacgggttgattatcatgctctgattcccttatctgtgcacgcttccccttaacggtccctcggagtcctaccagtaggcatctaacaacggaac

SEQ ID NO: 689956 - DNA, 943 bp, Homo sapiens
  misc_feature (19)..(19): n is a, c, g, or t
attttgttggccataattnagactgttacattttatatagtgtggtataaaatggggcatggatttatactaagtccatggagttcagtggaaggggaatgatttaaaaaaagttgtggttttctaaataatgtggcttgaaaaataggtgtaacaggacttggtcagaaacgcagaggctgttcaagtttagctccccaccagatggaaaataggttaaattctgtaaagatttaactttaaccacaagagggcacaactggagagcacaatttttttggtactgcagtaaaattgattacctcttaaaaaaaaaaaaaaaaaaaaaaaaaaaaaaaaaaaaaaaacaaaaaaaaaaaaaaaaaaaaaaaaaaaaaaaaaaaaaaaaaaaaggggggggggccccccaaggatatatctccccgagggggaggcgacaaacatatctactacgcgctagcccgcccttattttcttagaaaaaaagggcgcgccaccacacaataaaagggggcgcgataataatataaacagcaggagcgagccgaggcggagactgtaataaaacaacaacgctagggggcaagaaaaactgagaaaaggcgaatcactattggtgaaagaaagaagaaggaccaccacaatgtgcgggggggagaggagcgagcacaaaaaggtaggaggagagcaaccacacccactccccagccagagattaataaagagagcccacggcggaggagagaaaaaaacggaccgcacagagaggagaaaaaacgaggggagggcacaaccccacaacacgacgagagctagtgggcggcggcggggggaagaaagaagaagcagggcagccacgacacaggaagagcatgaaaccagccaggccaaagggactttttcaccccagggggggagccaaataagaaaaaagagaggggta

SEQ ID NO: 689957 - DNA, 175 bp, Homo sapiens
cccgacgctgcccgaacctgaatcgtcgaactcgtaccacgcccacccttgtgcggtttccgtctcgatcgccgccccagatgcgcgccgctcgacggcgacgttgcgaaagtctacataccggcccggcagcgatccgtagtcaggcaggtgcagacgctcggcgacccatgcg

SEQ ID NO: 689958 - DNA, 234 bp, Homo sapiens
tgctttagcctatcaccccttattttattttgttgggttttaggcccccagggttttagggaactttttaagagatcctctgctcccaaacaataatggggatttttttgcccagaaaaatttaaggggggagggtaaaaaatgtcacaaaagactcctccccaaaactttatgttgaaatcccttaatattaaccagactttgttgtattgcaataaaacagagagctgttta

SEQ ID NO: 689959 - DNA, 100 bp, Homo sapiens
ctatctgttagaagctgagtataggccttaaacagaaatggtactgaggcttcctataccaaatcaaaaagagtactgacaccaattctcgaatcccacg

SEQ ID NO: 689960 - DNA, 162 bp, Homo sapiens
gccaggctggtctcgaactcgtgaccttacgatccgcccgcctcggcctcacgcctgtaatcccagctctcagggaggctaagaggcgggaggatagcttgagcccaggagttcgagacctgcctgggcaatatagcgagaccccgttctccagaaaaagga

SEQ ID NO: 689961 - DNA, 545 bp, Homo sapiens
ggtggtgctagtttctctaagccatccagagccatcctcgtcggtggagcgagagacgctctcgcgggcggcatgactgagcagatgacccttcgtggcaaccgtcaagggcgcagaacggctgggataaacccagagtcgcgtacgtaccccgcagtgttcccggacattgaatcctctccgacctgctcgagaataagtagccaatcgatcactggtggaaagctgaccagggatgagagccaaacgtatggaaagtatccactagcgtgtctctgcgagggtcacttcccaacttatgtataggtgactgtggtgtatctcctcagagtggaccacgtttgcacctcctcaggtcgtccctgggagtggaagccgctgctgccgtcgtgggagtctcacagacgtggcagccaccgagcgaggcggatttgtgggccataccaaggatgtgctgagtgtggccttctcctctgatgaaccggcgagattgtctctggatctcgagataaaacgatcaagctatggaataccctgggtgtgtg

SEQ ID NO: 689962 - DNA, 414 bp, Homo sapiens
gactattaactaaagtctcttgtatatgatgtgctcctaaaacctactaactctttctactggaatgagatcttctccggccttgggataatgggaacgtagccgactcctagacttagaatagagaccgccgtactcaatctgattattgaacgactgtgtctagaagatgagggagtcctcctcctactaaaacatgatctagatctagaatgcctacttaatacttcttacttatctggttctatagcagcagaaattagggactgtgcttctcgtactcttttcaaagctaacctctatatctttactagaggtaaccgatttcagaattgatgacacgagaccagcagctaactgattcaacttgcaatcaacagtactcataaagcttcaacaaatagtcaacaacac

SEQ ID NO: 689963 - DNA, 133 bp, Homo sapiens
tatgagagtggtggagcagagaattctacttatacaacatcaacatcttgtgtcaagatttgaactcttcaatctcttgcactccaagcttgtaaagatagttcagcgtgcattagttgcccgccaatcggaa

SEQ ID NO: 689964 - DNA, 407 bp, Homo sapiens
gcacaggtctacaaggattgtgatgaagatttaagatgtgcggtcaggagttcaatgaccagcctgggcagcatggtgaataccccatctctactaagaatacaaaaaatattatctgggcattgtggcaggcacctgtaatcccagctacttgtgaggccgaggcaggagaatcgctcgaacccgggaggcggagcctgcagcgagccgagacggcaccgctgcactccatcctgggcaacagagccagaccctgtctcaaacaaaacaatacagtctagggagtttcattctagcagctatgctcttaggtgctcaaaatttgttgaacattatcaagaacagaagttgagcagaaaactaatggatagtgaagaaatacttattgacattcttcacatagaatg

SEQ ID NO: 689965 - DNA, 116 bp, Homo sapiens
acacaacacaacacaaacaaacacaacaaaacgaaaaaaaggacgtgatagctatatatggcccatcgtgctcagccgaaggacgagcgccaggagcctatagagcgaggaagcgg

SEQ ID NO: 689966 - DNA, 358 bp, Homo sapiens
  misc_feature (234)..(234): n is a, c, g, or t
  misc_feature (259)..(259): n is a, c, g, or t
  misc_feature (277)..(277): n is a, c, g, or t
  misc_feature (314)..(314): n is a, c, g, or t
  misc_feature (346)..(346): n is a, c, g, or t
  misc_feature (350)..(350): n is a, c, g, or t
agggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctncaggagtgggagttggagttgatanctggatacagaagctctntgggtgggagttaggcaaaacaaagggtcctcaggtnttgggacaagcaatttcctctggtgaaaaaanactnggctttct

SEQ ID NO: 689967 - DNA, 246 bp, Homo sapiens
tgcgctgaattgtcataagaaacaccaacctgttgtcgatgttgaaaacaattgtgattgttgccctgtaacattgtgaagtgttccgttgaattattcacacacctgaaatatggcaggtgtcacccaccctcgctgtagaatatagaataccattatgggctttattaacaattattgttaacagtgtatgcagtggttttgcctagttgttccaagttgttggaaccgtcaccaatataacaa

SEQ ID NO: 689968 - DNA, 1469 bp, Homo sapiens
  misc_feature (569)..(569): n is a, c, g, or t
ctgttcgcccccggagttactgggatcgcgctggatgtctcgccccgtcgcgctgcgccggctcgcgctgcgctatttagctccgattcccacactcacctgctggggactttcagccgccgcctgcacatctgccgccacagcctccgccggctaccctgaacgttctcgtgggccagcgccgattggatcaccggggaccgcgaggcaccctgctgctgccgcatgacccctgcgcgggcttggattcaccctggctagagctgcgccatcatgcgccgtggcctcttgtcttgccctgggctgctgccagagcctgcttgacgggcgcgcaagagctgccttgggactccgggatgccctgatccctatgcgccgcgatgcgggaaggcaacctacttgcagagagatcgggggcctgggacgctgctggccgaaggtgtgatcggaaccccaggctagccacaaaaggtgcactttggccccagtggctaaggaagagccaaggggcacgagcaacagaccaacaccgacttctgatgtggcccgggaacttcgggatcagaacntcggcccggacgcaatttgctgcccccgaatggtaaccataccgtggggtagtaccaagtagtaccacgacgggttgcatattacaaaatttgggcagaagaccgcgaaaatttgtgtgggggttgccaccatgggaacgtaaagtgcacagagtttgaattcacgtgatgctgtgtcaacatacaccttggtacaaccagaggaatacagaccgacacgtataaacaccattatcacatatgtaacacccaggtaggttttagccaccaacaggaaattaggcattgcccccacgaaaggcccatttggtggtcccggcctgagtactgggagatacattaacgacagagcatagaaggcggcacaccagaaacacaattagtagcacccaactgaatatcccctaggaaaacccacgtagcacaccagtatacatggaggtaactacatgcgagtatacaccttcagagggcaagaattgggaacacataacgggaatggactagaaaaagaaaacgcaagaggatacaatccagattaacatacgcattttacacgatttagcagatatcgacacagaagagagatacaaataccaccagaagaatcacgagatagaaagtaatagataggagagaacagaaccatattacgcaatagcgaagaacatcatatagacaacaatagagaacaagagaaactagaaccaaaatagaagagaacaaccaacagataaaagccacagagaacagaaaataagacaacagagaagaaagagtaaatagaaagaaaagaagaaagaacaagtagagcgagaaaaaacacaaagacagacaaaaaaataaagaaaagagaaacaccaaaaaagaaaaggaagaagaataaagagagaaaaccag

SEQ ID NO: 689969 - DNA, 550 bp, Homo sapiens
  misc_feature (53)..(53): n is a, c, g, or t
  misc_feature (87)..(87): n is a, c, g, or t
  misc_feature (92)..(92): n is a, c, g, or t
  misc_feature (284)..(284): n is a, c, g, or t
  misc_feature (293)..(293): n is a, c, g, or t
  misc_feature (393)..(393): n is a, c, g, or t
  misc_feature (398)..(398): n is a, c, g, or t
  misc_feature (406)..(406): n is a, c, g, or t
  misc_feature (425)..(425): n is a, c, g, or t
  misc_feature (439)..(439): n is a, c, g, or t
  misc_feature (441)..(441): n is a, c, g, or t
  misc_feature (509)..(509): n is a, c, g, or t
  misc_feature (511)..(511): n is a, c, g, or t
ggtaatatattttcaaggggtgattttctttatttttgttaatattaaaaagnctgtatggcatgacaactactttaagggggaggnaaggnttctgtctactaagagatgctgtgataccttaggcactaaagcaggactagtaatgctttttgggattcatgatggtttattttcacaggttggggaaacgtgcactgtaaggcgaatgaaacatgatgataactttgtggtctaaagtgattagctgtcaagccggatgcctaagttaggacaaatcttgntattgaagngatctgagctgtatcttgatgattagaaaagtattcgttacatcttgttagggactactttttgaacttttcattccctgtagttgacaattctgcatgnactantcctctanaaaataagttaaactgaancaacttgatggaangnactctccacagggcttgtttttccaaagaaaattattgtttggaagaacaaagttaaaaacctacctnancatatccttaaagctgttcaaaaataactcaaaccatct

SEQ ID NO: 689970 - DNA, 159 bp, Homo sapiens
cactatcgtgaaaaaaactctacctctctatactaatcatccctacaaatctccttcattataacatatcacagccacatgacctactcatatatatatatcttcttcgacaaccacactatatcacccaccttgtgctatcatacaccctgatgcagt

SEQ ID NO: 689971 - DNA, 139 bp, Homo sapiens
ctctgagtatcccaattagaggcacggaccgaagcctgagagcctttcctctgtcaagtgggactgaaactcttgtacagatgctgctcaatctgactggtatagtcaggacagttaattccgtgggcctctatgaatt

SEQ ID NO: 689972 - DNA, 523 bp, Homo sapiens
caaacctaaaaaaaaaaaaaaaaaaaaaaaggaaaaaaaaaaaaaaaaaaaaaaaaaaaaaaaaaaaaaaaaggggaaaaaacccaaaaaaaaaaaaaaaaaaaaaaaaaaaaaccttgtgggccgcttggcccaatcgacttttaaactggaccaagtttttgctggcggccgaatttgggcctaattggcccaatgccccctatggggggtcgtttaaaaataaatgggccgcgttttaacaacgtgggaacgggaaaacccctggggtacccaaattaaatcgcttggaagaaaatccccttttcgccagtgggggaaaaagaaaaaaggccccaccggatccccttcccaaaaagttgcccaccctgaagggcaaaggaaaattgtaaccctaaatttttgggaaaaatccgggtaaaatttttgtaaaacaaactctatttttaaaccaataggccaaaatcggaaaaacccctttaaaataaaataccccctggggttgagggttttccctttgggc

SEQ ID NO: 689973 - DNA, 101 bp, Homo sapiens
aaggctattcttaggcctcaggcctcccaaatatgcccctccccagtagatacggttccctgcataggagctggggagggagagatctaatcccttcaagg

SEQ ID NO: 689974 - DNA, 125 bp, Homo sapiens
aatgaggaagaggacagatgcaagtcaggtggtgagagcacttggaggggctgaaaggacatgggctgggagtgaatgcatgtgcacatacacacacacacctctccaacatatgtacacatgca

SEQ ID NO: 689975 - DNA, 1021 bp, Homo sapiens
taggtgagcccggtgttaatcggccgagggtctatggtgtggcgctgcggaactgaggcatgaggggagctgcttatccgcttcttcaactccttcaatgaggccaccatggttctggtctcctggcctcatgtggtacgcccctggtgggcatcatgttcctggctggctggcaagatcgtggagatggaggatgtgggtttactctttgcccgccttggcaagtacattctgtgctgcctgctgggtcacgccgatccatggcgctcctggtactgcccctcatctacttcctcttgcacccgcaataggaacccctaccgcttcctgtggggcatcgtgacgccgctggccactgcctttgggacctcgttccacgtctccgctcacgctgccgctgactgatgatgtgcgtggaggagaatattggcgtgggcaagcggatcacgccgtttcatcctgcccatcggcgccaacgtcacatggacaggtagccagcgctcttccatttgctggtggtcagctgtgttcattgcgctagctcatgtccagcagatcctgtgtgacttcgttaaagatcatcaccatcctggtctacggacacgagcgtccgagcgtgaggggcgagccgcgtgcatccctgcttggacggtgtcctcactctggtccatcatcctcgaagcagtcgaacctcccggtcgaccatatctccttgatcctggctgtggactggctaatcgacggtcctgtgaccgtcctcaaatgtaggaaggtgaccctgtgcgggcagggtgtcctccaaaatcccgtggaccgacggatgtccagaagcccgatcctgattgatcccgtgaagagtgagctgccctggatccgtgccctcccctggggaaggaaccccttctgacccttagtggccggggatgccagtggcaccagaggaaaccctgtaccggggatccaccttggtgtctggcccgttaggaaccgagacactctcgttctccctggacgcccgaga

SEQ ID NO: 689976 - DNA, 133 bp, Homo sapiens
gtagacatccaccgcgccagccctgctgccaagagcccgtcggccccacttatggagcagtggctcagcttagtccctgagtgacaccgtcgagaagctcaaggatgaggtcctccacggagacagtatctca

SEQ ID NO: 689977 - DNA, 308 bp, Homo sapiens
agcatacaccgtcccagcgagtcaccctctaaatcaccacgatcaaaagggacaagcatcaagcacgcaagaaatgcagctcaaaacgctaagcatagccacacccccacgggacacagcagtgattaaccttatagcaataaccgacagtttaacttaagctatactaaccccagggttggtcaatttcgtgccagccaccgcggtcacacgattaacccaagtcaatagaagccggcgtaaagagtgtaatagatcaccccctccccaataaagctcaaactcacctgagttgtacaaaactccag

SEQ ID NO: 689978 - DNA, 174 bp, Homo sapiens
  misc_feature (40)..(40): n is a, c, g, or t
  misc_feature (48)..(48): n is a, c, g, or t
  misc_feature (75)..(75): n is a, c, g, or t
  misc_feature (110)..(110): n is a, c, g, or t
tgaatgatctgacctattttgtgctggcagctgaaacagntttttttntggatgaatggatccacaccctcaacngcattctgcaaatcagtcctgaggggcccctccangggaggaggagcacagagctcactgatctgggtctggattcgctggataattctgtaacttgtg

SEQ ID NO: 689979 - DNA, 914 bp, Homo sapiens
  misc_feature (424)..(424): n is a, c, g, or t
ttttcttataagtttttaatgatcaaaacaaagcatttaaaaccgcagttcttggaaaaccaatgtgtcctggctggacgactactccgggacgcaaagcggctaatcgctgaagaactttgatgatgcaccctcagatcgcccctagagccatgcatctggtggctggaatggaccgctacccccggaaagtgacagctgcccattggcccatgaagaagatcgcctagagatcaaagataaacatctttggtgaaagctgtataccttacaatcacctaattgcccacaaggtactcctgtggatatccccctgtggacaaaaattgtcgttcaataaggatgtctctcagaagatcctggctccttaaaccgtcaggaggccccgaacggggaagtgcccaaggtccaaggtctcggaagnagcagcatacaaagaccaggtcatagaaaccaagttggttccttccagaaacccgtggcggttcctcagcaatgccttgggtcccccgagtacattcaacaaactgtctccaccgcaaaagacaatactacaacatctcatggatgacatcccaccagtagccatatcacaaacgtgcgcaaagaccacctacgtcatatgacagcacgcgttaaatattacatacacccaacgacaaggaagagctagcccacgtaaacctatgaatataagatgccccacactgctagacaacggactatcgtactcccatgcttctagcgaagacaccaccgccgagcctcaacattgtagcaccaacacgggcgggctcgcctcccctatactaaaccgcgatcctcgtctattactgagcaacgacgcgacagcaccaccggaggccgtgcccatgctaataccccacaacagcggtactagctacgtagcgaaa

SEQ ID NO: 689980 - DNA, 197 bp, Homo sapiens
aaacctgtatcaatttgagtatactgagcaagtatactcgagacgatagaattgcataagattttgtccattgagtaatcacatccaaagatagaactcacgacgtgtgctgatactatgatgaatccctcattcctggccttatgttacagttcatagagggccagatgctgagggctgtataccattcataaaat

SEQ ID NO: 689981 - DNA, 1554 bp, Homo sapiens
ctcccccgtgcactgccctgcccagcctccgtgggctgctaccacgatggtggcctggctggtgtgtgtgctgtgctggcgtgcacccctgatgcagtgtggacactgtaccctgtactgggctgcccacaccgtcctgaagatgtctccccatggacgtgcttggatgcctgtgatgcatgaccattcttcatccatccctcctgccatgtgagtgatgcactggccaatcccctgcctgacatcctcccagccgtgcacagtggacagccctgtagctcagcctgtgatgttactgcccacaatgcgccatcataccacttgtatgcacacacacaccatgtgtgctcacacttgtgccccatatgtgaccaggttccacacctggactgtcttccacttgcattgtcgccactgttacctctctgtgagctggtcaccacgcagtacgtcccattggcgctacattagcgtacgcactcgtggcacagccctcactcagcaccagctacacaacatacgcaagcacatcctaatggccgcgacccttgtgtgcccaagagccttatatcacgcacatgcgacaatcccatcgcatgccaacccgttgtgcatatcaagagcgggcccacatagtgcactccaaaccttggaagccccatcgagttgagaaaccatcacattggacgtgtgaacgaagttggagagcttcagagcatactcttgataagattatccagaaccccagcgactgcctttcttggaacacctatcactccaccttgctgacgcaaccacccccagtggaagcagtactccatggcacccaacctactcgcgtggtgccccaacttgcgacgctcctttccaaccgtctggggagcaagcttggctttccccatggcggcttaccattccacatcgcagcggtggaattagaaagcgagcacaccaaactcacagtagttcgctttcccagcagagacgaaggggaagagacacgtgcgaagaggcccacttcagcagtgttcagttccacaggggagtccccatttggggcgtacttgggacgcttagcacgcgaagcgaggagtacccacaccgctgttgatcctacacaacatagagcgacacggtcgtatccccaacagcacttgggtgggacccacagtcaaccgacacacacttggcgaaacggaggcatagccacccaccggaagcctcagggggacccacgggagccagcatccgaccaggaccccagtacctgtcgcaggatacccacttgggaaggccccggatatggaagagttctggagaaaagacgaagacagcgccaagaagacacagaggcaacaacagaccccaaaaaggaactactaacgccgttccccgcagaccccagggcagcccaaacagaggcacacaacaggacacagcaggcgccataacagaggccacatcgggagacgacgccaccagaaatgaagccatactctgacagccaccaaacaaagcgataggaagacgaagccaagacacgtagtaaagccg

SEQ ID NO: 689982 - DNA, 141 bp, Homo sapiens
ataaaagggggggggggggtttttttggccccccccaaaggaaaaaaaaggattttttttccggggggggtttggggggccttttttcaaaaaaggggggggtttttgggggggggaaaaaaaccctttttttttttttta

SEQ ID NO: 689983 - DNA, 112 bp, Homo sapiens
gttgggtttataccgggtaggtaacggggacaagtgaggtaactgataccttgcttttgtagacagtgcaagacaattattttgtaggtgaagggactgtatgccaacaagc

SEQ ID NO: 689984 - DNA, 576 bp, Homo sapiens
  misc_feature (10)..(10): n is a, c, g, or t
agaggattcngccggatgataccttttaccagagcgggtcatgcaaagctgtcaaaagagcaacttcaggggttctagaaatcatgagataaacccacactgagacagccaatttgtgtcttcaattctcacagctttccatagcatttttttttaagagaaaggtactgcgtctttatcatacaggtacagcagttttaaagggacaaaattcaagtcaagacagttaccaactctcatcaatacgattaccaaagcacgacagaggattaacaagaagcacaatcgtcagagaaccacagcaggagtcgggcatgggtatgctatgtgcgtaccaccagtctagagccagccttcggtggagagcctggactggataggctgaagatgccgctgtccctgcaccaaagcgcttggacagcagaggagaagtcttagtcacttaccctcagaggctacccatgaggtctggaccaggtgttagttacgctcacactctaacacctgaaggtacataacgattatcttatgaggatgcttcacatggacgcagaaaaccaactctttgagaactcg

SEQ ID NO: 689985 - DNA, 425 bp, Homo sapiens
ggtgaccaggcgaggcgacacagccagacactgtgctttacacgggaatacagaaattacgccaggtgaggtggtgcacgcgtgtagttcctgctactcgggaggctgatggtaggaggatcagtttaggcccgggagcttgaggctgcagtgagctgtgatcgtgtcactgggtgacagggcgaaatcctgtctcaaaaaaaaaaaagcaaaatggtggtcctaggacagatttggatttacaaagttaaggcgggcaattggtaaaagtatagaatcaatggcaagacctctctccggtttatgtatccactgggaagttcccataggcttccggattcatcatttacaatggaattcctcttcccgggtatatcctaacctcctatatcctctatcacgggaaagggccccattttgtataa

SEQ ID NO: 689986 - DNA, 143 bp, Homo sapiens
agaccctgtggtgcttatggtcggctgctgcacacggactggggaccggacggcggacgacgctgacacggggctgggctgggcccgctgggacgggccgacggacgtctctgcacctggcacgttctgtacacccctgacgc

SEQ ID NO: 689987 - DNA, 108 bp, Homo sapiens
gtgcgaaactgtatcgtattatacgatggctgatatctgagtagtgtgattgaggtggagtagattaggcgtaggtagaagtagaggttaaggagggggtaccgagct

SEQ ID NO: 689988 - DNA, 537 bp, Homo sapiens
ttttgaatgcaccaaattttgtaatcttactgttacttctttgtattccattgcttcaaatggtatcacacctctgaatatgttccttaaaatttattagttacatataggcttatgtatatgtgtagtcattatatatgttcttatagggaagagattttatcattttgttcatcatgtaaacccacaagttcaagaaaaatactgatagagggtagatccacaaacattggtggaaagtgtgaaatcggtttgccagaaatatgaacaaaggaagcacaatggcatacaggacggtattccaaagtttttaagttgtgtcttggaaagttgtgtagtgagatttcagcagagggtaaacaccccgaaataacaattttgacttctatattatgacttgctttggcagtctacgtttgttccaaaagtgtacatcttcttttctaaacagagcttcctaatacccaattttgacaccaattccatttctaaaccacgattggcagttcagtatttctgatcatttgttatctaacc

SEQ ID NO: 689989 - DNA, 871 bp, Homo sapiens
ggcgtgtgaacctgacggaactgctcacgatgctgacactttgaatctctgtcactgctgctgggagccagagcgggcaaaacgaattgttgactagcggaaagacatcgggcggtatcagggatgactccccgcactggttcaggaattacggtaagaggaccccctccatatgtggcctggtctgcgagcaagatgtcgcagcaccggactttcatcctatagtacgtaatggagagccctgaaggaagtgttccagagaagaggtgcccggcaggaattgcatcgagaagacatcagcgtggctcccaaaatttctcagaatgaccaacgaagtaggcaaaagacatcttcgccctctgtagtttattgccatggggatttcctgtgagaagcaaacgggtcgcagacacggtaatatacttgggcctgggccgcagtggtggcgccatgcaaaagaagatccttggtacgcagaggcggccttgggaaaaaggtggtggaggaccggttcattgcgtgcttgttgcgcctcgtgggtcagacagcgttggctttcccccgaaaaccctggtggtttaccaatcgatccaaaagtcacctccgggagggagtccaatttcgctgggattcggtacgggtaacgcaagagaacgtgggcggttagtattgggggggagctctccttcgcagaccggggcggtccggattaacctcggccctttcccaactgttcgcatgtgttccatttgggggcctccaggcccttgtgttggccccacctgcctgtttgggggagtgctgtggacttgatgatccccattggcgcccacttgggcgcgcgttccccagggggttggcccccggccag

SEQ ID NO: 689990 - DNA, 832 bp, Homo sapiens
  misc_feature (25)..(25): n is a, c, g, or t
  misc_feature (90)..(90): n is a, c, g, or t
  misc_feature (104)..(104): n is a, c, g, or t
  misc_feature (112)..(112): n is a, c, g, or t
  misc_feature (119)..(119): n is a, c, g, or t
  misc_feature (123)..(123): n is a, c, g, or t
  misc_feature (133)..(133): n is a, c, g, or t
  misc_feature (142)..(142): n is a, c, g, or t
  misc_feature (144)..(144): n is a, c, g, or t
  misc_feature (146)..(146): n is a, c, g, or t
  misc_feature (154)..(154): n is a, c, g, or t
  misc_feature (158)..(158): n is a, c, g, or t
  misc_feature (160)..(160): n is a, c, g, or t
  misc_feature (172)..(172): n is a, c, g, or t
  misc_feature (177)..(178): n is a, c, g, or t
  misc_feature (190)..(190): n is a, c, g, or t
  misc_feature (192)..(192): n is a, c, g, or t
  misc_feature (207)..(207): n is a, c, g, or t
  misc_feature (210)..(211): n is a, c, g, or t
  misc_feature (214)..(214): n is a, c, g, or t
  misc_feature (216)..(216): n is a, c, g, or t
  misc_feature (222)..(222): n is a, c, g, or t
  misc_feature (229)..(231): n is a, c, g, or t
  misc_feature (238)..(238): n is a, c, g, or t
  misc_feature (245)..(245): n is a, c, g, or t
  misc_feature (249)..(249): n is a, c, g, or t
  misc_feature (260)..(260): n is a, c, g, or t
  misc_feature (272)..(273): n is a, c, g, or t
  misc_feature (300)..(300): n is a, c, g, or t
  misc_feature (305)..(305): n is a, c, g, or t
  misc_feature (308)..(308): n is a, c, g, or t
  misc_feature (314)..(314): n is a, c, g, or t
  misc_feature (316)..(316): n is a, c, g, or t
  misc_feature (318)..(318): n is a, c, g, or t
  misc_feature (320)..(320): n is a, c, g, or t
  misc_feature (328)..(328): n is a, c, g, or t
  misc_feature (350)..(350): n is a, c, g, or t
  misc_feature (363)..(363): n is a, c, g, or t
  misc_feature (367)..(367): n is a, c, g, or t
  misc_feature (392)..(392): n is a, c, g, or t
  misc_feature (396)..(396): n is a, c, g, or t
  misc_feature (400)..(401): n is a, c, g, or t
  misc_feature (409)..(409): n is a, c, g, or t
  misc_feature (414)..(414): n is a, c, g, or t
  misc_feature (424)..(424): n is a, c, g, or t
  misc_feature (448)..(448): n is a, c, g, or t
  misc_feature (462)..(462): n is a, c, g, or t
  misc_feature (469)..(469): n is a, c, g, or t
  misc_feature (477)..(477): n is a, c, g, or t
  misc_feature (487)..(487): n is a, c, g, or t
  misc_feature (497)..(497): n is a, c, g, or t
  misc_feature (499)..(499): n is a, c, g, or t
  misc_feature (502)..(502): n is a, c, g, or t
  misc_feature (510)..(510): n is a, c, g, or t
  misc_feature (534)..(534): n is a, c, g, or t
  misc_feature (545)..(545): n is a, c, g, or t
  misc_feature (582)..(582): n is a, c, g, or t
  misc_feature (593)..(593): n is a, c, g, or t
  misc_feature (604)..(604): n is a, c, g, or t
  misc_feature (606)..(606): n is a, c, g, or t
  misc_feature (612)..(612): n is a, c, g, or t
  misc_feature (728)..(728): n is a, c, g, or t
  misc_feature (819)..(819): n is a, c, g, or t
tcctgtcggaccaaagcattacacnagggggtattgccagggagctcttgcagagccttctccctctgtaccccccgacagtccccaganaccctgcctccgtngcctccanctctggntcanctccctggangaccccganananagggaagnaggnanaggagggctgtnggggnnaaacctccccanangcaaaaaaagaaatnaannaantngaaggntaagtannnaaaaggnggttgantganttgaatgaacnaacctgtgggtnnagtcaaacgaaaaaatgtaaataaatnaaggnctnaatttnanantnaaaaaaanaatcgggaaaaaaaaattcgcntataaatgaatanaatnaatggatggaaaaaaaaaaatggantggnaatnnaatggaanaaaanaaataaaatnaatcctttaatggaataaaatganatgaagaaaaaatnaaaaaanaaaaaatnaataggtganaattggattntngangaaaaatnttaagaagaaaaattgtatgtatnaagggactgtnttatgatgaaataaatgtaatttcctggagctaattnttgaatgaaantatgtaaaatntntaaatnaatttaattatgaattaacaattatacagccactcagaggtcctacattcgccagaattggcatccagttgatgggttcatttgaattaaatggtttggaggctaacgtgattttntaaattgaatttcatcactattctgtgtattctatttatcactattctaaataactcatggttggataattgattatcatgtaagcaagcnatttgaagaaatt

SEQ ID NO: 689991 - DNA, 757 bp, Homo sapiens
cgggactaccgggggtcattggccaggttcagatactgtggcacatggagccctgtcgtgtggatcttctttttattaccaggttgggccctgaccaatgcctggcgcccagaggtttgagctgtggtgagctggggtcaccaccccgtgcgttcccgccctgtgtgaccgggccaggcctcatgcgctctacaaatttagtagttacccgaggttataactggactctgagatatgacttaagttcttgtgtgatacagtgtgcccgtaattagcgtccagaccattccctggggcaaccctattggaactggcattgtaatccccggctatgtctcctttttagcgttctgtaatcctttggccagcgccccttggattctttccagcctggtacccattaggagactcgatccggtgattgcccttttccaactgtccagttctcttaatttcaggcgttggtagcttgtaggaactgtaaattgcccatttaacaccctttatgtaacctcccaacttatccatgtgattcaccacgaaaaagtccccttctttccccaaccttgatggtacccccacctaccagttttaaatatgaagtcgcacctgttttaagagattttgcatatattttatgtgccaccttccagaaccttttttttgggaaaaggaccccaccatttttataactgcaccatattaatttattgcccgaataaattgccttgccatcttaattaatccgataattcca

SEQ ID NO: 689992 - DNA, 435 bp, Homo sapiens
  misc_feature (25)..(25): n is a, c, g, or t
  misc_feature (90)..(90): n is a, c, g, or t
  misc_feature (104)..(104): n is a, c, g, or t
  misc_feature (112)..(112): n is a, c, g, or t
  misc_feature (119)..(119): n is a, c, g, or t
  misc_feature (123)..(123): n is a, c, g, or t
  misc_feature (133)..(133): n is a, c, g, or t
  misc_feature (142)..(142): n is a, c, g, or t
  misc_feature (144)..(144): n is a, c, g, or t
  misc_feature (146)..(146): n is a, c, g, or t
  misc_feature (154)..(154): n is a, c, g, or t
  misc_feature (158)..(158): n is a, c, g, or t
  misc_feature (160)..(160): n is a, c, g, or t
  misc_feature (172)..(172): n is a, c, g, or t
  misc_feature (177)..(178): n is a, c, g, or t
  misc_feature (214)..(214): n is a, c, g, or t
  misc_feature (216)..(217): n is a, c, g, or t
  misc_feature (220)..(221): n is a, c, g, or t
  misc_feature (227)..(227): n is a, c, g, or t
  misc_feature (237)..(237): n is a, c, g, or t
  misc_feature (246)..(246): n is a, c, g, or t
  misc_feature (262)..(263): n is a, c, g, or t
  misc_feature (287)..(287): n is a, c, g, or t
  misc_feature (299)..(299): n is a, c, g, or t
  misc_feature (305)..(305): n is a, c, g, or t
  misc_feature (309)..(309): n is a, c, g, or t
  misc_feature (313)..(313): n is a, c, g, or t
  misc_feature (321)..(321): n is a, c, g, or t
  misc_feature (332)..(332): n is a, c, g, or t
  misc_feature (380)..(380): n is a, c, g, or t
  misc_feature (396)..(396): n is a, c, g, or t
  misc_feature (399)..(399): n is a, c, g, or t
  misc_feature (416)..(416): n is a, c, g, or t
  misc_feature (426)..(426): n is a, c, g, or t
tcctgtcggaccaaagcattacacnagggggtattgccagggagctcttgcagagccttctccctctgtaccccccgacagtccccaganaccctgcctccgtngcctccanctctggntcanctccctggangaccccganananagggaagnaggnanaggagggctgtnggggnnaaacctccccagctagccacaaccgccatgaccccntnngcnngtcatncccacaaggnggttgcctncttttacataactccnnaaaaataaactaaaccgatcagantactcatgactnccaganttgntccnatttgatncggcgcctagngtttgctccgcacaagtggccaataaaatcaaaatcgaatccaattcnattggcaagatcagcnggnataggatttccattcgnttgctgtgcngcgacaccc

SEQ ID NO: 689993 - DNA, 136 bp, Homo sapiens
cgccacttcttcagataatattttctgaactaaagtcttttcctaaaattatttattctgttaaactttaatgtaacgtaatgttctagatccaagttatagtgtctattgtacttatgggacttacatatttaac

SEQ ID NO: 689994 - DNA, 654 bp, Homo sapiens
caaatgggaaaaagggtaagggaaaaggagatgcaaagatgcttaacaggaaaaaaagggccataaatgaggttaaaccaggattaggaattcattttaactcataactttggcaaaaggtaaaatttttttagacggagcctggctctgggtaagtttcgatctcaactaactgaaaccttaaccttccaggttcacgcaattcttctgcctgggcctcccgagtagctggaactacaggcgcctgccataacgccgggctaattttttttggaattttaagtaaagacggggtttaaccatgttaaccaggatggcctcttaatctctggacctcgggatctgccaacttaagcctcccaacgtgctgggattacaggtgtgagccaccatgcccggcccactttggtaaaatttaaggagtccaatgtaccgttgatgaggatgtggagaagcaggacctaacaccatgctagtggaaccatgattggctctatccctttggcaaagtaatctgccaatgtttattaaagggttgaactttgtggttcacgcctgtaaattcagcactttgggagacccagttgggaagatcccttgggcccagcagttgaagaccagccctgggcacatgattggacccttttttcattt

SEQ ID NO: 689995 - DNA, 132 bp, Homo sapiens
  misc_feature (78)..(78): n is a, c, g, or t
tctgtgcgacattttattacacagggaaatggggtccctagctgcacacccagcctgagctttttcaagcagataaantcacagcagaaatagaatcaccctaggacttctcgcgtgttccctggtgcttac

SEQ ID NO: 689996 - DNA, 256 bp, Homo sapiens
tcaggagaatcacttgaacccgtgaggcagaggtggcagtgagctgagatcacgccactgcactccagcctgggtgacagaatgagaccctgtctcaaaaaaaaaaaaaaaaaaaaaaaaaaattttttaaaaaatgaaaattcaacccttggttttaaaatggctctttgttgggccccacacctcactctctttacagagggcccctggcctctcctgtggccctcttccccaaccccaactctctcacaatcc

SEQ ID NO: 689997 - DNA, 416 bp, Homo sapiens
ttttattcaacctgtcagttcaacccatgacagggatgatttttgagattctgagctccccttgcttcaactgctaccctcttctaaagtgaccattgaggcacctcgaccgagccttaggactgcccatcctgaacactgaaaaccactgggccagtgccgtctccccatattgctggatcaggagaatcatctaaggtctttcttatacacagaatccctgagccccaccccaatctactgaatcagaatcttgcagtctgtgtttctatcaagtgctggagggcagtcatgatagactagtcaagttcataatgaacgctgtgctaggagcagagggccattttgggaaactgggacttgaaaagggcaggtttattaggggatgtttgattttcagggctgaggggttcatt

SEQ ID NO: 689998 - DNA, 174 bp, Homo sapiens
gaccatgtaaactcttgagaaagggtctatgactctttaaccaattattgttcaaaggagtccccaaagtgttaagcagtttcaaggacagacatccctcctaccaacgcagtggacttcactggaagatgctatttcaccaaaatctgcaaatgtaaactgaagtgtcaacgt

SEQ ID NO: 689999 - DNA, 1029 bp, Homo sapiens
gaaggacccagttccttaccagtgctccctttctctgtcagctggggacgtcatcagacgaagctggaagccagtaaagtgaactaattcgtttagaccacatatataccaagcccgctagtcttagagatacccgtctgtaggacagagaggccaagctgaattgtggtagtgaaaatctgaggaagcgatctctcagtccctcagagaatgatcaccctgaattcattgtctcagtgaaggatgaacgctgtacgaagatgacctcgttccaggagctgggtagtctcaaattctgctttcatcacagcacacatggcccgaaagcactatcttgcctgtcctacatggatggctgtgactagttgaactgtggatacggggggttgccctttcccgcgagttcgaggtgacgatgtacactgctctgctatggtgtaaatccattgctctgggaggacactctttgcccacttgaactgctttccccgagcgtagagttagatgtctaagggaagtgatccgagaatagctgttgacccttttccgttgaactattacatcttgcctggaggatagcaagagaaagcctgtctgtacttcattcgggaacagccaaagtagagagtatacaggcctagagaatacctctatattgttcagatctcataggatgacccccagtgtagttgtcttttgacatccaggcagtccaaggctattgagaccatagttcgtggaagtcagaaatgttactataatgtgagaagtacagctgtaagatgtacttttatcttacaaggggtggtagtataccctaaaaatactctattattgtacgggtcatttagaccacgatgtcttgacggtcgagcatggaacttactgaagtggtgcttcatcatttcatcttcgcgctttgggggcatcctgggcgtggcctccaggttgaggtccttagttggcttgctgtcagcagagggaaacactgtgaggggggatcttcctcatgtatactgacggtagacg

SEQ ID NO: 690000 - DNA, 503 bp, Homo sapiens
ccggaccggtctcatgcacagttggtggatacccacgtgatataaaaacaaatctacacaaaaactgtgcacagatgttcttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttga

SEQ ID NO: 690001 - DNA, 164 bp, Homo sapiens
gactgttcttagaccacaaagtgtgtgtgtctgtagctcagttcccagacagcttctaggtagtgcaggaggttgcttcatgtggcacttgggcatttatattccacttggcagggtcaggctgtggcctatctggagccaggtagcttgttaatggaacgcta

SEQ ID NO: 690002 - DNA, 813 bp, Homo sapiens
ctgtgcccacggggatataggagatgcccccccttgtgcgaaattgtgcgcacaccccttgccaaggcggggaaaacattttttccaagggggggcaccccccagttttccaaactcttgggggattagaccctgtgcgatagctcttcttccgcggtttgcagcccccgggtgcgctcgccagtttttattgggtacctatgcggtcgcggcggaaaatccggtgctccgccataatctggcgcccgccgtgacgccctgcagggacgtcatgtgtaccagaacagggcgtttggtcttgttggttcccaaacaaaaacttttaagattatttctctcggcagaatcccactctgagagattttcccggcggaggcacctttaccataggaggaacacagcagatcgcccaccaccggcgtggcccctcaatataaaaggtgtgctgggcaccctctacatgctgcgcctgaaagccacgttctcccacaaagtgtgttttcaatacacgtgagcgtagttcacaatatctctacaaacattggtctccttctccgtcatccaggaccccaacaataggttttgcccccaatccccatctactaacaagatagatggtcccgaacgaggctgacccaccggcgcattagatgttttcaaaagaacaaaacattgcttcaccgaagggttccctcttattaggataactcactgggtgtctatctaatgtcctacaaacccttcccattaggataagactatgaagcaccaccaaagcttctgttccaaacccctgttcccacatcccacagc

SEQ ID NO: 690003 - DNA, 132 bp, Homo sapiens
ggaacccccagccaaaaaggcagctgttggctgttgtcccgcttgtctctgaggacaaatcagtcactgtagcctaaggcagaaatcctggagcagttttgtctgcttcaacccagtccttttcaggttcct

SEQ ID NO: 690004 - DNA, 154 bp, Homo sapiens
tagagataggggtccccctatgttgcccaggttggtcttgaactcctggcctcaagtgatcctcctgccttggcctcctaaagtgctgggattataggtgtgagccaccgcacccagctggatgtagttattgataaaatatcacaccatatat

SEQ ID NO: 690005 - DNA, 121 bp, Homo sapiens
acgcctctgtggggtggcaggtataacggatatattcatttagccttctgagctttctgggcagacttggtgatcttgccatctccagctaggcttacttgctcactgctttgatgacacc

SEQ ID NO: 690006 - DNA, 141 bp, Homo sapiens
  misc_feature (56)..(56): n is a, c, g, or t
cgggtcctgccggaaggcggcgtcgcgacgcagctgttcacgcttaggtgggcgangtgggcgcaggatggcaaaacagaagagaaaagttcctgaagtgacagagaaaaagaacaaaaagctgaagaaggcgtcagcaga

SEQ ID NO: 690007 - DNA, 377 bp, Homo sapiens
acagttcaacaagatgtttaaaatgcttttgtatttactggccatggtaattgaaaactatacttaaggcactattaacttgtaacctttcaacctgaacaatcaagcagtatgagagtttagttatttgtatgtgtcacctagctgtcttacatgaaggctttttaacaactctacacattttctttctcttaaacgaagtactttattacactgttgcaactgcgcaatattaaacaattcagctctaaattatcccccaagcttaattctgatagcttgctaagacacttgtattccaccaattttctgcaacatgggctgtagtttttacctcataaaattaaaaacgtgacacttcagaagtaaacaggtaa

SEQ ID NO: 690008 - DNA, 1742 bp, Homo sapiens
  misc_feature (1)..(1): n is a, c, g, or t
nttttctatataggctgtctggctcacagaagttgatctccagattgcttgatgtgattattgatttggtgccctggagatgctcttttgtggagattctacgaaaggacacatcttgtgtggtagaacactcccccacgtccatattgtttcttgggtgccacaaggccacacaaaacatgagattcctccgtttttttctctcgggcacagttgattgtctcacttgtggtgtgaaatgtccatcatcttacctccctcgggtgatataggactgtttgttgccacccatggagatctcttctcctcctgtttatagacgttgtgtggaaagaataggtccttggagttccccgcccgacgagtggttttatcggtcccccatagttggccccgccccgtgtgccccttctttggttcgactttggaattaaagtgtccgcggctgttggtcgtcatcatctcccccgtgcggcacaaatatattttgggggaaagtgaacatcacacatgatgaagtatgtccgttggggtggttaactttaatggtagaaatgagaccttctcggtgtttgttcccccatcatacatccttcgtggacataagtgtttcgtcaatatgagtatgtattatagggggagacaatcctctgtttaacattggggttgaaaaataggtgtgtgccccgcctgtgtttaatataatagagtacgaggatcatggtatgcccctccacagatgtcataattcgcgttttttcctgtaacagtggtatgatacccccgccttttaatccccctggagttgcctccacacacaccacatgtgttggaagcgccaccgtagatgttgtaagtcctcttatagagctttgtgtctttaatagggtcccacagagaatgttgttttcgatatggtgagagacacccacgggagttgggaaaaaatcccactgttgtgataatactctgggccacaacattgcagctcgcgctctgagttgtgtgttgtgtttgggtggtgccccacagtgtgccgccactacgccctcggagatttgtttttgctctgtctgatagcgcccctgattatgtgatatactctcttgtttcgccctctctcgccgtgaattcctctggggcgcctctgtgtgacaccttggccccagcccacacactgtgggggagacactctctgaaatatgcgctcacgactctgtgtcacaacacacagggggtgttgccacacacactctgtgtctctgtcccacactggtgaatgaagaatatacccacacctgtgagtaggcccaccttgtgatatgaagccacgctcttgtttcacagagacctcccacgtgatataagcctctgagagtgttgtgatgaatatataagctctgagaaataggagatatacgctacgagctctggcgagataatatatgggtgagctctgcctctgtgtgaggcgcactctcttgagaatataattgtaaggcccaagagtgaaggagactaattctgagagaaaattcacctacaccttcttagaggaaatccctctctgtgttctccacgcacaaaccttgggagtgtgaaagcctcccccgggattctgataaaaacctacttctgtcacaaccaccgaacccgaggggtaattttcttttccctcccgaggcaccccttggtaccttataaaaatctgtagctgattaaagattttccccaccaccctc

SEQ ID NO: 690009 - DNA, 393 bp, Homo sapiens
aaccggaccgcctttgcggcagatcctttcatgatccgggaaagaccacattatggggtgaacaaatttaattccaatgtcctctgaataaacatctggcagaaatgctagaggcctcagaagggcaagctccgggttggttcacagaggcttctgctaaggtagagaagaaccttggtctctgcaaagctggagtttatgggttgtgaggtgacagggactttctctgctcagtgtgtggctggctcttgtgttggtggctatatgtgttgttgctcaagaaggtgggtctgtggcatgaatccaactcaagtcagagtaggcaccaaaaaggcacccaggctcagcttccctggctcagcctggaccatcggcaggtcatttcagactaca

SEQ ID NO: 690010 - DNA, 592 bp, Homo sapiens
cactagtcctctctggctgcttatttcatgtgtaatatatttaacttcatctatagtgcattatgagacaaggcaactctgtcacctaggctaaagtgcagtggcgtgaatacagcgcactacagcctcaacatcccgggctcaagcaatcctctcacctccctcctgagtaactgggaccacaggtgcgtaccatcatacctggctaatttttgtatttttagtagagacggggtttctccatgttcatcaggctgctcttgaactcctgacctctggtgatccgcctgcctcggcctcccaaagtgctggaattacaggcacgagccacctcgcctggcctcacatttatttatttatatttatttatttttggagaggaagtgtagcttttgttgcccagactggagtgcagtggtgtcatctctgctcactgcatcgtctgcctcccgggttcaagcgattctcctgcctcagcctcctgagtagctgggattactggcatgagccaccacgtccggctaattttgtataaaaagtagataccaggtttcttcatgttggctaggctggtctcgaactcctggactca

SEQ ID NO: 690011 - DNA, 207 bp, Homo sapiens
gcacgagaaaagatgaacctaggcaacatagatctcatctctacaaaaaaaaaattaactaggcatgatggcttgtgactgtagtcccacctactcaggaggctgaagcagaaggatcccttgagagaccaggagttcaaggcggcagtgtgctgagatctcagtactgcaccccagcgtgggcaacagagtgaccctgtctcaatt

SEQ ID NO: 690012 - DNA, 506 bp, Homo sapiens
ctcttctgtcactcattgtagtccaggatcttctagtttggtgtcagatttatcctgcaaactctaaagaaaaacttttaagataaaagtaaattttaaaaatacatgtttgttgaaatccaagtataagacaggaacaaagataatgtcaattgaagcttgtaattcctagttaaacatagattgcatacgtcaagattctcaagaaattttagatatatttgtcttcattaatggtttcattagaatacaatatacaccctctttagaaatcatttaagtaatagtcatgttcctcaacatttccaagcttccaatagtatttacagtttcctgaatttggggaacacaaactgtgggaaaaaattaaaaggaaccaaatagagagtctatgtgtcattgtcctcttaattactatttcatatgcttaaaatctgtccaaggaggggaaaacagggaactgtgtgactcgtatccctcaaactttgctgtgtgctcacagttat

SEQ ID NO: 690013 - DNA, 627 bp, Homo sapiens
  misc_feature (277)..(277): n is a, c, g, or t
  misc_feature (472)..(472): n is a, c, g, or t
  misc_feature (483)..(483): n is a, c, g, or t
  misc_feature (552)..(552): n is a, c, g, or t
ggcagagaatcgcttgaacccgggaggcggagcttgcagtgagccgagatcgcgccactgcactccagcctgggcaacagagcgagactccatctcagaaaaaaaggaactggagggagggaccctcagacatcctgtccacaaggctgtcaagggggtttctggcctggcattcctccctagatctgacctacgctctccctgcagcattctctgccctctgacagggcctctgctggactgccaggttcccgtgtggtttggtggagaagatttnggggtgggtagagtaagtagttggctctcagggattttgtctaagagaaagtgagatgggagaaatcgggactgaccgggtcgtaactgaaggtaagctgtttgcagcatcccccttcctgggtgcaaattcaggtatcataagtctaacatggaatcggtctgctctcatatgtggcctggagataagggtatnggaggtctctnggcaggaaggcctcattcacatctgaggggtggagagcgcgcaggcagcaggcagttgttcccaggttngtcacaggccaaatggtagctttcatttggcccttgttgcccctgccccctcttcctccattgttagccatgtgc

SEQ ID NO: 690014 - DNA, 601 bp, Homo sapiens
ttctccgagcactaatcgccctacatgtaaaacccattactttgtgaataaatgcacactgcagccctcacgcctaaacaatgccgaagaacgaacaatacaaatttattgagttcctgcaccactcaagcaattttttacaggggggggccacaatcccttgcacctcctggcacccaacatacaccctatattaaggttacaccctacttcaatggatcagtcactgacctaagccttgttgactataacggcaaatatttggcacttatcttctatcctaaggaacgtaccttataataaacaacatgcaaagtacatcctcgcgacaaaactaaccaatttaacgacgctaactgataaacattgccaaacccaagctgtccccaccataggccacatacctctcccacccccccacctttaatgtcccttttgcccacactaacctttaactcaaatcaaccccccccaactcctacctccccctccttcctcgcactcctccaaacgacccataacttcccaaaacaccacactcccttattcacccttcatcaatatataatattatatcattaataaattaacaacacttcac

SEQ ID NO: 690015 - DNA, 932 bp, Homo sapiens
  misc_feature (48)..(48): n is a, c, g, or t
  misc_feature (90)..(90): n is a, c, g, or t
  misc_feature (109)..(109): n is a, c, g, or t
  misc_feature (258)..(258): n is a, c, g, or t
  misc_feature (582)..(582): n is a, c, g, or t
  misc_feature (777)..(777): n is a, c, g, or t
  misc_feature (788)..(788): n is a, c, g, or t
  misc_feature (857)..(857): n is a, c, g, or t
ttttttttaataggggaaaggcatacaagttaatttaataggtatccnccaggacccttcagaatgaagacccaaaggttccgggaaaanttgtcccatttttatgctnaggttcaacaaagtatggaccagctgtgtggaaaatatgattggaaagaaaaggcttatgaatcttaatgcttaaataggctgaagtgggggaaacccagcaagtctgtctgtctagattcttctcagcctctctgagcagcattcctncccttctgggtatgggcaggactctctctggaatgggggtcttacaacctatagtcagacaaggtaggtcaggtgatttcttttcttttttgagatggagtttcactcttgttgccctggctggagtgcaatggctccatctcagaaaaaaaggaactggagggagggaccctcagacatcctgtccacaaggctgtcaagggggtttctggcctggcattcctccctagatctgacctacgctctccctgcagcattctctgccctctgacagggcctctgctggactgccaggttcccgtgtggtttggtggagaagatttnggggtgggtagagtaagtagttggctctcagggattttgtctaagagaaagtgagatgggagaaatcgggactgaccgggtcgtaactgaaggtaagctgtttgcagcatcccccttcctgggtgcaaattcaggtatcataagtctaacatggaatcggtctgctctcatatgtggcctggagataagggtatnggaggtctctnggcaggaaggcctcattcacatctgaggggtggagagcgcgcaggcagcaggcagttgttcccaggttngtcacaggccaaatggtagctttcatttggcccttgttgcccctgccccctcttcctccattgttagccatgtgc

SEQ ID NO: 690016 - DNA, 395 bp, Homo sapiens
tatgttattgttatttttttaaacttaaaaaaagggagagcaagagacagggtcttgctatgctccccaggctggtcgtgcattcctggcctcaagcaatcctccccctcagccccccacaaggctggtattacaggcattagccactgcacccggccttttttaacttttattttagatttagagggtacatgtgcaggtttgtcacctgggtatattgcatgatgctgaggtttgaggtacaaatgatcccattactcaggtaataagcataataaccagtagttagttttctaatccttgctctcctcgttcactcccccaatagtccccagtttctattgttgccatctttatgtccataaattccaaatgtttagccaacctcaacttta

SEQ ID NO: 690017 - DNA, 827 bp, Homo sapiens
  misc_feature (48)..(48): n is a, c, g, or t
  misc_feature (90)..(90): n is a, c, g, or t
  misc_feature (109)..(109): n is a, c, g, or t
  misc_feature (258)..(258): n is a, c, g, or t
  misc_feature (582)..(582): n is a, c, g, or t
  misc_feature (672)..(672): n is a, c, g, or t
  misc_feature (683)..(683): n is a, c, g, or t
  misc_feature (752)..(752): n is a, c, g, or t
ttttttttaataggggaaaggcatacaagttaatttaataggtatccnccaggacccttcagaatgaagacccaaaggttccgggaaaanttgtcccatttttatgctnaggttcaacaaagtatggaccagctgtgtggaaaatatgattggaaagaaaaggcttatgaatcttaatgcttaaataggctgaagtgggggaaacccagcaagtctgtctgtctagattcttctcagcctctctgagcagcattcctncccttctgggtatgggcaggactctctctggaatgggggtcttacaacctatagtcagacaaggtaggtcaggtgatttcttttcttttttgagatggagtttcactcttgttgccctggctggagtgcaatggctccatctcagaaaaaaaggaactggagggagggaccctcagacatcctgtccacaaggctgtcaagggggtttctggcctggcattcctccctagatctgacctacgctctccctgcagcattctctgccctctgacagggcctctgctggactgccaggttcccgtgtggtttggtggagaagatttnggggtgggtagagtaagtagttggctctcagggattttgtctaagatggaatcggtctgctctcatatgtggcctggagataagggtatnggaggtctctnggcaggaaggcctcattcacatctgaggggtggagagcgcgcaggcagcaggcagttgttcccaggttngtcacaggccaaatggtagctttcatttggcccttgttgcccctgccccctcttcctccattgttagccatgtgc

SEQ ID NO: 690018 - DNA, 194 bp, Homo sapiens
agaggatccccgctcactcggcaatcaggtgaccctcctcatcatcctctacactcctggttctcttgccttcggtgactcttctggaaactgcaagtggcaatgtggcaagatcatcgagccaagtgaatatacctgtgtgaattcaggtcagaatacgaaattcattccgtgcggagatattcagtgcattc

SEQ ID NO: 690019 - DNA, 340 bp, Homo sapiens
ttcacacacaaattgttagtatttgaggtactgtatatgttaaccagcttgatttagttattccacattgtacttcataaagttgaaagatcagctttgtatcccataaagtttattataaattatcaatttacaatttcaaaacataagtaggaaggggatttattggctcatagagctaagtctgaggtcaatagtattaaggtgtagctcgatcagatgtcatcagtactctgcgttcctttctattccttcttattcttttttttaaatatttttttttttttaaaggggggacaaaaaaactgggggaccccaaaaaaaaacaacgaagaaaaaa

SEQ ID NO: 690020 - DNA, 125 bp, Homo sapiens
  misc_feature (3)..(3): n is a, c, g, or t
gtnccacatgtataggctggaaacatacttggttcagagtgcttaaggaggcaagcacggtggctcacgcctgttaatcccaacactttggaaggcaaggcaggtggatcacctgaagacagcct

SEQ ID NO: 690021 - DNA, 1022 bp, Homo sapiens
  misc_feature (5)..(5): n is a, c, g, or t
  misc_feature (160)..(160): n is a, c, g, or t
  misc_feature (180)..(180): n is a, c, g, or t
  misc_feature (297)..(297): n is a, c, g, or t
  misc_feature (332)..(332): n is a, c, g, or t
  misc_feature (357)..(357): n is a, c, g, or t
  misc_feature (681)..(681): n is a, c, g, or t
  misc_feature (689)..(689): n is a, c, g, or t
  misc_feature (719)..(719): n is a, c, g, or t
  misc_feature (794)..(794): n is a, c, g, or t
  misc_feature (849)..(849): n is a, c, g, or t
  misc_feature (878)..(878): n is a, c, g, or t
  misc_feature (937)..(937): n is a, c, g, or t
  misc_feature (958)..(958): n is a, c, g, or t
  misc_feature (972)..(972): n is a, c, g, or t
ctggntcgttagctcgatgaagttcgggcccagagcacccggcttgcccagggactgtggggcccacacacacggggagaggccagtaccacctcggggaaccctctggagccttcagccagcggcggcatccgggcagacccatggaatcctaattgtnctttttgcccccggtgaatnaaaaaaaaattttttcaattgcatgggaattttttttttttgtaaacagtctcacccaagccaagggcaagaaagcggaaacccggggtttctccccaagtgaaaaaccagcgaggngcaccgcagcgagccagcctgggacagcagaggcngggcccaccaccgagcggagcggcntccccgcaggcggcagccccatcttcaggcagaagccctggcccccgtggccgggccccccaggaggccactcctttgccccgagcctgtgaaagcctctgaggccgggggcggccgccctggctgccccccctccggccaaacttctgaggccgtggcaaagaaacaaaaaacgactaaaacgctactgagtctgcaacccagggcactgggcccgtgctgctcaaacccggggcccctgagcgaccgcggggcctctccccagccgggggtggatgctgcatgttggccaaggttggctcagatctctgactcccgtctgtngggccgcngctccaggaccccgccgccagcctggagtntgttaaagtcatgcctggcctgggggctgaggccgtcccggcttcggccgttctggtctccgtccgcctcatccncctcgtcacggctcaggaaggccagcgcgttctcgtagcagaaggagttggcgcngggcagcaggaacttgttctctaccaganccttcgcactgcagcggggcgtagagggcacccataggtcttgtggagttcgagttgtnatcttgttctggttctctccncgaagacacgggcncaagcggtgacccacaggatccattggcaggaggagcgcgggcctgggtg

SEQ ID NO: 690022 - DNA, 451 bp, Homo sapiens
cctgcagaaaggctaaataaatttggtgtagtcctataactatatgaaagagaatgaactaagagagagctcaggttaaaacatggataaatctccctaccataatgttgaggaaaaaaacccaaaaaggttataaacatataaaacatacataatttctataaaataatggatgcatatatacaaataatgaaagtataaagacatgcataggaataataaatatcaaattcaggctaatgtttacttttggagaaggaatgggagggaaggagcaagattgaggctgggcatggagagggcttgaattgtatttgtaattaatctggagcaaatatgagaaaatgtttctatcggggtggtagatacacaagtatttatattcatagatatgtagatagactacatatattctctatatatttttgcatgttgaaatatttaagacatt

SEQ ID NO: 690023 - DNA, 168 bp, Homo sapiens
tccttcgcacgctgcaaaaagcctcctgatcacaagtgtttcctacatgttctagtactcacacctcagcactgaactgcagaccacacccatattgagggacaatctagcaaaatatacttggccaaaatctgttaaagaactgtccccgttatgggtgacagccaa

SEQ ID NO: 690024 - DNA, 168 bp, Homo sapiens
agcaagaagagagtgacacaatatcatatgagacgaaaagaaccaccaacttagaatcctgatgcctggcataattatccgttcaaagaccaaagagaaataacaactttgctcagacaaacaaacaattagggctgggcaaggtggttcatgcctgtagtcctaatg

SEQ ID NO: 690025 - DNA, 340 bp, Homo sapiens
gccctggaggcagtggagtaatggatggagaacctgattacgtggcttcttccagaggctggaggatgagctcttctgctacttactatgctgtagcgacaagtacccaggctgctggcttcttgccagtcagcttgggtttgcttgaatgaggcagtcattgtcatgagcgtaagtttagcgagtgcagaaagtccctggacttgagggtggcaggaatatcccccagatatgactcctcaatcctcagctccttacagctaacctacttctgtagaacttctgtttcaggctctcacacactgcaaaagaggcatcggcatcggccagttcctatatg

SEQ ID NO: 690026 - DNA, 102 bp, Homo sapiens
  misc_feature (60)..(60): n is a, c, g, or t
aattatttaccagataaaaaagaaaaaaatagtgattgtttctcttcacccccatcatcntcgtttaccatggtcgagttggagagaaattcattgaacaac

SEQ ID NO: 690027 - DNA, 892 bp, Homo sapiens
  misc_feature (26)..(26): n is a, c, g, or t
  misc_feature (83)..(83): n is a, c, g, or t
  misc_feature (154)..(154): n is a, c, g, or t
  misc_feature (168)..(168): n is a, c, g, or t
  misc_feature (183)..(183): n is a, c, g, or t
  misc_feature (187)..(188): n is a, c, g, or t
  misc_feature (422)..(422): n is a, c, g, or t
  misc_feature (428)..(428): n is a, c, g, or t
  misc_feature (450)..(450): n is a, c, g, or t
  misc_feature (466)..(466): n is a, c, g, or t
  misc_feature (468)..(470): n is a, c, g, or t
  misc_feature (493)..(493): n is a, c, g, or t
  misc_feature (506)..(507): n is a, c, g, or t
  misc_feature (526)..(526): n is a, c, g, or t
  misc_feature (539)..(539): n is a, c, g, or t
  misc_feature (546)..(546): n is a, c, g, or t
  misc_feature (558)..(558): n is a, c, g, or t
  misc_feature (639)..(639): n is a, c, g, or t
  misc_feature (742)..(742): n is a, c, g, or t
  misc_feature (744)..(744): n is a, c, g, or t
  misc_feature (763)..(763): n is a, c, g, or t
  misc_feature (788)..(788): n is a, c, g, or t
  misc_feature (812)..(812): n is a, c, g, or t
  misc_feature (877)..(877): n is a, c, g, or t
tgggcgctgccgagtcttggggcgcncgcagttggcgtctgccagtgctaagactgtgccgcccccacagccgaggcgcgaangggggacgcccggcctctgggtcgctgccttcgctttctctttgttgttgcgatcgccgtccgttcaggangcgccccgcgaccngcgcgatgagtgccntcgnngacctggatgttggaactagaagcattacgctctatttatgaaggagatgtaagtttccgggaattatgtccagtttcttttcaatataggtttaaatatggtgattccaaagctcttcttaatagatatttcctggacagaaacatattcccaaactctctccatttctatttatgaacgctttttttaacatcaccttatcatcagctgtattgctgagtatattagccatnctacangaagcagttgaagctttttttntaaccgctatgtcctntnnnttgtttgaatttgccaaagacanttaagtgcagttnntggagtatcacaatccctntcaattccgcaanatcgctnagcaatatcatntcaattgaaactcctaatacagccccatcaagtaagaaaaaagacaaaaaagaacaactttcaaaagcccagaagcgtaantggacagacaaaacagatcacaaaggagaacttcctcgaggctggaactgggttgatgttgtgaagcatttaagcaaaactggctctaaggatgatgagtagnanttggaatttgagacaaggnaagagcattctttaaagagtaaaantgggttcaaaatctttcattactnttttctggtattgaggcgactttttataaaacacaattttttgtatgtttcttacattaaaaagntgtaagttgaagtca

SEQ ID NO: 690028 - DNA, 570 bp, Homo sapiens
ttgtacagggagggagagaaaaaaagggtcgaggtctaacatatagtagagggttgtaagttacaaacagaggtgaaatccttacggatcaagtggccatgaaaaaccagggacctcatcttgggaaagtcttaatatatgattccaaatatgtgcagggattatacaaaaatttgggaaatatacacaagagtgtcactcagcatcaggccgggtatataaaaggcactaactaaagtgtccagggaataacgtgattatgtgattatcatcccttcactcagccaagcaaggtgggtggtcaccaaaatactcccacccatttatgagagtagtatttttccggagtctagcaggggtgcacttcataccacaggctggggccggtaaatggtcccatcaggagtccaggagtggtgtatggaagggggatccagtcacctgggaccatagatcttagaacggggactacacgggcttaatgcatacggttactgggaagcgctgaaagtatcccgcctcttctggcagtaaccctgtgtaagggtctaatcaatagtagcttctctc

SEQ ID NO: 690029 - DNA, 997 bp, Homo sapiens
  misc_feature (1)..(1): n is a, c, g, or t
  misc_feature (78)..(79): n is a, c, g, or t
  misc_feature (87)..(87): n is a, c, g, or t
  misc_feature (99)..(99): n is a, c, g, or t
  misc_feature (119)..(119): n is a, c, g, or t
  misc_feature (159)..(159): n is a, c, g, or t
  misc_feature (162)..(162): n is a, c, g, or t
  misc_feature (196)..(196): n is a, c, g, or t
  misc_feature (239)..(239): n is a, c, g, or t
  misc_feature (326)..(326): n is a, c, g, or t
  misc_feature (343)..(343): n is a, c, g, or t
  misc_feature (356)..(357): n is a, c, g, or t
  misc_feature (368)..(369): n is a, c, g, or t
  misc_feature (455)..(455): n is a, c, g, or t
  misc_feature (552)..(553): n is a, c, g, or t
  misc_feature (582)..(582): n is a, c, g, or t
  misc_feature (849)..(849): n is a, c, g, or t
  misc_feature (914)..(914): n is a, c, g, or t
  misc_feature (987)..(987): n is a, c, g, or t
ngtgtgtgttaacaaaataaagataaattaggattgttgatggaaatgctttactacagaatagaatacatggcggcnncgtcctanctgactgccgcngtgtcttgtatgtgcaaganctgggtccagcccagatggtagctctttacaaaaacacgnganaaagtgttgcagtttgcacaacagggctgcaccnctggacttcagggtctggtttcaacaatgatgttaaaacagtnagctagattcccagctcggtctgtatacagttcagagctcttttatttattagctagctcaccattcaacttgccatgtgcattgcngaacagtgagaactggngcccacacgaaanngctcagtttcnnccaccgctagccaaagtccttgactgttgaggatatatttcagtcatccaaacctttctcagaaaatgaactcagtttccatcggngcacagcccttattgtttgctaaaagttagtttcgggccttcttcctttttgtctgcgaggtcacgtctttttcttctgcctattgtgccgtttttnncctttttatggcaagtcaattttgtggcnatgtaaaatgcttgctcaactccactgtcattctcagagatttccactgggacgccatgcctctctttatatatatcactatggctaggggccaaactcagcccagtgaaatggattacatatcggagtaacacatatacaatcatatttacacagatacacactcatgccacacacgaaagaaaaaaaaaagggagaaggaacaaattttggaaaacgatgccaaggatgctacactacatgaaactacatgactttttttagcanagtaatttcaggcctctacataatattacatggttatggttcaattattagacagccaggaagtnatcccgagccaaaacaaaggaaggttgtaaagcctcattgtagacaaggcctgagcatccacagagaagatanaatgttttat

SEQ ID NO: 690030 - DNA, 160 bp, Homo sapiens
cttcaggaatgggctgtctttggcctaaccctcagacactggggctggcacaaactcttggtttcttcaacaggcgacttttactgtgtctcttttggttccattgtttggcgaccttcctgggcacagtttggtccgttagacttcccagttgaatttt

SEQ ID NO: 690031 - DNA, 149 bp, Homo sapiens
tctagaggatcgccggagccttaaccctacacacaatctgatatacctacttagtcactttctttttttttttgagatggggtcctgccctgtaattcagaattggagcgcagtggttccatcatggctcactgcagcctcaacctccc

SEQ ID NO: 690032 - DNA, 314 bp, Homo sapiens
gggaagggttagtaggtgatggtggggcatctgatggcgaatatagtctaatagttgaataatggtagcgagatagagattatagatgggaagtgaagcgtgtgtgtccattgtcatgtgtaatctaggtaagacgagttgattctcttgaatgaagtgacagctgtatggattggggattggctgagatttggattttcgctacccagtccccgtccacaggggtcacacactgcatatactccgtggtggtcatgaccaactcgtgatacactatgtaatctggggtgtagcccataccaaagagggagctg

SEQ ID NO: 690033 - DNA, 983 bp, Homo sapiens
ggttgaagaggagagtcacgagacttgctggaggactctccttaaacgtcccaaggaggcagaaaaccctgaaggagagtgagaagagaggcagtccaccttggcagagttcgaggaggtccccttcctatggtaaggtgcgaaaacgaaatacggcaacccttcctcatgtagtcccggcctcatggaccggaggagacctgtccccaagaggacagaaggaacgaggacggatgaaggaaaggagaagagggcatatcaatgtgacaagatgccgtgtagtgccctctatggccaatcagacgaatcattgagacgtccatgttcgtcacaccaagtgtgttccaactgagggaggtcctcctcgatcgcctgtttgcctgactgacatgatgctgtgcgttggcgtaactgagaggaaacaccttgggcacagtggctccgtgtcgaagaccgtgggggagaccctcgcatttaatagcgcaaggtaggcaaaaagcgtgggctatttccttcgtttcacaaatcgacagtgttatagcgcaacaagacgtcacagacggccaggagccaccggagggtggacatagtatacgcatcgcgtgcagaaatggaggagagcaagggccaatgcacatgacatgtacctcgtctagtgcgttagagcgtcaccccgaatacgcatctcattactggactgcttggagactccaggaatcacagtgttcttttccttcccacatggggcatagtggaaggttggaagcgaccaacgtgagttagttcccttatccacgcgatgagacgcatagtattatcccacgggctattactagctcagaggcgccgtagcggacaaactatggatcgcgcaccattccttgagcaccccctattctaccgccacatcctccttaagggcacttgcttaggaaacctcattgggagtccgggaatccatgggggtaaggaaattcggaaaa

SEQ ID NO: 690034 - DNA, 201 bp, Homo sapiens
tggcgaagtaagcagtggctggtgatcgtgatgacagcatgagtctcctggttctcgtctgagctgggctcatgggcctggagtcagccacggctgtgcgcccagtgacttctgctccaatcgagacccttatgttctgaacctgacccaggaggagacaggtcttcagctcagacatcctgaggctataatctcgggggg

SEQ ID NO: 690035 - DNA, 670 bp, Homo sapiens
caaacatgggggttctggtctaatttggcgtactggggcgctgtgtcctttacagcaggtacatggatgagtggttctgctgcactaagtgtcggcctaagttacccagagaccattgtttcgtttcttctcggtaatgtcttgatcattattttcactatggccaactcttaccccggttatgattggaaaatcggtttcaccttggcccaaagattcgtttttggcatttacggttcagccttcggtatcatcattagaattttgatgagtattgtcaattatggttccaacgcttggttgggtggtctttctatcaacatgatattagattcctggtcccaccactatctgcacctgcccaatactttgtccccaagtgttgccatgaccaccaagcagttggtcggcttcattattttccacgtcctcaccgcgctctgctatttcatgaaaccctaccatatgaactaccttttaatttggtcatgtgtagctacttgctttgccatgctgggtatagtgatttacttgactaagaatgcccatggtgtcggagaattgtttacctccactaaatccactgccactggttctaaaagagcatgggcttgggtttatatgatctcttactggttcggttccgtttctccaggttccaccaaccaaa

SEQ ID NO: 690036 - DNA, 164 bp, Homo sapiens
caatgacattgaggactgaggaacagattctcacagccacagtggacactgccaatgtcttctgcagattgacaatgccctgtctggcctgctggatgacttcctgcaccaatgtatgagcacagagttgaaccgtgcgcactgcagtgtggaagcctgacacc

SEQ ID NO: 690037 - DNA, 832 bp, Homo sapiens
gaagtggcggtgcgagggctgctgcacagcgagcggagccgcggtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcatggacgcggccatcgtgggctacaaggactcgccctccgtcttgggccgccgtccccgggaaaacgttcgtcaacatcaccgccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagacgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccataacacacacaaaccattttattttttgggccattaccccataccccttattgctgccaaaaccacatgggctgggggccagggctggatggacagacacctccccctacccatatccctcccgtgtgtggttggaaaacttttgttttttggggttttttttttctgaataaaaaagattctacta

SEQ ID NO: 690038 - DNA, 87 bp, Homo sapiens
ggatttgctggtgcagtacaactaggcttaatagggacatgcagtttataaaaattaaacggaccaaagaatccccacccaaaaaaa

SEQ ID NO: 690039 - DNA, 394 bp, Homo sapiens
accatgttggattgctggtgataatgtaaaatggttcaggcactatggaaaaaaacagttcggtgattcctcaaaaagttaaacttggaattactatatgacccagcaattctgctcctgggtatatacccaaaagaattgaaaacagacattcaaacagatacttccacaccagtctttatagcagcagtatttgcactagctagaaggtggaaacatctcaagaactccagtgtccattaatggatgaatggataaataaatgtcatatatacatgcattggaacattattcggccataaaaataagtgaagttttgatacatgttggaacacggatgaaccttaaaaacaacaacttaatatgactagcttacccaatagcttttatagta

SEQ ID NO: 690040 - DNA, 1320 bp, Homo sapiens
  misc_feature (852)..(852): n is a, c, g, or t
  misc_feature (862)..(862): n is a, c, g, or t
  misc_feature (878)..(878): n is a, c, g, or t
  misc_feature (883)..(883): n is a, c, g, or t
  misc_feature (885)..(886): n is a, c, g, or t
  misc_feature (889)..(889): n is a, c, g, or t
  misc_feature (899)..(899): n is a, c, g, or t
  misc_feature (905)..(905): n is a, c, g, or t
  misc_feature (911)..(911): n is a, c, g, or t
  misc_feature (929)..(929): n is a, c, g, or t
  misc_feature (945)..(945): n is a, c, g, or t
  misc_feature (949)..(949): n is a, c, g, or t
  misc_feature (961)..(962): n is a, c, g, or t
  misc_feature (977)..(977): n is a, c, g, or t
  misc_feature (981)..(981): n is a, c, g, or t
  misc_feature (993)..(994): n is a, c, g, or t
  misc_feature (1007)..(1007): n is a, c, g, or t
  misc_feature (1011)..(1012): n is a, c, g, or t
  misc_feature (1019)..(1019): n is a, c, g, or t
  misc_feature (1090)..(1090): n is a, c, g, or t
  misc_feature (1101)..(1101): n is a, c, g, or t
ccctcttgtatgtgttgtctcctcactgcctcccccccacagtgttttcgctgatagcgcctcccactattgggccgccccgtgtggtttggtgttaatccgtccctgcgttttactactgtcttggtcctaacacacccgtctttctatattgggcgcggtgtaccctcggggaggaaccctctttgttgtgtctcatagggatcacctgcttggggccacccacttatgctacgtttggggggccggtttacttccaacaaaagaggatagctgttctctcgcccctacatcttcctccagcgatgtattttggtggggccctctcagctctcgtcgggttgcgtccacccccccgggggggggattataactctcgctgctgttttgtgtgtggtcctgtcagttaccaacattgttctaacacacgcgcagcacacatggacgttttccagtatgtgtgtatgtggtggttggtgttactactactttgggtttttggtcgccccacaatatgagggcttctccggcgttctaaaacacgagtgttttttattaaaacgcggtgtgagaaaattggggcctgtggtacacacacctcttgtgggggggcgcccacacagaaaagattttgtttttcgccgcgtggagtattcccgccgggagaacatctcaccacttgtgtcttgcagcacggcgtattattgtgggcgtagataatgttcttatagcctcagcatcggggagatatccttttgccgggtatatccccaccttaggaggcgcacccccgcgggtgggggcccactcccaacacgcgctgtccacaatggtgtcacacctgggttcacncccacagagncctgacacacacaganacgcncnntanattctcctgngcgtgngagtgnggccacacagaagagggngtgtgcccacacgcgntggngtgttgagtttnncacacacacgagaanatgnttatatgagaanngggccttcccacncctnntcggcgntgttcccacgtgttctggagctctctctgtgtctgtgtgcgcctcttcccgctcttcccccgcgtctcccncacacagcttntgcaccccctttcctccccactatcacacccccaaccacttttaattttttgggccacttatccccatatccccttatttgctgcccaaaccacacacatgggctgggggccagggctggatggacagacacctccccctacccatatccctcccgtgtgtggttggaaaacttttgttttttggggttttttttttctgaataaaaaagattctacta

SEQ ID NO: 690041 - DNA, 121 bp, Homo sapiens
ggatttgctggtgcagtacaactaggcttaatagggacatgcagtgtttcatttaatcctgccagcagccctgcaagggcaatactcttgttatttttgctcgaattcgagtcgaattcaa

SEQ ID NO: 690042 - DNA, 439 bp, Homo sapiens
gaagtggcggtgcgagggctgctgcacagcgagcggagccgcggtccggacggcagcgcgtgccccgagctctccgcctccccccgcccgccagccgaggcagctcgagctgctcggtggggcggggggaggggcagagaggcgagaggccagtaagccactgcgcctggttggaacgcctacagtcgacaacacatcatgcgcggaccggagagctgtcagagaccgcggcacaatcgtggggctacaatggaagtcgcccttccgcacgatggagcccgtccggtcccgcgtgtaaaaacagtccgatcacacaatcaacagcacaagcatggatagatggagatgatccatcggatggcgcaaaggaccctgagtcaaagtatcacacgtgaattggggcatgacacattggggaccacgaaatgtacgggtgaac

SEQ ID NO: 690043 - DNA, 872 bp, Homo sapiens
gaagtggcggtgcgagggctgctgcacagcgagcggagccgcggtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcatggacgcggccatcgtgggctacaaggactcgccctccgtcttgggccgccgtccccgggaaaacgttcgtcaacatcaccgccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagacgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccataacacacacaaaccattttattttttgggccattaccccataccccttattgctgccaaaaccacatgggctgggggccagggctggatggacagacacctccccctacccatatccctcccgtgtgtggttggaaaacttttgttttttggggttttttttttctgaataaaaaagattctactaaaaaagtcgacgcgcccgcgaatttagtagtagtaggcgg

SEQ ID NO: 690044 - DNA, 500 bp, Homo sapiens
  misc_feature (23)..(23): n is a, c, g, or t
  misc_feature (140)..(140): n is a, c, g, or t
  misc_feature (142)..(142): n is a, c, g, or t
  misc_feature (164)..(164): n is a, c, g, or t
  misc_feature (187)..(187): n is a, c, g, or t
  misc_feature (201)..(201): n is a, c, g, or t
  misc_feature (203)..(203): n is a, c, g, or t
  misc_feature (211)..(211): n is a, c, g, or t
  misc_feature (229)..(229): n is a, c, g, or t
  misc_feature (251)..(251): n is a, c, g, or t
  misc_feature (254)..(254): n is a, c, g, or t
  misc_feature (269)..(269): n is a, c, g, or t
  misc_feature (272)..(272): n is a, c, g, or t
  misc_feature (276)..(276): n is a, c, g, or t
  misc_feature (279)..(279): n is a, c, g, or t
  misc_feature (281)..(281): n is a, c, g, or t
  misc_feature (284)..(284): n is a, c, g, or t
  misc_feature (286)..(286): n is a, c, g, or t
  misc_feature (293)..(293): n is a, c, g, or t
  misc_feature (311)..(311): n is a, c, g, or t
  misc_feature (327)..(327): n is a, c, g, or t
  misc_feature (329)..(329): n is a, c, g, or t
  misc_feature (336)..(336): n is a, c, g, or t
  misc_feature (366)..(366): n is a, c, g, or t
  misc_feature (433)..(433): n is a, c, g, or t
  misc_feature (446)..(446): n is a, c, g, or t
  misc_feature (448)..(448): n is a, c, g, or t
  misc_feature (467)..(467): n is a, c, g, or t
  misc_feature (471)..(471): n is a, c, g, or t
  misc_feature (488)..(488): n is a, c, g, or t
actaaaacattacgaacatttanagtcaaatatgagtgctttgaaagaccacttaactcaaagggccatgcttttgtccaatagtgaagtgcagtctagtcactttagaaagccattttctaggcaaaagctgtcaaaancnctaagtagctaatgcctgtggnccgtattgttgcttttatgtttncttaaatatgtttncnaataatanctgtaactgagatgtgcnccagttttctgtgaatgatagncanggatgttttttttantantatnatnantgntncagaacncagatctttatttttttncagcattattgtttgngnctgattncagtattgatttagaagtatattttttaanaattgtttttcttttactattttaagtattttcgaatgttattgcaagatgtaaaatatacatttgngtttgaaaaacgngncaatttttgggaaagttgngcancaataaatcttgtaatnttgtaaaaaaaa

SEQ ID NO: 690045 - DNA, 405 bp, Homo sapiens
  misc_feature (5)..(5): n is a, c, g, or t
  misc_feature (391)..(391): n is a, c, g, or t
aaaanaagcagggattatgtattctacctcatacttctgcacaacaaagaaacaaactaatataataagggttataatataaatacgagcatttcgttgaaaatctttagatcaggccaaagcaattcctatgaaaaaaatgcatgtaaatgttcataataataaagacgatggtaatagaaattgcagctactgtttcctgaggacttgttcagtgttttaggtctgtctcatttaacttacaacactccagtagagagattctatccaggagagaggatttgctggagatactgaaattaagagaaataaagtgacatttttctgggttacctagctgttaggtggcaaagctacaattcacccctccctgtagctttggaggttgggnatttatggttaatc

SEQ ID NO: 690046 - DNA, 801 bp, Homo sapiens
gaagtggcggtgcgagggctgctgcacagcgagcggagccgcggtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcatggacgcggccatcgtgggctacaaggactcgccctccgtcttgggccgccgtccccgggaaaacgttcgtcaacatcaccgccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagacgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccataacacacacaaaccattttattttttgggccattaccccataccccttattgctgccaaaaccacatgggctgggggccagggctggatggacagacaagctttcctacctcatagacgtaccgtgtatgcctcggaataagggcgcaggttcga

SEQ ID NO: 690047 - DNA, 116 bp, Homo sapiens
gccactgcaagatattttcacaatgtctctaataaatctgcccttcttaacctacaactatctaggtaaatggctttaccacctgcaaaactgaccctaagtggttgctacccaca

SEQ ID NO: 690048 - DNA, 704 bp, Homo sapiens
  misc_feature (642)..(642): n is a, c, g, or t
gaagtggcggtgcgagggctgctgcacagcgagcggagccgcggtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcatggacgcggccatcgtgggctacaaggactcgccctccgtcttgggccgccgtccccgggaaaacgttcgtcaacatcaccgccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagacgctagtcctgctgatgggcaaagaaggtgtccacggtggtttgatcaacaagaaatgttatgaaatggcctcccaccttcggcgttcccagtactgacctcgtctgtcccttccccttcaccgctcccaagagcgctgcatcccctttcacnccgataacacacacaaaccaggtctaacaataagggccattagcgccaatagccccttatta

SEQ ID NO: 690049 - DNA, 910 bp, Homo sapiens
  misc_feature (645)..(645): n is a, c, g, or t
  misc_feature (827)..(827): n is a, c, g, or t
ggtccaggtgagagcggagggtgccagaggtagggggccgagaaacaaagttcccggggcgtggtccggggccgggtcggggctagcgcgtatgacggaccccatcctcgcgaaggcgaaggcttccaaactccagcggcgcggtcatcctcgggccgtgccggtctcggggcgaagggcgaccgtgagccagaggatcgcccagaacttggtcgtccagcatcgtctccaggcggagcgacttcttgcgggagatacatcaaggccagcacacgaaggtggtgagatggcagaagcaggatatagagaatagtctttgggttccagagcgcatgtgatcacacgcctaatgatgtccgaggtaggagaacaggcgttggccaggcactgggctccttgatggttattcctgagggacattaggatcaaggccgaagactcctgggactaaagatcgtgtgaagttggatctacgtgatcagattatgacatattccatcttgaagacagcttaatagatcgatctcgagtgcgccagttgcgattcaaccctcactagcggacagggtactataacgctgtgtacttcaattccgagctcatggtacaatggatatgggatgatcgtcacctgagtgaagccgnttgagctccaggcaggaggcatgataaaccccggaagcaagttgcgtgccaggcctaagacaggtatcaaagagcgtggcaaaagccgagtcagttgaacttgagtacaaagaggccggagggagtgcatccagcaaatgttgccggacagggacgacgaacaacaatctggcccgtacgtntgacgcgcttgtctcatacaagatcaccacctattcagtccaaagaagcatattgaccctggccaatgggcagaacctggaag

SEQ ID NO: 690050 - DNA, 730 bp, Homo sapiens
gccctcctccacctctccgccccctccgggcttggctctcccaggaggctacgactggagccactggtcccgcaggatccccgcgtcctcggtcgccgcgtccacgtccctctcgcgtccccgcccggcgccacgccgctcctctggtcggctccggcgggcaggcagctcagccggggacagccgattaatccttctgcaaggtaacgaactatcttgtccgtgtgacatggcacagacttgagtatggagggctaggcggaagtcagtcgagcaatcaaggcttatgtcacaaatcccccgtgatgcaggaagctgtgatgtcatcaagatatattggtggcagtgcccaataccagatatatagctgacatgatctcaggaaatggatacacaacatgtccagacttcttgtagggcaagagcctgggacccctctggcgactggtctatctccctgagggctgaaaacaagaatgccaagatcgtagagagatcaggcatcttgagttctgaaacaacagtgtcatgccaaaatggcacggggatctgcgggggactgtgccacatgatgagatactcagatcggcagggccgcttgctcgcagatctgaacttacacttaagacccactttgtctttcgcgaacctgagggatccccccagacatctgcgaccaactgccgacctgcagtgatatccttaccattctggcaacaggtccggccca

SEQ ID NO: 690051 - DNA, 872 bp, Homo sapiens
tacaatctaccctcagaatgcgccaattaacggacttcagtacgaggctggatgaatccacacaggatcatgaaccgttagtgtggagccttcgcccaaagtgtcagacacagtggttggagccctacaacgccaccctctcatccaccagctcgtataaaacacagacagacctactgcattgataacgaagctctactacgacatttgcttcagaaccctaaagctgaccacgcccacctataagtcgacctagaaccacctggtagtactaggctaccatagagtggaggtcaccacctgacctgcagctatgaccaggccagctcaatagctagacctagcgaaaataggctagagaacatggtacacagtatataccccggcatagcactaactatacatagcccggacatttgcacccactagaccagccggggcagccagcagtaccagggcgctaggacacgtcagcccgagactgcacgccaggaagatagataaagatagcacaagaacatagataggctagcctagcagaacacccgacacaatggaccgactacacatgaacggtatgccagcgagctatcagaggagacagcatagtccatagaaggacggcggatgagcgaaagtgcttaactgtcgcaaaacaaaaaacagcagactaattggtgtcgcagaaggataccccaaagaatgagaaacaacgggtgtctaggtgaaataccaccctacggaggggttaacgatgtcacgcacacttcattgaggagcagcaacggcagaccaggaggtgtgcgaggcgcaacacgaaaaagcacaaaagcaagaacggaggcaagagcacagacagataggggaaaggc

SEQ ID NO: 690052 - DNA, 129 bp, Homo sapiens
aggtcagagtgggggctgcatgtccagccaggcagcaccgagtctacaaagatgctattagatctgatccgcaggcaaaggatctatggatatggaaatagcaggaattggtgagaatccatatctcag

SEQ ID NO: 690053 - DNA, 258 bp, Homo sapiens
  misc_feature (50)..(50): n is a, c, g, or t
cctgagagcttcgatacacaccgaactggtgcgggggggggatgccgtgnccagctgtccgcccattgagtgacaacgcagacggcgtgcctccgcaactgcgcaccgacctgttgaagctgcatcaactggcgatgaggtgatccaggtgcggattcgagagcacgtcatcgccaccaatgacatgcgtctgttcggtctgcacctactggggcaggcgtcgctgcgcatggagcaagcgctgtggccagaagaata

SEQ ID NO: 690054 - DNA, 309 bp, Homo sapiens
ctggagagcgcacagctcccatcatgcttgactgattacctaactgcacatcgcctctatagttgtagctgcagactcaggttgctgaagtacggtggatctccttcaagactatgtacggagatcagggcattggccctgtgatgtcttacaaactagggaatgtagatgtatctgccattttaactcttttaatttttctgggcttacttagtcagctcacctatgaaactagcttgtaaaatttgacattaggaactatattctagttttatcaatttgtaggatagctttatttgttatatgttt

SEQ ID NO: 690055 - DNA, 374 bp, Homo sapiens
ctttgatgaatatagactgagtagggcaaggatactatgtgatcagtgatacctctgtggtacgagcaagggtggtatgtgagtattagtctacagattatggcaaatacagtgacaacaatcaactggtctcagattgacagtagcacagatatactcagtgaaggtaatgttcaggacaaatttcaagaaaactagaaaaccattctttacagctgaaatctttccctacccattgttatttccacttataagtcctcaaagagatgagaaaagggcggtaaggctaccttatacatttcctgcacaatgaaacataatacctcctccaggcaaagattcaagcagaactggcaaatatcttatcttgctct

SEQ ID NO: 690056 - DNA, 172 bp, Homo sapiens
aacgagcacacacacgcaggcacacactcccacgcaaaaacaaagcttttacaataatacaagcagtctacaacaaacacaaaactcagaaattattacaatgcttcctttcttaatacaaaagatgcccatcttggagtctatatacaatatatattttcagatggtttac

SEQ ID NO: 690057 - DNA, 250 bp, Homo sapiens
ttttttttttaaaaacctgaaacctgtaaactgagaagtctggagcctttttgcccctctgtaggggatgtgaagatttcaaaacctgagagccccttttttttgtttaaaattatgagaaaggccctaaatggctttagggtttgcctttttccccttaatgccccctttcttgggaccccctggtggggagggaaatctgttttttttttccccccaataaaaaggtaagatttttttttgcccctga

SEQ ID NO: 690058 - DNA, 476 bp, Homo sapiens
aaagtctggtgcctgctctgctgtgttttaaaaatctgactgttgcttatgaagaatggattagattcagatgaaaccagtgggataccgatgcagtctttacatcccagtgactcacacacagcttcttcccatcttagggctttcgtgctgtttcctttgcttggaatctaaacaatgtgtggtgctggccaggtgcgttggctcacacctgtaatcccagcactttcggaggccgaggcgagtggatcagctgaggtcaggagttcaagaccagcctggctaacacggtgaaacctcatctctactaaaacaaaaattagccgggtgtggtggcacacacctgtaatcccagctactcgggaggctgaggcaggagaattgcttgaacccgggaggcagaggttgcaatgagctgagatcatgccactgcactccagcctgggtgacagagcaagactctgtctcaaaaaaag

SEQ ID NO: 690059 - DNA, 194 bp, Homo sapiens
tcaccatgtggaggtggtcccggaatctcttgatctcaactgatccacccacctcggcctcccaaagtgccaggaccacaagtgtaataagccactgtgcctagccgcaaaattatcttttaattaaaaaaataggccaggcacacgtgcacgcctgcaatctcagcactttgggaggccgaggcgggcagatc

SEQ ID NO: 690060 - DNA, 309 bp, Homo sapiens
caccccaccccccaccccctggtttccctcactgcccaggttgatcaagtggctttttctggggcccggccagctttgagaattttttttcatccaccctttggcacccagccttttagggaaggagggatggggcatagtgggagaccccccccaaagcttagggtaagggcaggtaggggggaggctgtggaccttttcggaaagttttgggtttgtttttttttaaccgggcaaaattggggtcaggtccagctgtgaagaaaaaaatatatcaatgttttcccataaaaaacaggggctccctga

SEQ ID NO: 690061 - DNA, 661 bp, Homo sapiens
  misc_feature (608)..(608): n is a, c, g, or t
  misc_feature (629)..(629): n is a, c, g, or t
cagaaaatatctacaaatcacatatctaattaacatccagaatatataaagaactccaacaattcaacaatagcaacaaaacaatctaattcgaaaatgggccaaagacttcaacggacatttttccaaagatataaaaatggtcaacatgaaaagatactcaacatcactagctattagagaaatgcaaatcaaaacaataagacaccgctccacgcccattaggatagctattatttgaaaaaggaaagtaactgttggcaaggatgtggagaaattggaacctttgtccactgtcagtgggactggagaacagtaaagtcactgtggaaaacagtttggcaatttctcaaaaatttaagcacagaattactatatgatccagcagtttcacttcttagtaaatatccgaaagaactgaaagcagggactcccatatctacatgtacgccaattttcatagcagcattgtttacagtagccaaaggtagaaacatcccaagtgcccattaacagatgaatgaacaaaatgtggtatatatgcacaatggaatattactcagtctcgaaaaggaatggaattctgatgcacaagccttgaaaatatnctaaatacccaaactccaaanggacatattttatgatttcacttacttgagcc

SEQ ID NO: 690062 - DNA, 1964 bp, Homo sapiens
gcatccgttcttcatttattatctatgacttatttgtgatatatctatagcactgtcttacagtgttggcgagtcgttatttctctcttatacttatgtatctttctattattgcttttgttatctgtgctcttgatgctgacgtgctgcggatatggtggtctctgaattatgatgtgttcttctggctgatgtattattattttgttgttttatctattctgatctcctacatccaactgcttcggttatgatgtcgcatttatcatttgattattggttggttgagactttcatcactgatgtgcttgcacatgtagttttcacaaccttcatcgttgtttcttctctatgtttattttattagtttagtttgttttctctccatttgtatagtacttcctgagggtgtggtttgttctccgtgttcatacgtactttgtgttattatggtttttttctctatgtactttcttttgttgtgtgttggtgtgttggtttatctttttagtggtgctcttattgttgtgttttaggtgttgttattagaactgtatgttttgctgtgttggcgtttgtcgtttggttattgtcttcagtggtgtggtgtgttgttatgttgtttggttgtgttttgtgttgtggagcccatctcgcttcttttgtttttgttatattgccggctgtcttttccactatgtgtgtgttaaacaatcttattcgtctctcctttttggtggtggtttgtattagtacactcctatagctgtcgtttgttttttggtgttctccctcacttttgtattgtgtatctctgctcgtgttagggtgtcgtctcttcacccatgtgtggttgtgctctcacatatttactgcgcgcgtggttgtgttgttgttaatcatcctcctgcgcgcacgcgcggggtggtgtattgtttacagcgctgctcgtctctctatgatttgtggttgtttcgctgaggaggtcatcgcgctggtgggggtgcccgagtaatattattggctgcgccgcccctatgtgtggggtgctctcccagctctggttgttcgcccccagctcactcgtccgtcgctgcggctagtagagagatgagaggctgctgcgcacgcggcgcgtgctacgtctatatgagatagatattagatgtgtgatttatctcattgcgcgcgcacctcgtggcgccatcagtctctcttctctctcctcgcgcgcacacatacgcgcgcgcgggtgtcgtcgagagagagagagatcatctctcactctctatattctctccctccactcgcgttagatagagcctctcggctcgctccttcttcacatatattacgcgcgcgctgcgtggtttctctctctgctctcctcgtctttgtttgatagaacacacatgatatctctactagagagagagcgccccaaccgatagagagagtgtatttgctctctctctctctctacctccgcaccacagagagagagagagagagagagagaagaattatagataagagatagcatactatatattgatgtctctctctctagagaggtgttgctctctccactcgtggagacacacagacagatacataattatgttagataaaatatctctctccccactctatgagagaatatataatttatataatatgttgtgatatttcgcgccaacgctccgtgtccaccactctctcgcggtgtcctcctccaccccacacacctctgtggtgagataatttgcatcaaaccctcgcgcgggagcccttttgtgtttttttttttgttgttccggctgtttttttctcaataatttgggggggcacccacccacaaaatataataatataataataataaaataataaaatatataataataaataatataaataaaaaaaacatcgagcatctaactcggtcgaaagagtatgtctcc

SEQ ID NO: 690063 - DNA, 673 bp, Homo sapiens
  misc_feature (96)..(96): n is a, c, g, or t
  misc_feature (578)..(578): n is a, c, g, or t
  misc_feature (587)..(587): n is a, c, g, or t
cggatcggttgcagtcctggtagctggggtgcaaaagccacatttcccaatatgtggaagtatttctgtatcaacaaatgccagtcaccgtgggtntgtatgcagtctatacaagtcctgacagctccacaccaagacatattactggaaggtctccatgagagttgaggcagtcagagcataaagacagaaccacacttaccaccccagacgaggcactcactgcatgccaggcaccaggacacacatgtcatggacattatttagtgttatccccataaatgcccatgagatgggggctgttattcgcattttgcagataaggaggctgatgtttaacatgactaagggcttgtccaaggttctacagctagcaaagtagcaaagttgggattctaacccaggtttgcctgatttcaaaacctaagctctcttcacttgcccagacggaggcagaggagctcccagctgtattccatctttgctgagaaagcatgaaggagatgctgtgaacctggcacaggcacacaaggtcaagccacagggatcggtgaaacagcagtgaggccaggtggtanagatgtacncctcgtcctccgaccagcctcaccgcagtgccaacagatgacagtctaagtacagtaagaccacttttggctcaggtcaaaagctt

SEQ ID NO: 690064 - DNA, 398 bp, Homo sapiens
cagctctttgggaatcttttggcatccagggcttgcagatgatcttctctaatgtcatcattcttggctctctgccctctcactggctctccacgtctgcctcattcttcttcctgctcttgctctacagctgttcagctgctgctgcatccactgttgagcagccaactgccttgagtgacttgatggccctgctgtccctgctgttggggtcctatggctctaaccccaccaccaccattttgctcttgctaagtctcctttctctgtgttgttctagcgcagttctcaatactaaaggtcatcaagaaaaggccactcaagacaattttctctcattgggatataatttcctcttctactttttatagtattgtggtattagtcctgtcgacgcg

SEQ ID NO: 690065 - DNA, 472 bp, Homo sapiens
  misc_feature (287)..(287): n is a, c, g, or t
  misc_feature (294)..(294): n is a, c, g, or t
  misc_feature (333)..(333): n is a, c, g, or t
  misc_feature (365)..(365): n is a, c, g, or t
  misc_feature (383)..(383): n is a, c, g, or t
  misc_feature (414)..(414): n is a, c, g, or t
  misc_feature (444)..(444): n is a, c, g, or t
  misc_feature (452)..(452): n is a, c, g, or t
tgagatggagtcttactctgtcacccaggctggagtgcagtggcgtgatcttggctcactgcaacctccacctcccgggttcaagcaattctcctgcctcagcctcctgagcagctgggactacaggcgcctgcatcatgcctggctaatttttgtatttttagtagagacggggtttcaacatattggccagggctggtctcaaactcctaaccttgcgattcgcccgccttggcctcccaaagtgctggggattccagggcgtgacaacccgcggcccggccagnaatcgantttatatttaaatagttcataaagaaggcacttacattncattctcactttactttctattaagggcgggntaatacgggagtaagggnttttttaaagtcactggaaacatacaggaanttaaatgtagggatcccactcttctttgtnataaaacnggttatataatttatttaat

SEQ ID NO: 690066 - DNA, 311 bp, Homo sapiens
  misc_feature (70)..(70): n is a, c, g, or t
  misc_feature (72)..(74): n is a, c, g, or t
ttctagccatgtatttatttttactctgcatgacctggatgcacacagctgcctcgtatttgcatagacntnnncccccccccccccagttacccaggtattcctcgggatggtgtataaactggaatatgtatgaaatgtcagtaaaattcactttgctttcaatgtatatatacaaaaaacaacaactacatctagaaacacagtaacaaagcaggcagacgagccccaccaacatcaatccggaaggggtctcctataatgctacggggcccctttccatctcctgactaatcccttaactggttact

SEQ ID NO: 690067 - DNA, 890 bp, Homo sapiens
gccagagtcctcagtctcacccgtgaagtgtccgctagacccttcgtgacccagccctgctgaccagccacgtctctcatgtctcttaccctgtgcctggcagacgtgatgtgcggtacatctctagaatagacaggatgtatttcacacatgctgtctccctgaccccgtggaaactcccttcgactcccctgtaagcgtgctcatccattgagggatcaacacagatagcacgttccatccaggaagaccccctcccattcctttgttgctttctttagtcgtctatcaatcaattacccactggccagtgatagtgactatctagatgtgtatctgctccatctcggcactgtgagcagcttaatggcaggggtcagtgtaaatttgtttcttgtacccatcatctgacacgaagcgtggggctcaacagatgtcgtacgaccagagacaacggaagggaagggaccctggggagggtggcgagggggccccgaggagtgggagcacgactagacggacagatgcgaatcttaagatccaccatgtggattttatctctaccaagccaaaagctgtctggggatggcccggagcccccagggtggcaaggtacccatcgggagaaggtgagaccaggggcagtggtgccccacctgggctgaaagaaagtgcagaaggaggaagatgaccatctggccacgggcctggcgtacatgcacattgagggatccctccgggaccggcatggatcaacctctaaaaacttggatttcaggaaatccctgagcaccaaacaactacccgagggtgctaaacaaagcacgaatagcccgccccccacaccaacaacccatcaggcccagacccgtcaggcccgcagaaacccg

SEQ ID NO: 690068 - DNA, 291 bp, Homo sapiens
  misc_feature (116)..(116): n is a, c, g, or t
  misc_feature (289)..(289): n is a, c, g, or t
cacctaatcaccctcctccactcccacacatcagactggtggtgctcctgggcacaggtgggcacctgctggaaaagttttcagtgtgcttcttctgagacttgcccatgaggcgntggcaggaatgggggccatggatcctggcaaggatatattcctaaactgtccttgatggtgtaggtccctcctccttttctctgtggcattttgctttgtccatttgatgccatatctttacagatgggtttcagcaagatattctcaaagcatttcaagcaggaatgagccnct

SEQ ID NO: 690069 - DNA, 129 bp, Homo sapiens
tctagcaggatcttaaaggcaagtagaagaggtggtggccaacttaagtgctgtatcctggaggaggtccgggtcagcacagggcaaggtaggtagctagctgcctgacccctagtctggggtgctgtc

SEQ ID NO: 690070 - DNA, 385 bp, Homo sapiens
tgtcgtttacaggggggtatcacggtcgaacgttattgacgatgtcgctgacaagcaaagtcatgccatataaaaaaggatttggtccgtttgctcctgaagtgtataaatttccgtatccatactattaccgtgcaaacgagcaaactatagatgaagtagataaccaactcattgaatcattgaaacagtttttcgttgcggaagtagcccctgatcacggtagcagcaatcaaaattgaaccagtacaaggagaagggggatttgtccgttccgtcggcgaaatttatgcaagccgattccgtcgcatttgtgatgaatacggcatcgtccatgattgctgatgaaattcaaacaggttttgcgcgaacaggacgcctgttt

SEQ ID NO: 690071 - DNA, 170 bp, Homo sapiens
agtcacatgaggcagtctgctctgtcaccacgctgggtgcagtgctgtgatcttggcactcaactgatcctctcacctcagcctctcaagtagggggacctcaggtgtgcgctaccatgccctgcctggctaatttttttttttttttttaaaaaaacggtcttgctatg

SEQ ID NO: 690072 - DNA, 186 bp, Homo sapiens
agcggacggagtaggttctcgaggcggggcagcgagcggcggcggctccggggctcctcctcctccttggtggcggcggcggccgggacgagaccggcccggctcccctctccggcacccgcgcgcccaacccggcgccgggaacatgggtcggtccggaggcgggagtgagtgacccccgtagaa

SEQ ID NO: 690073 - DNA, 103 bp, Homo sapiens
gcttctgagtaccagtatgttgtatagcattacatggaaaatgagaagacaatttctgttgtgcatcaaccatggtgtatcatcacaggcttacgttcagcga

SEQ ID NO: 690074 - DNA, 135 bp, Homo sapiens
aaggatccccaagcacgtactacattactcagtgaacttgaaataggtccagaagtgaacacttagggtgcatttaccttactcctgaagatgggaagacacacggatgcttgccttaaaatatctgcctgagag

SEQ ID NO: 690075 - DNA, 550 bp, Homo sapiens
  misc_feature (208)..(208): n is a, c, g, or t
  misc_feature (269)..(269): n is a, c, g, or t
  misc_feature (336)..(336): n is a, c, g, or t
  misc_feature (358)..(358): n is a, c, g, or t
cacctgaaaagggattctaggaaacaagcaggacgaagcagccctgtaacacttcagaaaagaagaatgaagatggtgcgggaatgaagaaaaacacagctggctgggcctgtacccaacaaaggagcatttacagaacaaaccaatgtagaggaaaagttgtgttctgcagagaaaaactcgtgtgttcagcagagtgccaatttanaagttgcacaaaactcaccatcagtagaaaacatacagacttctcaagcagaacaagcaanaacccttacaggaggatattttatgcaaaatattaaactgtgcacccatttgaagagatagcagacngcattctttgagcgaccacgcncatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccaaaaaaaa

SEQ ID NO: 690076 - DNA, 1040 bp, Homo sapiens
gagcgcacgagtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaa

SEQ ID NO: 690077 - DNA, 1242 bp, Homo sapiens
ccggccccttcagtaccgcctcctacactagaccatggtgtctcagacataatgggtgacttcaataaccacccagcagtgccactcgtgaagcccgcatgattctcgacccagcatcatttgaatggctattgttatccatgtgaaggatgcgagaaccatttccgcggtgggttagttgcgtccagatttcacttgcacaggcagtcttgcagcatagccgactataccagcacttgtgctctgtgcctgcaccatggggctctcgaccttgcagcacatccagatccaaggctgggcccctctctgcgcgccagtcgcgcaccaagcccgccaatcctagtctggcaggtctcagcatcacgggcacagggccgcacatcgtccactggacagctgccagcagctcagctggctaggagcacaggtaacgcgccccaccggccgagccaggcccacggattatcacaggatagggcccgtccgatcaaaacgcacgcgagctctacatgggcccatccagcaacattggacgcctttttgaccggccgttaacacggaagggggataaccaacacttgcatggactgcccctaggattaccgcatcccatgttccaatagattttaccccaggcgcgccgtgggcaccacgggcaaaggcggaacacccaagacccagcacaccgtcgggacacacacagcccacgcgcaatagtcacaccaaacacagcggcaaacaagacggccccccaaagaaggcgcactaaacagcttgcgaccgcattcccagaccaccgggacatacaacctgggccacaagtggaggcacggacagtgagtgaaaacacgcccacacccgtgacccccgggcccaaaggcgcacgactgtaccacaagtttcaagatgggcatagcgccaagaaatatagtgggaccacacgacccatgggcgttggcgattcccccgcataccaggtcgtacaacgagtaatccccacacgctagtcagacacgtacaaaccacagtggctggggctcctccgcaaccgcaccatcggcagagttacgtgcgagtagtttcatcacaacagcgcgcaaaaacactgggaaaacggcgtagcacgctattacacgtaggacaccccatgtgggccagcaggacgtactttatctcctaacgcgcgacacgctatacagcaagagtatgcaccgcaccaagtagcacatctgacaacgtttg

SEQ ID NO: 690078 - DNA, 1383 bp, Homo sapiens
gagcgcacgagtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaaaacaaaaacacaaaaaaaaaaaaaacaagcaacaaacacacaccccaccccaacacaccagccgcaaaaccgaaaccgacaaaaagacgacacgcgagacccaaaaaaaacaagacagaagacgcggcgggcacagaaaaaacacccgagggggcaacaccaagaacagcccaacaacaatcttgagaaacagccccacccaagagagtgaaatatataaacagccgcggccggcataaaacaagaccatagcaagcaaacaagacgcggcatctcggagaccccactggtggggcgaacaggaccccaccacgaactccgccggaaacaacagaggatgagc

SEQ ID NO: 690079 - DNA, 1012 bp, Homo sapiens
gagcgcacgagtgcgcgcaccctctcccctcgtccaccgctgccgcctccttcttctgccgctcctggtgctgcttgtgtgctcgtttggtgcggacctggtacctcttttgtgaagcggggaagactccgggcctgcggaagccagagtgactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaa

SEQ ID NO: 690080 - DNA, 680 bp, Homo sapiens
catgtgtggaacatatgatcccagccgggcatagtggctgacgccacctacatgaatattcatagctcctcctgtagcctgttgaatatgtatgtttagccaacctcttcagcataaagctcctgcccaaacccctcctgctcctaaatgtctgtctctggtgttaaccagaggctgctcttcccaggctgctggatggctaccttgcaggctgtcacccttaacaagaaataaagtgtcctttgcaaatgcaaaaaaaaaaaaaaaaaaaaaaaaaaaaaaaaaaaaacaaagaacaaaaaaagataacgaaaaaaaagagacaaaaacaacaaacaaacaacagcggcgcggcggcgtcgcatcgaaaaagcccccacaggcggggcgccccccgctatgacgccgcacgcacgattagttggacagaacagcgaggcgcctcacacacaaagaggggggcgaagtataatcaaaaaagacgaacagagagcgagggcgcacgcccagggtaagacaacaaccaaaaagaccaagccaaaaccagacagagagacaaccgacccgcgccacacgagagggcaaacctactccatggagggagaaggcgagccaaccccccaagccctgggagggggagaacaaacaaaagcggggggacgacacacacacccccacag

SEQ ID NO: 690081 - DNA, 735 bp, Homo sapiens
gggctcacatgtgtaatcccagcattttgggagggtgaggcaggagaatctttcgagcccatgagtttgagaccagtttgggcaacatggggagaccccatctctgtaaaaaatcttaccaaaaaaaaaaaagggtgcggtaaaaatctcagttttattatatttaggggaccaccatcatctgtgttggcccatctgttggactgaacacgtaatctcatgggcgggcattatcgactggtatcggatattacctagagatttccttggtcctcaggggtatactcggtatagaattgtgccttagactattgcttataaaggtccctcagaataattcctctcaggggggttttggtcacccagcgggcttccacgagttgacaggtgcctatcggctatcacatctaatcgcgggaacaataatggggggggacactatctacacaacacacgtttaccttcaatttcacactctatgcaagctgttagttcaccacagctcaaatctaacaaaacagggcttacagaaacgttaacgtgttcccgggctaacttgtacccctttgtaacgcccgctgcacacctcctgtagaacgaacggcgagaactaattcgagagcagcgttaaactcgtcaatgcaggcattgttaccacttaggacacccagactacccccaagggcaattatcaggtgccttggggacacatcttaaacggcccgggcatcctag

SEQ ID NO: 690082 - DNA, 826 bp, Homo sapiens
ggggtggggtggtggtctggcgtgcgtcgggggcggacggggttgcggggtgcgcggcgggcacgtgtgtgtgggcggcgtgcagtgcgcggtgtgagtgcggggtgggagtcggctgctcggcgtgtgcgaggaggccgtgctcaggcggtgcagactgtgaggttcctcgtcgatgggcttctcaggtgcctggcggctccttgtctccgctccagtgcgaagccgtacatctaagccagaggagagatcagggtcagctgtgtccgggctctcagcgcagtgaggagttggccagccccctccggctgccacaccacgtaagttctcagtcccaacctcggggatgtgtgcagacagggttgtgtggaaccacagctggggcctgttccctctggaacgatcggtctcgctcatctgtgagtatgctgtggcccagcgtgagcgagccctgacgtccgccagagactcgagtgctctatgaggacagtgtcgcgcctctgccctccgcaacgtgcagtccctgggcacggcgggcccgtgccatgtgctggtaagcgcatgccgtgggccctggcgttgtggctctctccactccaggcggaccgtgggggccagtgaaggaagctcccggaaagagcagagggagagcgggtaggcggctgtgtgactctagtcttggcccttcagcaagctgaaggaacgataagaaactggaaaggaagatgctttaggaacatcgttttgcttttttaatatatatatataccttataagagatcctttcccatttattctgggaagatgtttttcaaactcagagaca

SEQ ID NO: 690083 - DNA, 150 bp, Homo sapiens
cgacagggcgatactgtctcgagagagaataaaaaataaaataactatttacatcttctcagttttaatttcaacagagtatcacgagatatacccaatataattaaaagctctttggggttctcaataattttttttgtattttttgta

SEQ ID NO: 690084 - DNA, 686 bp, Homo sapiens
  misc_feature (97)..(97): n is a, c, g, or t
  misc_feature (167)..(167): n is a, c, g, or t
  misc_feature (671)..(671): n is a, c, g, or t
tttagcactgacagactcagcaaccaggctctcctagtcctgctcccctgatctgtggcaggtactgctgctacaaaagacgggtcaccatgagagnactctgctagtcaaacacatatgacatggatctccagacctgacaggaccatgtccacctacactgatgnccatcggacatgaggtacgaagggtacgggtgaggtgaagcaagtgctgactccacccctcacagacttccaggtccagcccatagcatgcctttcaggtagtcgtgcgagacgatgctcagcacattgagagcactctcagcaactgaagctgtgggagtctcaggagctgacaggggactgctgggcacagtgggggcagaaatgctagtggagcaagagcgcgggggcagcggaggcttctcatcctcacaatcatgaggcatacaggtaatacggtgggtccaggtctacagctcaccctatacaggaagaagcagggacagcacacaaggcactggttgggctgagcatacaggccgatgagctcaccaagggtatggaagcggcgcacaggcacaccctgcgaggtatgcacagccaagaaataatctccatcaggcagaatgcgatacgtgtgaacatgcttctgatacatggaccagagcgagaagccacacgccnacgtatcgctatcac

SEQ ID NO: 690085 - DNA, 489 bp, Homo sapiens
ccttcataataacttccatattttattaatgatttaatattgtagtaatattttttggtatttgtttttacttttttgcttctcaaatactaaatcctgacttatttaaggattatgtttttcagaaggcttcctatgaaatatttatatttttaatattgtgccttcatcatttagttcttcaaaacaaggttaattgtaaggattccattttctggaattgtataatgttttatagtgattttgtttgagttctctcctaataatccagattgtttagtattcaactacttgtgtattattaagaacttgagaaggtgtttatttgtgactttgttttctcagcctctgtgtactgaggcatacttcatacgtattcttatattttattacataagaaatcctacagatcataatgatgtttcatatagataaattcattgtgttgtatactagtctgtctcattgaaataaatctctaaaagttaa

SEQ ID NO: 690086 - DNA, 239 bp, Homo sapiens
  misc_feature (11)..(11): n is a, c, g, or t
  misc_feature (22)..(23): n is a, c, g, or t
  misc_feature (31)..(31): n is a, c, g, or t
  misc_feature (43)..(43): n is a, c, g, or t
  misc_feature (74)..(74): n is a, c, g, or t
  misc_feature (77)..(77): n is a, c, g, or t
  misc_feature (89)..(89): n is a, c, g, or t
  misc_feature (99)..(99): n is a, c, g, or t
  misc_feature (102)..(102): n is a, c, g, or t
  misc_feature (106)..(106): n is a, c, g, or t
  misc_feature (110)..(110): n is a, c, g, or t
  misc_feature (117)..(117): n is a, c, g, or t
  misc_feature (127)..(127): n is a, c, g, or t
  misc_feature (130)..(130): n is a, c, g, or t
  misc_feature (134)..(134): n is a, c, g, or t
  misc_feature (155)..(155): n is a, c, g, or t
  misc_feature (176)..(176): n is a, c, g, or t
  misc_feature (179)..(179): n is a, c, g, or t
  misc_feature (220)..(220): n is a, c, g, or t
cggcacgaggntcgaactgaanncgcatcgncgagggcatccncaagcggccccctgacgagcagcggctgtanaanatgacacctttnaggccctgtncancganccgntttccancccgccaganctncccnatgtgatgaagccccaggacncgggaagcagtgccaatgaanaanccgtgcagtgaggacccccaagaggcccatttcccccaatnaaagagatttgggagtctg

SEQ ID NO: 690087 - DNA, 230 bp, Homo sapiens
tgaaaggaagtagcttactaataaacggacctccttcttcaagaaggcaagtaaggtagacgaagtcttgtatacgagtttctaacacttcgttttctagaggtcctcaagtaaggagaatagttggtctaatgccggtttaagttctatgtccataggggcaaaaatgttgtctacaagtacggggacgaagtacgttaaaaacttcacgacgaggccggtcgtcttct

SEQ ID NO: 690088 - DNA, 228 bp, Homo sapiens
cttttctgagactacttgatcaaacatttccaaaagaaaacacatgcttccacttcactgataacaaaatttaccgcagtttgcgccacctaagactctgacaacagcaatacaaaagtcaatttcacaagcgttaagatttcttcagacaaaatagatcattcacatcttcaagtcctttatgaaatcagttattactattattctttcctgattaccaccctgatc

SEQ ID NO: 690089 - DNA, 254 bp, Homo sapiens
ttagaataccctggtttctgcattgccctggtgatatagaataccttggtttctggattgccctggtgataacatgtatttttgattcataaagtcactctttagagacccaatgaatttggctctaaataggaaaggaggtatttgcaagtccggatgtacacagacattgaagtcccatcagtcccagagtgcacatattcaagtacccctacgtagtgcgcatccctttcaacacaaatatctctaaacac

SEQ ID NO: 690090 - DNA, 619 bp, Homo sapiens
aaacatgccatgggggtgagagtgcaagtagggttggggggcagtgggagtaatgtatattctttcctagaaagggtatttgccacaacttgagagaaatttcttctttctgatcacctgaagggcacggaaaatccaaactcttaggaggctgatgtctaaggctgggttgaggggctttgcagagtgactgcaacccaagtttaggtacccacctgggctcaccaaggctttttcatacagaggaaatggagtgggatctacaaaccccatcaaatcaaagtaagagggaaaacaaacacattcccaaaggcccattttaacccatttcctttattcaacaattgctggacttcaaaccctccagtttccctcccaggtgggaaggttaagaggggaaacttggtgaacccaaaaatttattgccaaaattaagccaagaggcttaaggcccccagggttagagggccggaagcactaacctccaaaactttggtttcctgggggcctggggaaattgggttaatcttggggtgggaccaaaaaaaccccaaatcggtagtttcctccttaggaagtctcccccttggtggactcttaaggaaatggttggttcctt

SEQ ID NO: 690091 - DNA, 165 bp, Homo sapiens
tggggatgggtggcagattggaaatagagaagtcagcatgggcttaatgagaagataagattggatcaatgaagacccctgagaagaaaaaaaaaaatgggagcaaagaattggcagttactcaagaaagaatgcacaggcagaggaaataaccaagtgcaaggg

SEQ ID NO: 690092 - DNA, 645 bp, Homo sapiens
  misc_feature (107)..(107): n is a, c, g, or t
  misc_feature (152)..(152): n is a, c, g, or t
  misc_feature (290)..(290): n is a, c, g, or t
  misc_feature (302)..(303): n is a, c, g, or t
  misc_feature (308)..(308): n is a, c, g, or t
  misc_feature (319)..(319): n is a, c, g, or t
  misc_feature (336)..(336): n is a, c, g, or t
  misc_feature (353)..(353): n is a, c, g, or t
  misc_feature (360)..(360): n is a, c, g, or t
  misc_feature (556)..(556): n is a, c, g, or t
  misc_feature (573)..(573): n is a, c, g, or t
  misc_feature (636)..(636): n is a, c, g, or t
  misc_feature (644)..(644): n is a, c, g, or t
gtcaagcagcccggagagaactgacggtccctgggcctcgaaggtcacccgggcggccccctcactgaccctccaaacgcccctgtcctcgccctgcctcctgccantcctcggcctgagtctcagcatggcggaatgggagcagcgatggnctagggaacctcgccctgcaccagccccaatcagacgccgctcctccaactaccgcgcttatgccacggagccgcacgccaagaaaaaatctaagatctccgcctcgagaaaattgcagctgaagactctgctgctgnagacttgcaaannaagangctggaagcangaggcggaagatcggcncgtagagaaggggcgcnctctgancacccgctgccagccgctggagttggccgggctgggttcgcggactgtcaggacttgttgccgacagctccacgcccgtgtggacaaggtggatgaagagagatacgacatagaggcaaaagtcaccaagaacatcacggagattgcaaattttgacttcagaagatttttgaccttcgaagcaagtttaagcggnccaacctgcgaagagtnaagatctctgcagatgcatgatgcaggcgcttttggggcccgggtaaagagtccttgacttgnggccactna

SEQ ID NO: 690093 - DNA, 150 bp, Homo sapiens
taggacgataaggtctgatagtataaacttatggaggtaggagtcagtggaggtggctgacaaaagagatcatttgccccaccacatatggcagcaaacgctggcaactctcccgctagaccacctactaaagtgcccagggtactatgg

SEQ ID NO: 690094 - DNA, 277 bp, Homo sapiens
atatgctgtctcagtctggtgagcagccagtatatatgggtgggggtcaggacagaagattcaataagagataatgaagaggggatggaggtggataccacaccaacagttacttggacagttggaggatgcagatgtggatcactgaaaatgatttatgcaagtttaagattctgctcctaagtgtaggagagaactgggtgcctcttccactcgggagtgacagtactgaaagtctttttccttttccaaaacccaacctgaaccagttctcgct

SEQ ID NO: 690095 - DNA, 141 bp, Homo sapiens
atcactttggcgtgctgacgcctggacctctggcaggtcaagtctggcaccgtgtttgacaacttcctcatcgccaacgatgaggcatacgctgaggagtttggcaacgagacgtgaggcgtaacacaggcagcagagaaa

SEQ ID NO: 690096 - DNA, 231 bp, Homo sapiens
ctgctctaagaggatcctgcggctgaactgctcccagtggctctttcggccagccagttcatgctcccggcggcttcccaagccccgttttgacttttggtggctctgcaggctcgaaaggccagcctcctgcctcccgaagcctgacatgcccaagcctctggctcaacagcggactctccacgccccagtagctctcgcctcactgcggttcctgggtccggagctcga

SEQ ID NO: 690097 - DNA, 255 bp, Homo sapiens
tgctttctaccatgttgccctggtggtgagccactggtccattgggccaatatatgggtaaacaaggcttatacaaaagagagtccagattcctaccgaggagagtgactactgatcagatttatttactcggaagctacactgagactacagtgtggactatggactggaattattggtactttactacattcttatttaatgagtgatcccccacaatatcccccaatgaccatgagaggactgccgcactct

SEQ ID NO: 690098 - DNA, 1107 bp, Homo sapiens
  misc_feature (777)..(777): n is a, c, g, or t
  misc_feature (825)..(825): n is a, c, g, or t
agagggaagaagtgcccagaaggtcggggctgtcggacggagcacagggtatgtgcttttactatagcgccgagacgggcatggaagttccgcagctagccgcgagctggcgcgctagctgggtcggctccatggactctgatcaccttcgatttccgcatagtggcaagcatgcatgatgatgcttagatgaacaatgagctcggcagcggcagtgccgcatacggatatccatccaaccgcaaggtcagaggcgacacatgccctgaacatgaagcatcaggcagcatgtccagtggggcctagtagctggcgtccaattcgttgcgagagcgagtctcaggatgagctcagaagagttaccgaaaccatcacccgaggcaatcggaggatcagagagctgagcccgcagataggcgtgtggaccacgacccgcgccatgttcttcctggagagaacgaacgtatgaatccgcgccttgaaacagcctttcgagcattgcttgaaggaagctggctcaagcatcatgtggaccctcccgcaagggacctggatgggaggtagggttacctggcttgacacggcactgaggatgcgtgctagtcaggccgatccggccaagttgccgcatgacgacgattaagcgactcaatgcacccatcatcagggttacagactcttccggccgcctggtggagtagagaatccctcaggagtaatgtgtgtgaaacaactatagtcagcctctggtgcaagagctcttcagtggttgatccngatcgaggtagcatccaaggtaacgccgtgcacgcagtctggtgtcgnggcatggtgcgggaaagcgcggggtggatgggaaagcgcctgatgggccgatattgtggggccacgttggagggaggctggtccccgcgtacgttggggaggcccaggtggagaatggcttggtgatgaagaggtccaacaagcacaacacgggggggcggcgggagggatccccccgggcgccggattgggccgtttgtggaagaggcggtggatcatgagtggtttgatacgggaaggggtaccctgtacgcggacgggagagcaccctgtggccactag

SEQ ID NO: 690099 - DNA, 248 bp, Homo sapiens
cgatacttggcgtgatctgtaatggcagcacagtagtactcggtccactgttagtaactcacagacgtctgtatagagcagtggcccttacagtgcccctccagactgcaaggctctgcctctatgcatccaggagagattggaggtggccggggggccacgggccagtgagatagaagagagtctcccctagcccctcaccaggcacattggtccctcgagagacgagacgatagaagctcagcatt

SEQ ID NO: 690100 - DNA, 537 bp, Homo sapiens
attccttatcactttggttaaatgaatgacttattttacaatgacctatgatcctatttcatggtatcaagtcttttaaacctttgatattttacaaactttccaaaatcaatttataaattgtcttttcctgacctaattaatcctttaagatattaggtcccctaaagtccaaaaatgacataatttggcttatttggtataaaaattagacagggagcattgtcaaatatgaaatgatgtttggttttctttgggctatatttgtataaatgttattggtatgtgttccaaaatgatgggaaactcctgtaattctgatttaacttagtgaacgttatcagtaattgtaattgttgttaaattattgtgtgccacagaggtaacacatttgtcaattgtgtctttgattatggctgccctaaaatttttgtcatccatggaccaatggtgtcttgttttggtcctttttaagtgggtcttattaatcaactatggaaacttaaacaggtggtcttaaatgcaaagttttcgata

SEQ ID NO: 690101 - DNA, 457 bp, Homo sapiens
gtgggagctttgtgaagggtggccctgagcgggcgtatgatcgatgcgcgtcgcgagcatgtggtgcgcagggttctgctgcgcaagccgggcctgtggctagtacggctcaggggaggtcgttgatcgctaaactgggtgcgcagtcgtgcaggcttgcgtatgcgcggtcgagtgcaggcgtgtcttaatgtggccaatggagtggcgtggttcacagtagttcgtcacgggattgcagtcttatgactgctgcctcatgctgtccttatagtgccgttctttgcagtaggtggtgcagacatgctcgtgagatgcatgcggattcgaatagaggcgcaatgggtgttctcggtgcatgtgctcacgttagacagactggcacgttgagcggcagcgaaagggtctgctcgttgcactgcgtgaaaaggtgtctcttgaatggcggtcaggtcat

SEQ ID NO: 690102 - DNA, 153 bp, Homo sapiens
aatccccgagacgtggagtatggcactatcgaagggctcatcaccaccaatgttggagacagcactttagcagatttatttggatcaattcggtggtacaataaggaaggtggcctctggcctcccttttctggatcaaagacaagtgctccc

SEQ ID NO: 690103 - DNA, 247 bp, Homo sapiens
tctgagtatcccccgcgcgcatatatcctaagtcaagtactgcgtgccactcttgttcacttcggtgagaagagactggaagccctggtggatgcctccaccactgccacttttattgaaagaaagtatctgtcaccccgctactcgggaagctgaggaaagagaatcgcttgaacccgggaggcggaggttgcagtgagctgagatcgtgccactgcactctagcctggcgacagagtgagactcc

SEQ ID NO: 690104 - DNA, 1100 bp, Homo sapiens
cctactctgtggttgtcctggatctcgtcgtgatgtcgactgcttggttgcgccgcgctcccttttgtggatgtgatcttcttggtctggtcccctctcccgtgtgtcggcggggattcgtcctctccgatggatccccgcttttgtgacacagacctgttcttctctgttgtgtcgcacacacgcggggtgtctactcccggtttttagccgcgccccctccctcccgagggatcccccctgtgggaaagtgttgatcctcccggccattctgctgccccccggagggttccccaagtgagaaccccttgtgcacatggaccccggggtgaacccaaggttcccctgggaccagatcccggaaaagcgcacagggtcctccccctaatgccaaaggccctttgacccaaggaaccccttgaacgtatggtccacgaaacttgagaagtccacaactgaagatgagaaccagagggacacaggtgtcatccagaattcactggagtcctatgccttcgacctggaagcccctgttgaagatgagaaacttcacaggccagattcaccgatgaggtccccccgcagatttctggaccacgatgtaatgaaattatccactggcttgataagaatccgactgctgagaaggcaagaatttggacctcccccgcaagagcctggagaaagtttgccacccccatctatcccccagctgtacccgagtccaggaggccatcccggaggaatccctgggggatttccctggtggtggagcctccctcccccttggtggtgcttcccccaggcccccccattgaagaggttgacttaacccccacccaagtgtaagatgtacccattgttcccaccaccactttaacaccatttgaaggaccctaaattctcgtacccaaattcttgtcccagttttaaaaagttaagctgctatagtaagttactgggccattcctccgtaacttgaatatggaaccatatgccccggggaaggaaatacaccttcgccacctttataacacccctgtattgtaagtgggaaatcccattttttaaataaaactatttaacaattggccccaata

SEQ ID NO: 690105 - DNA, 343 bp, Homo sapiens
aagcagttaatacagactcagggtcctgagcacatacaaccccctcagcttacgaaggtgtgacgggattaagagattaaagtaaagacgaggcataggaaatcacaagggtatagactggggaagtgataagtgtccatgaaatcttcacaatttatgttcagagattgcagtaaagacaggcataagaaattataaaagtattaatttgggggaactaataaatgtccgtgaaatcttcacaatttatgttcttctgccatggtttcagccagtccctccatttggggttcctgacttcccacaacaaatagtcaactttgagtctgtattaaactgcttg

SEQ ID NO: 690106 - DNA, 104 bp, Homo sapiens
acggatagcggatctgcctaaaatattattaaatgataggaatgggagatctgaaattgtatggctgaaggctacaaagtcacgggaatcgcctcagttgatag

SEQ ID NO: 690107 - DNA, 406 bp, Homo sapiens
tgggtaggacagtgggactgggtgctggatagaatggccttgatgggaccagcgtctcttccctgggggtgaaaatcaggctctgattccagatctcgcctccatcatgaagaagctcttgaccaagtacgacaatctatttgagacatcctttccctactccatgggctggcatggggctcccacgggattaaagactggagccacctgtgaccacttggcagctccacgcccactactaccccccacttcttgcgatccgcaacttgtccggaaagttcatggttggctatgaaaatgcttgcccaaggcccagcgtgaccttcactccccgaaacaaggccgcagaaaagattaaggggcgctttccccgaaggtacactaatttgccctggcgcagaaagac

SEQ ID NO: 690108 - DNA, 123 bp, Homo sapiens
catcttcgacggaggcattcatgagggtttttaaagtgtcctgaacagttctgtctctcaggataattttctgaaacatactgaggaaattctgtaactcttttacaatcataaagcacagaa

SEQ ID NO: 690109 - DNA, 239 bp, Homo sapiens
ccggccacattgtgctgtgcccctcttaatactcaccaataaactctacttcctgtccaaaaaaaaaaaaaaaaaaaaaaaaaaaaaaaaaaaaaaaaaaaaaaaaaaccccatttttttttttttgggggcgggggggggggggttttggaacaaaggggggccccggggggcggggggaaagtgtgggggggggggggtgccgcgcccccaaatagattcgcgacacacagtggggg

SEQ ID NO: 690110 - DNA, 912 bp, Homo sapiens
aggtactttttaaggaaaaaatttatatgccacagtttacatagacatttcagattcaacacgtactcttgaatataatggtttcttttacttggtcaaaatgcatgtatagcatttctttcatcttagttccttgtgttgcctatgtggtcctttatatattttttattggtatcgaagcaaaccaaaactatcttcacagaccatacagttcaatttggcatatcatttgtcgatatcgaaactacaaagtgtcacaaagttcacagtttagcccttttctagacaagtgcatctttcaacaattcaaccaatgctcctctttctacaattcaccgaaatttatgtgtgggaaggcaccaaaatgatttagtaagtgccactgcaatattccctttcaagtgtggcctacatttcaatcttcaaggatggaatgcatgtctgctccttgttctgaaaaatgtaggcatctactagattgttaaaaccacagtgcaaacatatacataagcctcataacacaaagattgtgcaatttgaaggcctggttaatttttggatgtagacatacctacaaacgaacacgggttcaaaatatcacagcgctgtacaagcttccttgggcttccagataatctcacaatggggtctacatagcacactcattactacttattactacctagttactactgcattgttgggaagcattagttacaacgtggccccgtttcaactatggaattccttagcaaaaagtgcatggttaaactggtgggtatcggtaataagtagtaaagtaagtcagtattatgacatttaccgttagaaaccaacgggtatgcagatctctcacatggttgcagagtacaggcgatacactcgatgcgtgtcgtacgtgcacagaaggtt

SEQ ID NO: 690111 - DNA, 307 bp, Homo sapiens
taaggaagggtccccagcgttgagagagccccaagttgagaacaataatgaacaattattgtatgaacaattgttagaaacagctaatcacaaacaacctgcgggcacaatgacctcattccacacgtagcacccttcagcaggaccctataaaactttcctccagcccttgcctctttgcaggcagccccttctctgctgagctgcccactgcaacatattttcacaatttctctaataaatctgcccttctttacctacaactatcttggtaaatggctttaccacctgcaaaactgaccctagg

SEQ ID NO: 690112 - DNA, 880 bp, Homo sapiens
gctgggtgagcggacgctgcatccctttctgctgcagtgaacctctcatcagaccgactgagggaagcggctgcccggagaccctgcccgtgccggtccacattctccccaggaagcctggacctctatggggcgggacctgggggagcctgagccgagccccggagccagccccagaacccatgaacctccagacaggggcgcccccgggcagcagccacgccagtgggccgagcctgccgcccgccagagcaagcatgagcgagacgcgtcatctgtatccagccgggccactgtgatgctttatgatcgacggcaacccagcgatggctccctgctggcaccggcgtccccaggccattcagcccgctgtcagatctaccacaaccccacggccaatttcctttcgccgtcgtggcgccaggaagatgcagcccgcacagacaggtggtcatacaactgtgccatcgtccggcggtgtccaagtatcaacccaggccaccgcccaacttccatcagctggcgcgcaccctccgcacaggtcctggaggccctcgaactcccgcgcagccaagcgaggcacatgccggcccccagcacatgcaccgcccggccatgcgcccacgctgcccctaaaggccgctagcgaacgcgacgcgactggcgacacccacgcatcgccaacacactgcacctagcgaaccaccccccactcggcaacacaggtccccagagaacatccgaggctcacacatcctactcgagtaaaccgcaagggactgcgcagacatgcaacgtcaacacaagccgacactgtacatgaacagtgcgccccacgcatcagctacagcatagcacacagaaagagaagccacgatcg

SEQ ID NO: 690113 - DNA, 82 bp, Homo sapiens
ggatttgctggtgcagtacaactaggcttaatagggactcgaattcgaggtgggggagaaaatccagataaataaatgagaa

SEQ ID NO: 690114 - DNA, 707 bp, Homo sapiens
gccccgaccactgaggctcttttctgtggcactgggctgccggtgctgtgacgtgctgctcagccatcccctgctctacgtgaagctgctcatccagtgtgtgtgtcatgagcctgatgccccccacccttgtgaaccaatgtgctgtgtgtgatgtgaatgtgtccatctatcttgcctgagcttcgttcacctactgccaagatacatctgttgcaatgtgtgattgggtaatgatatgtgtgcttgttcctgattgccttgagtccccttgtgctgagtgtccaactgccctctctacttgtgactctggtggtaagcatggaagaacgtgtttatcccctccagattgatgacttgatgcatggtatccgcaacaaaggattgatattgaacgacattcccctgacccgcgaaacgttgttgccggagaccgtcctacgagactgatggatgcactgtgtggtgtccctgcgagtgttggcccacaccacccttgcattgtcaatctcaatggctgccttgccttgcggtccgcgtcctgtgccgcgacgcgcgagcgccacactcacccgttggttgttcgctgcgcctccccttgcgcgccagcttcccccgcacggccatgtgctgcctgcgattctccgctggcgttccctccttcacctcctgtgccgcctggctccctcgtcccgcctgccctgctg

SEQ ID NO: 690115 - DNA, 420 bp, Homo sapiens
aggatcattagatggccaggagtttcagtacagcctggacacgatagcaagacccaatctctactaaaaaaaaaaacccagacaagtataggaagtgcaaaggccacaacggcaggaccacacgggagcattctgaggagtgacagaaagagcaggaaagtagtgggtgccacaaagccaacggcccgggagtccaagaggcaggcaggcccagtgagcacgggagaagttcgaaaatcacatggggcgccactagggcctctaagcattcatccctctgctctgggaggcgggcttgaggcagccactaaaagggacctgtttgagaacagaagcccagcagtctatttcccagcagtttccctgcctccaagcctaagtggccgtgagccaaagagggagtccatctccctattacct

SEQ ID NO: 690116 - DNA, 416 bp, Homo sapiens
ggagtcgggtagagaaaggcagcagtgctggtccagccggcgtcgcttgagcggtgagcagtgccaggcaggggcgaggggccgggcaagacccgagagtttaaggcaaagcagggcaagggtgtacgcagcccaaggcgggtcaggctttgggacaattgaggggcggcaaccggggtgaccggcagtgcatggcccgagtaacaggggctgggaggaacccagaatggcccttggtccctgaaccctccacttccaggcccttgtgcaaggcaactggggggaacttctgtccccaatttggttgagtccctgtggccaacttactgggtggccaggggaagcgtagtccttcccttggccccaaaggtctagggtgggtcaggcagaaagcgttgtccggtgtttgaagggac

SEQ ID NO: 690117 - DNA, 128 bp, Homo sapiens
gctatggggtactcattgtcatagctatgcccttgtgtgcaatttgcttcgtcactacccgtctcaatatccaaacagctctaccttaacatggtctctcttatagcaatccctcacgcacacaagct

SEQ ID NO: 690118 - DNA, 342 bp, Homo sapiens
agccccactctaagggagcaggggacctacagcacaccactgtttccccagtcactccctctaaatactcacggccagggcgcgtccactcttcccccctgctcctcccgcttttaaaatgtcaagggacagcattctccaccagttgctgaggctccgtcagccccttttcaccttttgttacaattccctttccccggggccggggtgagggcacattcaggactagaacgccctctgggcatggggtggacatggcaggtcagcctgtggcacttgcgcaggtgcgagtggccagcagaggtcacgaataaactgcatctctgcgcctggctctctacc

SEQ ID NO: 690119 - DNA, 945 bp, Homo sapiens
  misc_feature (15)..(15): n is a, c, g, or t
  misc_feature (942)..(943): n is a, c, g, or t
ggcggtgcgggagtnaggccccggtcttcctcctcgtcctgccgcaggccagaacccctgaggtattcagctgcgcgtaagtctggccggtgcatctgtctccgaatgccccccaagaaacaggctcaggcgggggcaagcaaaaaggcggagcaaaccaagagacgggagaagatcatcgaagacaaaacttccggtgggaagaatcagcgaaaggagcaaacgcaacagaaagtttcatcagggcctgcccaccccttccacgtcaccattggggtccaaacaaatttccacgtcaggtaggcaccaagaggtgacagcttgcaccacgcaaattcggaagagggctgacaagaaaggaaaaggattgcagggagctaaagtgaggtggtacaaactgtgtagttgctggctctaaaaaaatacagtaaggggtggcagatccccagagtctgtagtatgtgcttcttcagggcaggaccggtgttcctacagggagcatacatgtgtaagttctcccaatgaatttgactctggagagcacactgtgaacacggcgaggggttacattgatgcagagatgaagattttgacaaaggatactctgggatcatggggatgagaaaaagcttggaagaagtgtgaacagaagccggtgaggggaaaggaaaaccaagaactcaagttgtgttgaatgctttcttgaaggtatggaaccaaaggttggtggttgggatgcctgaggggggaaattggaggatcgggcggcatccgtgatggtgaaaaggtacagacgaggaggggaattgaagaaaggagaggtgccggcaagtaaactgaattgcgacaagaacagatgtttagatggagagtgggcaactaggagtcgggatgaaatataggtgtgttgtcttatattatatatgttgtgtagttataaannaa

SEQ ID NO: 690120 - DNA, 174 bp, Homo sapiens
cctctagtaagtactggaatccagaggttagaacatgggaagaattatagacttgcctggaggtgcaggcctgctatgacttgcaggtctgtctacagatagcattttatctaggagcagaagaggtgatagtcgaggtgatcatcgaagaatagtctggttctacggcgtgtg

SEQ ID NO: 690121 - DNA, 545 bp, Homo sapiens
  misc_feature (417)..(417): n is a, c, g, or t
ggtatttattgtcaggtactgaacaagaagattcacgccgctcatgtttaagacctgaactctgagatggtttaaaggtacgagctcataaagatggggaggccgaggttacagaaaaagtcataaatcaatacattgaggctatacattggtttgactaaaaatgtgggacatcttgaagcagggcctctaggtcataggtagattcaaagactttctgaattgtgattggttaagaagcaaagctttgtctaaaatttgggatcagcagaaaagaatgttagctttagctcatgggtttaactgcctccctcgggaagaaatttagaacgaagaatggtgatcggagttcagtcctcaattgccccttatctgagttctatgtgccaatggaatccgttggtgggagtttggatntctgtaaaccaactcaggaagagaggttaaaatgttatctgtaatttctatagggaacaaacatcttgtgatgctaactgctttagctattggtttaagctacgttttgcttttttgctgatcaaaat

SEQ ID NO: 690122 - DNA, 136 bp, Homo sapiens
tgcggcgatgggtgtcgtcggcggtgaagaacagggcgtcggcagtgtggatgtagttgggcaggcgttcggcctggttgcggcagccggaacacgtcgcccagttccgccagtcgaggtgctgcaccgatttgcc

SEQ ID NO: 690123 - DNA, 756 bp, Homo sapiens
ggagagctctcgaggcgagcgcggcgcagcgcagattaaaaatcaagaaatataaaccagatgtagcacgtttctagacatggagaaccaagcccataatacgatggcgaactctctccttgtgcagcgctgagcttcaggaattcaactggaacaaactagacatcactggtaaagcaacaagcacaactggctccggcgaaaagcacaaagatgcgggcttctggaagaccacgattagcactcttcgggatcaagaattggcacaactgcacaaacttgatacaggatcagaaaggtcacgcaggtcactgaactacatactgttcaaccaatagctacctatcatcacgactgtcaacatatagtaattctcatcagcaatatgtccacaactccatcacatacttgaagatcaagcgcatcagcaacacgccatcgcattcgctcgacaatcgctgtcaggcaaataatcaggctcaacttgtcatcatactcaacatcacgtggaagacatccagcaagcctcacaatccccatcagaaatgctacaaggcccgcaaatcagaacgcacaggaactagccactacggctcggctacacagatgccacaaaccttgctaaacagaagctaacggcaaccacacaatttaaacacctattcctaattggtcaaaaaacgtacataggatcaacgccaacgttcacaccacatgaccaagactacctcatgcgacatcgcagtgccggacaag

SEQ ID NO: 690124 - DNA, 261 bp, Homo sapiens
cgtgctgattctagaggatccctcatcccgagtagctgggacacaggcacacaccaccatgtccagctaatttttgaatttttttgtagagacggggtctcaccatgttccccaggctggtctgaaattcctgagctcaagagatctgcccgccttggcctccgaaagtgctggggttacaggcgtgagctactgtgcctgtcctatggttttaactggtccttaaagaatgattttgcatagagtacaacctgccggtgg

SEQ ID NO: 690125 - DNA, 239 bp, Homo sapiens
tgcatcatcttgctattatggttaacaggcgtgtgggtctctccctgggacatgagggcatagttaaaattccctgggtggaattaatgcctggattcattgctcctccctttcaggacaacagggaaaggatgaagaggagcagcagggttgggacccatcctcaggagcatgtgtcgggcaccctggacgctgcctcagggtgctgtgcacacgtgtttggcactgtgactccagac

SEQ ID NO: 690126 - DNA, 102 bp, Homo sapiens
ctttggcgcggattctccctagctctcggtctccaccatagcctccacctacggctcctcccttaggccctgcctggagcttcctatcaccttcccggctct

SEQ ID NO: 690127 - DNA, 486 bp, Homo sapiens
  misc_feature (113)..(113): n is a, c, g, or t
  misc_feature (486)..(486): n is a, c, g, or t
cgcggtggctcacgcctgtaatcccagctctcagggaggctaagaggcgggaggatagcttgagcccaggagttcgagacctgcctgggcaatatagcgagaccccgttctcncaaaaaaaaaaaaaaaaaaaaaaaaaaaatgtgtgtgcggcgccgcgcccgcgggccccgggaaaaagcttctaagaaaccaatccggtgggggcgcgcgcgggggcccaagaagggaaggtgaaaccgggcgcccataacgcgggtgtcccataaggagaaacccggggccagaggaaaaaggcggggggaatctcccacaccaaaaaacaaaaccgccgcgggggcgaacccgagagggttctcggacaacaaatctccagaagagggaagtccggaggaggcccaaacagaggggggaactttaatcaaagcgggaggttccaaagggaagccccgaatatcaaattaaccccccggcccggggggaacn

SEQ ID NO: 690128 - DNA, 111 bp, Homo sapiens
  misc_feature (10)..(10): n is a, c, g, or t
  misc_feature (44)..(44): n is a, c, g, or t
gccagcctanaggaggaaaagcaaggcacagaaggatgttcttnaggaggaagcagcactaaaagcatctgagtcaagatgagtgggaaaccatctcaataaacacagggc

SEQ ID NO: 690129 - DNA, 472 bp, Homo sapiens
ccggtttttcgagtgaaggtagagaagtggcaggagcagtacagaaagtaatgaagatacacggaaagctatggcccgtgatagagaccaacgccagaggcttattaggtcagcagtaggagaggctcagaagggtagcctctcgggatagctgcacgcagacgatgagggctcgtttcagctgctcataggtgacgaacatcaccacgttccaggaacccaatcggagaaaggagggcatgaaccctttgtagaaggctcggggccccctccttctggtacgcatggtatagtgcgcacagtggccagcgctactgtactggcccaggtcagagttcatgtatctcgtcttgaccacgtctacaggggaggcgatgacagtggtgcagaagcctgccccaaaggcagaagtgaagtgacaagggaggtcatctgtcatgaggttggctttcaggagggcatccttgattag

SEQ ID NO: 690130 - DNA, 1044 bp, Homo sapiens
gccgctgggtgcctgagagaagcccctgcccagaggccgcagcgcccccgccggggcctgctggactcgcgacaacttcaccaaggcgccgtcgtgggaggcgagcgccccgcgccgcgcgcgaggacgcgggcactcaggcgggcgcgcaggcctgcgtctcagtggccgtgagccccatgtctccgcaggacggcgctgggggctcggccttcagcttccaggcggcgccgcgcgcgcccagcccgccctcgcgccgagatgcgggcctgcaggtgtcgctgggcgccgccgagacgcgctccgtggccactgggcccatgacacctcaagccgcgcgccgcccgccttccccgaagtgcgggtgcggcccggctcagcgctggcggcgctgtagcgcccccggagccggctgagcccgtgcgagacgtgagctgggacgagaagggcatgacgtgggaggtatacgggccgccatggaggtggaggtgctgggcatggcatccagaagcatctggagcgacagatcgaggagcacgggcgccaaggggcgcccggcacgcgccgcgcccgtgccggccccggaggttcgggctcggtgcgcacctggccccagatggcgccgcgaggcgtccgcccggcctgtacgcgcgctgtgcagagtgtgcgccggccgggtgctgtcgcgggcggaccacggcgagtgatctgcccatttgtacgccgagttcagacttctcaggctccttcttgatcacaggccctaggaagggtccctctggtgccacaggcctcgaagggggtgtgcagcactagggtggtgcgtccggtttttcaggccctccattccaatacagagaacccttttacaagttcctcgtggcaagaaggcagaaaccggtcagctggagccaattgtccctcacagcctagagtcactcccgcactggacacggggcgttagacctacatcacacccgtaaggggagtctaacagctaacgggtggccggggagacccacaggagatatctcggaacaggcg

SEQ ID NO: 690131 - DNA, 164 bp, Homo sapiens
  misc_feature (78)..(78): n is a, c, g, or t
gtaaaattcagctcatgacccctaactgggccctcttagcctcctaatgacctccggtctagcatgtgatttcacttncactccataacgtctcatactaggcctactaataacacactaactatataccaatgatggcgcgatgtaacaggaagaaacaaggg

SEQ ID NO: 690132 - DNA, 689 bp, Homo sapiens
gtattcatccttctggtccaaagtaaactggctacaatttctgattctaagggaaaacgcttcatgcaaccagatgaaactcagggctctggtggggagagccttactctgatactttccatcatgtcactgcccactgggctgatgtttaaaaccttccaaaaccatcacatggatggctagggacaggactgtgccgccttattacacaatgaactcagctcaccatgctaagaagactgcctctttccaggcaagattttactggagcaacataaccggagggtgtgattccaaaataccttcctttccaagccccgggtagtgaataaaggtctggaatttaggttatatgactaagggcgacagaggctgctaggcatctctgggcaccgtcccagtggcttagggttggaggctacactggcaaaacaatggcactgaataactagctcgtgtaaaccattcatctacagcaagtagaatcatcagttttgcactagagcaaggaagcacatgggtctcctatgagagctaatgccagaattcacatgcttagtaaaatataggatgaggttctttctatattctgcccctccagaggccaatgggtagggagttcctttgccttctgagtgcctgatgtcccagcctcacaagacctgtaaacacagcgttgccaactggtg

SEQ ID NO: 690133 - DNA, 924 bp, Homo sapiens
  misc_feature (464)..(464): n is a, c, g, or t
ttttgagatggagtcttgctctgtcacccaggctggaatgcagtggcacgatcctgtctcactgcagcctccgtctcccgggctcaagcaattctcccgcctgggcctcccgagtagctgggattaccggtgcccaccaccacacccagctaatttctgtattttcagtagagacggggcttcaccacgttggccaggctggcctcgaactcctgacctcaggtgatcctcccaccttggcctcccatagtgttggaattacaggcgtaagccgccgtgcccagcctggaaggttcttcttctatatatggaatgtgataatatctttggaaaggagactacagtaggttgtagacatactataaactctaagacaactactaaaataataaaaagttatggcagataagcaaacaaggagataaaactgaactgtggaaaaatagtcaatccaaaagaaggcngaaaagaaagacaaagaacagatggaaggaacagaaaacaagtagcaagatggtagcttttcacctggccacatcactaattacattaaatgtaatagtctaaacacccccaataaaaagatgtggattgtcagactagaataaaaagcaagatcactctataagctgcccagagaatctcactgtaagtaaaagacacacattagttattgaaagtaaaggaagaggaaaaaacacaccgtgctaacacagaaagaaagatcaagtggcaatattaatacaaaggtagactttagagcaaggaactggcaataaagaagatcctttcataatgataaaatcatgaccttggattaggcaaagatttcttagacacaacactaaaagcatgatgtataaagtaaaaattaatacattgggctttgccaaaattaagaacttcggccagtctaggtggcgc

SEQ ID NO: 690134 - DNA, 288 bp, Homo sapiens
tgaacctcattgtttttaaaattattcataagaggccaggtgcattggctcacacctgtagtcccaggactttgaggagcagaggcaggaggatcatttgagtccaggagttcaagattagactgagcaacacggggagacctcatctctacaaaaaatttaaaagaaaattaattgggcatcatggcacgagcctgtggtatccgctactcgggaggctgaggtgggaggatcacctgagcccaggaggttgagacttgcagtgagctgagttcacaaccactgcac

SEQ ID NO: 690135 - DNA, 944 bp, Homo sapiens
ggtactcaggtgcgtgcgcgcgagctatggatctgggcaccaagaatgtacgaaggcgaacaagatgccgtcgagtctcttcctacctgtccgaccgggcctccgcatgctgctccgtgttgtcacctgtcgcggagagaattcctctatcggaggaattctcgcctgcctatctagcgagaactatgactcacgcacccagtgattcagtgagtcaaagcctcccttttttgcaaagacttcaccactgaagcctctggcatagattctgctggacgaatctatattctaatacgagccgtggatggcagacccgattgtacaagcacgtgagtcaaatatttgtaccttcgtcccgcacgtcgatacaatccgtatccctcgtcctcttgggattgcttacttctccgtagccggagactagagttgtgagcatctgagaagaggcgagatagatcgctagcgattttgtctcctgaagatatttcagagcctgaagcgaggaaagttgccaagagggtatcagaagtcggtcttcactggagaatgactcgcgagaactcaacgtcgtggtgaccgcgcctccgaagcctcttcctttcaaaggaacaagtctaccgaaacgtcgcaacgcattccagggaatgaggttggtgttaaactacacgcccagaagggcctgtgaactacgttggcatggggtcctgtgaggacaagatgttttgaaaccgatgggtcactctatctgcaatacatgccatgcacctgggtggtatcttgcgcgggaaacggaaacagcacagtctactgatgaacttgtatcctggcaggaatttacaacttgtcactaaagagtggtaggacagttgaagagctttattgtaggaaagagtgggcgtgaaccactcttgaccaagaactcagaaggtctggtggtggggtcc

SEQ ID NO: 690136 - DNA, 251 bp, Homo sapiens
ggcaaaatctcgtgagtatctgcgcacgaataccttaatcatgatcacacactgtctcctgtgtagtaaaacataataagtagttcccatctcctgcattcagactactgaatactaagtatatagcatgtggatgtgtcctactagatatcactgtcactatttacattacctgtattgggaggaaattctatatagtagcaggttaaaacacatgattccggtcgaaaagtaaaaactgttaagatcta

SEQ ID NO: 690137 - DNA, 110 bp, Homo sapiens
ctgtatacatttttttcaagtacccaaaatatccatgtatgaacatagcatgttttatttacccacttcatcagctgatgaacatttgggtgtttccactttttgtctat

SEQ ID NO: 690138 - DNA, 112 bp, Homo sapiens
caccataccgactacaagcagatcattcacttgtctcttagctgtctagctttttcaactttcgagagtctttcatatatcatacactctggaattgtcacctgcaatgatg

SEQ ID NO: 690139 - DNA, 391 bp, Homo sapiens
ctcgaggccaagcaaacgccggccgacctggttgaggatcagccggatcaggggcttggtgcgcgcgatgtcggagggcggcacgacgagatagagcgtcgacggccgcgctccgcctacgatgtcggtgatgcgccagtcgcagcgccgcgtgactgcggcgacgactggatcgcgatagaggccgagaaaggacatggcggtcgagagcacgcctgagcgttcgttgtccgatttgttcagcagctcgcgggcagcggaggcgatgacgggatgcggtccggccgcgccaaggtgcgcggtcttcatcatggccgcgagcgtcgactcgatcgggcgtttcgggtcggacaggaaggcggcgacgccggcgagcgtcttgtcagcctcg

SEQ ID NO: 690140 - DNA, 156 bp, Homo sapiens
tgctcatagttactcttgagtatcctcaggtgagcagtggcctacgagagttgtacacgggggctctgaggcctgtacctagtgtctccagcaacgagggcgctcagtacagaccccaatatccaccttgactacgggataccgaagctcgaactt

SEQ ID NO: 690141 - DNA, 102 bp, Homo sapiens
acatctgtgtacttctgcgccacgagtttaccgagggggctgtggggaggccgtacacgcaatgagcagttcttcgggccagggacacggctcaccgtgcta

SEQ ID NO: 690142 - DNA, 271 bp, Homo sapiens
atgcaacccggatttctcggatcaagcatcactgaccctggatatcgcagcgttttgctcctcaatgaaatacagcttatcgcatttcttcacagggcgcgccccatgcttcttagcgcgcttgccaaactatgagctcatctagtcatcaatgaggtactctgagcagtccgatcaggtcattgtgataataccgtacatcactgctgtttcctcgctgaccgtccactccatctaccgggtcatagctgttcctgaatatagatagagg

SEQ ID NO: 690143 - DNA, 257 bp, Homo sapiens
agccgctaccgttgtcgaagaacaacggcattctaagagatgtatttaatgaaattgagcttatccatgtaacgaatgaagggaatgagacccctgaagaacatcaggtcacccgtaatttccgaacccatttaattaggggtgaaaaagcattgacctttgcaaaattaggagttagagcaattctttcccaaaaattatttggttgaagggtatttattagttaagggccgccttttaattaatttccccaagga

SEQ ID NO: 690144 - DNA, 171 bp, Homo sapiens
  misc_feature (52)..(52): n is a, c, g, or t
  misc_feature (67)..(67): n is a, c, g, or t
actaggccacggttggctactagtccactgtttgctactagtccacgtttgnctacgagtccacggnttgctactagtccacgcttggctactagtccacgtttggctactagtccacgtttggttactagtccacggtttggctgctcactgtaggtcagtccccgccca

SEQ ID NO: 690145 - DNA, 449 bp, Homo sapiens
  misc_feature (50)..(50): n is a, c, g, or t
  misc_feature (53)..(53): n is a, c, g, or t
  misc_feature (87)..(87): n is a, c, g, or t
  misc_feature (167)..(167): n is a, c, g, or t
  misc_feature (223)..(223): n is a, c, g, or t
  misc_feature (309)..(309): n is a, c, g, or t
  misc_feature (315)..(315): n is a, c, g, or t
  misc_feature (325)..(325): n is a, c, g, or t
  misc_feature (381)..(381): n is a, c, g, or t
  misc_feature (385)..(385): n is a, c, g, or t
  misc_feature (436)..(436): n is a, c, g, or t
taccgagcctggaaggtgcagcggcccgagcccagctgccggccgcgcanaantaccagccctccgacgctccccttcgagcgcganacccagtaccagaaggacttccgcgcctggccgctgccgcgccgcggggaccacccgtggatccccaagcccgtgcaganctctgcggcctcccaggcgtcggcgcccattactacggggcgcccaagacgccggnccgcagagccaagagcgactaggccagtgacagccgccgctgaaggcccgggaagacaggaagagcggcccccggcggagcgggtnggcctnggcggccggnaaagagcgtccggggcggacaaacgacaaaacaaccaaggaaagagcacagggccngccnggaatagtagacgtccgcgaccgtaggggccttggtgggcacggagacagnacgcccgcttgcc

SEQ ID NO: 690146 - DNA, 535 bp, Homo sapiens
gtgcctgcttttgttgatactttcttactgtaaagctctccataaatagtgaaaatgtttggtaaatttattgcaatttaaaattggtgagttcctttattaaattaattgctatgttattggagaatattcatcaaattggaattagaggatgtctacgcacaagtcagtgtggggggaaatggtttcatttggtcggacaaatgttgagtttgaacagttgtattctgctagctagttgactgaatccagcctctttctaaagctaactttctgtgtgtgtagagaccctgatgccacatcccatacatttcttttttcttttctttttttttttttggaaactggttgtgtggtttcgactgcaaagcagatcttatttttgattaatacatatgaacaatttaatcctatttcggaaaatcagtcatagtttttctggcatagataattttcctgttgattatttcattaatctggtaattttgagtatgatagcatttcatttcaaatataccccgtaatcgccttaaaa

SEQ ID NO: 690147 - DNA, 110 bp, Homo sapiens
ttgtttgctttaagaatgcagagctggcggggcatggtggctcatgcctgtaaccccagtactttggaaggctgaggcaggtagatcacttgaggtcgagaggtcgactg

SEQ ID NO: 690148 - DNA, 274 bp, Homo sapiens
taacgcgctgatagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgtgaggattgcttggcctgtgaggcagagtttgctctga

SEQ ID NO: 690149 - DNA, 108 bp, Homo sapiens
acacttcataaccatgtagcatataatgaatctaactcctacaccctccatttcatttccgctccttttacaacttctgcaggatcatcttcgtcatcatcgatcgat

SEQ ID NO: 690150 - DNA, 228 bp, Homo sapiens
gttactagcagatcatatctgaccaacagtttaaatatagaaaatgaaacctatactagtgaagaacagaattacactgtataacataagcagttcacctttcaagaaacaatcatacagtgggggagaaaaggccagttttccccaactgattatattccagtataggcaactgtttaacatgctatttcagtgtttatcataacacgagacagtgtttacaaaata

SEQ ID NO: 690151 - DNA, 141 bp, Homo sapiens
gagtggtgcgaagaacgtagtttacgccgatgaatatgatcagtgaaatggagtttatggcgtacgctttggttcatagtgcgttgtacgcctgtagcaataggggaaatcagatgcaatgaagcctcctatgatggcaaa

SEQ ID NO: 690152 - DNA, 926 bp, Homo sapiens
gtatggtgtaagtctccgacaagaaaaaaaaagaaacaaacactgtcttgtccatcagtaacactggcaatcttcctgtataaccactctccttagggatggtactctgaagacaagcaatggtccgccctcttgagattcgttcaaccttgctgattccataatgagcagaggtgtacgcgaaattgtgttactgactgatagccttcagcatacaacataccccatagtgacctgacctgtgtttacacagtcgtctatattgtaaactcattccattctgagtctttctggatgaacttggctatatctgaaatctgctatctgagtgaggactccaagaatgagcatagatctgggcctgattaagagtagagtgactattaacgaaacatagagctttctaggaggctactaagagtcaaacgtttcgataccaaccgatgttatggatatatcttgagtattccgaatcatgcaaaaacacgaagattgtccctgcctactacgaggacagactgatgtggaacttctgcacctggtcaacttaacttgtaacgcggacgatgctgtgaaaacactaccggtttgtctgatcattgctcgtgcagtttgagtactggatactcccttattccagttgcttgcaccacgccctggtcttggaacctataataagcaggtgtgaagcgaaatcctatatccagctgcctgcagtttaattcgaccgaaagagtgcgtccacttggaggattttcttttaccagaccagttcgcatcggaactctgtggcctgtctgatagtccacatggccaacgttacggcaaggcccaacgaaatacaggttaggtagactcggggaaaaaggcgttgactcacactgttcccataaatttggggccaggaccaaacgggggccaagaat

SEQ ID NO: 690153 - DNA, 609 bp, Homo sapiens
cagaagttggaccatagaccacccagaagccgcgcgtgtgcagtacgtaaatgaacatggacgtacctggttcctacgtgatccatgggcctgagtagtgctggatgctcaccactgaaaacaacgcccgcgggggaacgcggaggcgttctggaaacaaggatccaagatggaggttgcctgagggtccagtgtagggggatctatcaacgagggagtccgcatcgaacgcgatatcatctgaggcaccggcggcggtggcagtacaaccggagcccccgccccagcaacatactccaaattgaggccaacgagagtgaggaggtccggaagccggagatctttgcccagtggtggagatgacatggaggtcagcgccacagaactcatgacacacttctcaataaaaggtgtgacacgacacccctgatctgaagactgatggtgtggcatggacaacatgtcgcagcatggtggccgtgatggatagcgaaccaacaggcaagctgggcttgacggaaattcaagtactgtggaacaacatcaaaaggtggcaggcatatacaacagttcgacactgaccgatcagggacattgcagagagaaccc

SEQ ID NO: 690154 - DNA, 172 bp, Homo sapiens
tggagctagcgccccgtgctcactggctagacacctcaaagacataagcaatgcgcaacagggtctcctgtagtgtctctgattggtcgaccacctgcaggatggtgaagttctccagcacgctgtacatcatgtacttctcagggacgtgctagagcttgtggatcaagtc

SEQ ID NO: 690155 - DNA, 376 bp, Homo sapiens
cttcagaaaatggactaagacaacacactactatgaagtgcccctaagagattaaaaataagtgctgttactgcctagccaacttcaaacggtactttccttcacctaatgcttattagccatgtcaatagaccctcccttcttcaaaatcctattcctaaaaatctgaaatgattaattccttctagtccatgtaagtctagtctatttttaaatttttatttatctatttttggggcttttttgttgcttttgtttttgagacggagattccctctgtcacccaggctggagtgcagtggcgcgatctcggcttactgcaacctccacctcccaggttcaagcaattctcctgtctcagtctcccaagtagctg

SEQ ID NO: 690156 - DNA, 200 bp, Homo sapiens
tggaccagaaattgttatttaatataataaaatgtattagctgggagcggtggctcatgcctgtaatcccagcactttgggagtgccaattgtgggcagatcacgatggtcattgagatctggggtgatcctctatgagtctgaccttgcatgtgcatgcaatgcttgtgcacttggcctgctctgttttacgaactgtc

SEQ ID NO: 690157 - DNA, 283 bp, Homo sapiens
  misc_feature (55)..(56): n is a, c, g, or t
  misc_feature (110)..(110): n is a, c, g, or t
  misc_feature (169)..(169): n is a, c, g, or t
  misc_feature (213)..(213): n is a, c, g, or t
  misc_feature (215)..(215): n is a, c, g, or t
  misc_feature (218)..(220): n is a, c, g, or t
  misc_feature (222)..(222): n is a, c, g, or t
  misc_feature (224)..(226): n is a, c, g, or t
  misc_feature (271)..(271): n is a, c, g, or t
  misc_feature (280)..(280): n is a, c, g, or t
  misc_feature (282)..(282): n is a, c, g, or t
gtttttctgagtttctcgtaatgctcatttttacatgctgctactagctttcccnnttaaaaaaagtaaaagttgctgctttctaaaatattaattgccttatatttganagtgccattgcaatcgtaagtagactatgtatttcctataatgatgtctgatatttaantaggaaatcagacaaacaatattcagaaagtttaagcatataancnttnnntntnnnacttgcctaaatccctgtattccaaaacctgctgcatcataatanatatatctntnt

SEQ ID NO: 690158 - DNA, 891 bp, Homo sapiens
ccgtggggatggcaggttcggggaggctggtcctacggccctggattcgggagctgattctggggtcagagacaccctcgcagtccacgagccgggcagctgcttgaggtactacagtgacgccgaggtccgcggtcgcgggcccatcccacgcccctgatacgtccgacgtcggggtccacgctgcttgtgtctgacggtgacccgagcagtgtcctgatgcctggtgacgcgggaggccctggagcacctcggactgggaggatgaaggagttcggcttccgcgggacagatgggccgtgctgcgtgctgctgcaggactgtcggggttcatgtccaggtcgctgagggcggcgcgcccgcagacttctatctccaggtggaccgcttcagcctgctgccctcggcagcagccccggctacgtggtgcctggttgctaccaatgaccttagatgttcagcacagaagctctatgagctgccttgcaggagcaccgtttgcacgcagctccacctcgtcgcaatgccaggcctgatcactgtcccagccttcctggatgcaaatgcggcgagagaccaggagcgatcagggggcactcgttgtgcctggctgaaacgcctgctgcacactggagcgtgccctttgcacatgcacccacctgtcgacccacttgggcttgctcatcgcatgcaggcctcgggcagacgctgtgtacgctgtcccccagctcaatgctgtggatctctgagcatgaccagctaagtcctgcgccttcctgggcccttgccgagggacccagggccctgagctgtcccctgcatgacccggctctcgcggagccgatctctgaccgctcgttgcctctctccttcttacctcagtctcggacc

SEQ ID NO: 690159 - DNA, 783 bp, Homo sapiens
  misc_feature (745)..(746): n is a, c, g, or t
ggggggcactgtcttgactggcggggtgggggggaccagtgcccttgtgggattggcctgacccaatactcataacgagaggctaagaattgtcggcacaaagattctagatgttcttgaggaaatccctaaaaatgctatggtatcacaaagtatacagaacatattacatttgacaagctggctaggggtataacgtaaccagatgttaaaaatttaaaagaccagcttgaaagcggtcaatcataacaggagatacttcattttgaacataaactaattctgccaggaaaattgagggaatggaaactcttgtagacattttttgaaaagccttctgccgatcaaaggaaaagggcaatctgattattaagtgactttggcaaaattcatgggaaactgatggaataaacaattcgtttattaacaaaagcgtgttcttattactgacttcttgataaaccaaaaaagtggccttgaaaaatatgttggggatctggtcaaaattggatgaaaactggtcacacttgtcataatacaatcaattttccgcgtgaataaaggtgctcaaacaccagtcttttgtaaaggatggccctttttctgtagaacaagaaaagcctatttaaaataatttctgaaaatattagaaacaaaaaaattcctctcaatttttttcaatgcaaaaaagcctctctcaaaaaagaaaactgtcctttaatatgcacaatagaaagtaaagganngcacagcccccggggaggggggggcccttccttttct

SEQ ID NO: 690160 - DNA, 236 bp, Homo sapiens
gctttattctggcaagtatttttaactatcctaaccacccaattttgttctttaatctttgcattaattctatgacataacacctgtttccccattaattttttttaagtgaggcaacaaaatcatgaagaggatgtatcactctactgtgtcacaagaatgaaacatggtgtgggatactttataaacgatctaagtgccacagactatcccctttttgggtctcctgtcgacgc

SEQ ID NO: 690161 - DNA, 904 bp, Homo sapiens
  misc_feature (748)..(748): n is a, c, g, or t
ctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattggttagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaatgctnatgacaacaggcaggttgtgggtcagggtgtagtcctgcagaaactgcctaatacttatttcttgcatacaggactgatgggcggcgctggtcttaggccttctttgccctattcaggatatggataacacgttcgcggagataacacgttcgcga

SEQ ID NO: 690162 - DNA, 139 bp, Homo sapiens
  misc_feature (47)..(47): n is a, c, g, or t
gcacacgcctgaactgtgaggttctcagaatgagttatctggaaggncgatccaagtacatgaagatgtgattttctggtgtccagagtaacctcttcactttgggtctctggcaggcccctattccctttatggattc

SEQ ID NO: 690163 - DNA, 651 bp, Homo sapiens
  misc_feature (144)..(144): n is a, c, g, or t
  misc_feature (536)..(536): n is a, c, g, or t
attccaaaagttgctgaacttattgccaaagaagatgtagacttcctgccctacatgagctgcgcagggggaatccccaaggaagccgtcaggaaccagtctctgttagcatcctctgagtggccagaattacgttgatccaangcgacgaacatatggaaaattccattttccataaaaggaaaagagtggaattagtctcagccagaatgttggctgaacgattttgcacagacggatgccgttaggtgtactaccagctttcacatccaaatttggcaagcgtggacgtagtggtacaacaccctataggtatttcagagtcggacagagtctatgtaaaatcaaacacgcacatctgaatccactatttaacgaacagtcaagtccatgcggaaaaacatctatcttctagacttttttctccatatttttggcatccggagccagttagggttccctaatcttaaccccagaactgcccggctgctcaacagatccttgcttcccttgtcttttggcctcgatatcggtcnagggagcatagtttacggttcaagctgcgtcatcccgaagaaaagttttgaatgcatctccaattcaagccaaaggcccttgttgccttgggcacctttggttggcttgaactgg

SEQ ID NO: 690164 - DNA, 836 bp, Homo sapiens
agaatttaatggactgtgaatttcaaaaaaaaaaaaaaagatcggtcaaatgaacttttacagaatgcatttaaaaaaaaaaaaaaactctcctgtgtgtgttgggctcagaaacaacttgtgctactttactcattttgggtattaacagagggaaataagtacttttatctcattttatggggtaaatttttggaaaacttatggcttaaaagttgcattacaaaggggaggatggggggagagaccatatttaaggcaagagatatggggaagaaggtgtacatgtctatatttttttttccacaaattttatctaaattgggcgcctgagtggtaattatgtgtaacctcttaggcgtggtaatctatatttcgggagaatatattaccgtgtgggtttccccaaaaaccccagtgtttatatatccccggggggggatctcaatatatcaaaataacgggttcgtgagaaatatataaagtctgtggggggcacttctttaaaaacaacacggtgggggatatctccatctgtaacaccatctatttgtgttgtttcagtgcagaaaaataacattttacacacacctttgggagattccccctagtgagaaaaatattccacacctatgagggaaaagacaactctaacaacactctttaaaacagaagaaggggacaatcctacccaaaagctatgtctgtgggccaaacagccgcccacactattatcaccaaaagtggggggggtagaccccaaaagaaacatttttagaaaggggtgtgaaaaagtttgaggaaacgcacacaaccacctagatattttaaggaga

SEQ ID NO: 690165 - DNA, 439 bp, Homo sapiens
ccagaagataactagttaatcacactagtttcagaatatgaaatgtagaggaattttttcttttcctttttcatttcattctctgtttaccaaacaaaacatgactgactgtttcatcactctccagcacctgttgtttcctgggacatggatgaagctggaaaccatcattctcagcaaactattgcaaggacagaaaaacaaacaccgcatgttctcactcataggtgggaattgaacaatgagaacacttggacacaggaaggggaacatcacacaccggggcctgttgtggggtgaggggatgggggagggatagcattaggagatatagctaatgtaaatgacgagttaatgggtgcagcacaccaacatggcacatgtatacatatgtaataaacctgcacattgtgcacatgtaccctagaacttaaagtat

SEQ ID NO: 690166 - DNA, 130 bp, Homo sapiens
tgctgggattacaggtgagagccaccacgcctggccgattttttgttgttgttgtctatgctggggtctctctccatcacccaggctgaagtggaggggcagagtcagtctccctgtgtgctccagtcca

SEQ ID NO: 690167 - DNA, 134 bp, Homo sapiens
gcaatcaaattagaactcaagattaagaaactcactcaaaaccacacaactacatggatattgaacaacgtgctcctgagtgacttctgggggatttagcggggtgatgcctgttgggggccagtgctaaacac

SEQ ID NO: 690168 - DNA, 637 bp, Homo sapiens
gtcagaaaagaggtgccagggccgggctgggacagtgaagagtgctgggcagtctgtggtcctctgtatctcaactttttcatcttaaaaaaacaaatagggttgtgtgtgtggctggtggtcataaggtcctttctggctctaataaccatgagcttctgttatgaagctgggacccttagagcctcaggatgatcctctgttgttgtgaagccccaatcaggtgctaggcaccatagtggcacttagctgaagctcctctgtaactccgtgtgggcccgttgccttgcacctacgccccgacagctgctgcagtgctccggtgagcagcacatggcctgatggagcttctggagaagatgctggcctcagcttggcaaatggcagattctcccaggacgtgcactcctcgtggatctgcactgggctgctctagctggcatccttctctgcccaggagcgcaagggcagttcggaggttcaccaagacagtctctgtggaaatggaccaagtatagaaggctctcagctttcctgcgaaataggctgcactactctcaggtgccatcttatgcttccgtgcggacagcgcctgcgacaaagctttgtcctctgccctggtagccctggtgccctc

SEQ ID NO: 690169 - DNA, 121 bp, Homo sapiens
tgcgagaatcgcacggaggcggtgaccccgctcatggtgcccgacaccagatggttgagttccccagtgggggtgacagtcagcttgagggtgctgacacagcacttagcctacgccttct

SEQ ID NO: 690170 - DNA, 169 bp, Homo sapiens
cagcaggcagaaagaagcctctgtgggttgaacagtaaccagcagctccttgccctggcagcccggcatcgcactctccatgtccaggagctcatccacgcaatctccattctgggtctcctcttcctggcagcgagaggcgcggagctgctccaggaccactcctcta

SEQ ID NO: 690171 - DNA, 411 bp, Homo sapiens
  misc_feature (310)..(311): n is a, c, g, or t
ccctaagtccactggtgggggtgctgtcaaattcctgggtttagctcgttcctctggatggcgatctctgaagctgatcgtctagaatctttctgcggccatcacatcttgcttctgggcttagctccagaggatccctgagtatgggtgccactcttagctcagacagaagtcatgttcttagcgttcaggcaagtcagcctttgcataagacaccctgtcgtcgggcaggaatttgccgttacaaatcccaaacccatgacagtaggaatgtcaccccatgcttcacatatgcattatgctctgaacnnagggcaactatgaccatgcttccttaatctttattgagcaaatatatggccaaggttattccctagacactgtcatcctagtgccgagaagaacctgcta

SEQ ID NO: 690172 - DNA, 164 bp, Homo sapiens
ggggggggccccccccgcccccccccccgtttcctttttgtttttggtttggggctccggccccggccctttgtccggggccgttttttaatatttttttagcggggggcctttttaccctgggggccttttccaaggggccccttaaagaaaggggggcccca

SEQ ID NO: 690173 - DNA, 237 bp, Homo sapiens
  misc_feature (11)..(11): n is a, c, g, or t
  misc_feature (13)..(13): n is a, c, g, or t
  misc_feature (221)..(221): n is a, c, g, or t
  misc_feature (233)..(233): n is a, c, g, or t
ggcgcttacantnatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccntagaacatgccnacac

SEQ ID NO: 690174 - DNA, 933 bp, Homo sapiens
  misc_feature (790)..(790): n is a, c, g, or t
ggaagcgtggcggctgcagactgtgggtaccgggtccgagaggactcagcgcttttctcgtccgtgccatggcgcctgcgaaagccacgaagcgtggtgcggatagctagtaggtctacgacgagctgatgatggcatattcgggagctcggagtacgggggagggtcgccaggtcgaagtcggtgtactgcccacttggacgacgatagtggacgcggagatcacgcgcatgattggatggagaggtcgaagtgacattatatatggggaggaattgagaagtgaattgagcatagttttagggccatgatggtaggtagaaactggtggccaagaatatggagggtaatgtcattacaggccaatacaggaggtcatgcaattatgctttgattaccaactggggattcgctagagaggagagagctggacacgttttcggctatgaccgaaactattatccatctattcaaagccatattctaaaaggtttaagccttctactctttattgcatgggggcatttacctcctccgcaaggctgagtatccaggactggtgttcatggtaagcattgtgtcaggggtggattagaaggccacaaatcattcgcaagaattgggggttggataggtgaggcattattggtggggatatagttgcagtgcaaagagacagggcaacaacccttggttttagaaagtttaactgagaggactgcaaaagaagaaggctgagtttggaaagggaaacagggagtggggttccagaaggggaatcctatggagngccatttaattcctgattggtaaaagcgggaggaatttcgaccaaggaattttcgcattacaaaatagcaaaaaggcatgaaaactttgagcaggggtgggatggaaatttcctcattaatggccggaaaaatgggttacctg

SEQ ID NO: 690175 - DNA, 129 bp, Homo sapiens
tacgtctcgcgctccccagtctgctccagctcgtgtagtgtggacatactggctatagccgtgtgcatggcctacttttcccttttaatgtagataatgtctccacctcttttcatttccacatggtct

SEQ ID NO: 690176 - DNA, 213 bp, Homo sapiens
  misc_feature (4)..(4): n is a, c, g, or t
  misc_feature (11)..(11): n is a, c, g, or t
  misc_feature (15)..(15): n is a, c, g, or t
  misc_feature (145)..(145): n is a, c, g, or t
  misc_feature (203)..(203): n is a, c, g, or t
  misc_feature (210)..(210): n is a, c, g, or t
ccgntgggcgnggangaggagcgccgggctggttttaatttcctcatgttttgcctgcactcacgccccctcctggcgtccccgcatcacctcgctccgccgccgccgtcgccctcagcccgcggcgccgcgtcatggaggcgantgactcaggcctttcagcggcggctggagctgaggctctggctggggaggagcgcaanatgagcntgg

SEQ ID NO: 690177 - DNA, 716 bp, Homo sapiens
ggacggagaacgtgaccttgaagaagccagaaattttccaaaatctcaagaggagagtgttcgagctccgtgatctgaaaggaatgctagaagtgttagagagctgacagatgtccagacgctaactggatgaagtttggctctgtgttcccccaggcctgatgtgcaggtggcacgatctcggttcagtgcaacctcctagctctcagattcaagcagttctcctgcttcagcctcccaagtagctgggattcaaaggtgccaccacacccctggctaaattggtattgcagtagagacggggttaccccatgtggttaggctcgtctacgaacctctgacctcaggtggatccacccgcttgggctcccaaagtgctggattacaggctgtgagcaaggggggccccaagccgggtgcttattttcttacaactacttttgggttctaaaaaacttcacatttacttaggtgctacgtgtcgactgcatagtagggtgacctagacgttacaaataccctatattgacttatattgtgggaaatagctagaaagagaggactggaagttctcaaaacagaggaattgacccataattggacggtggatggatatggtattaccgtggtcggttataacgcgagggatactgtgtcaaaactcaaactgtacacataatttgcctactatttggcaataaggcaaataaacaaac

SEQ ID NO: 690178 - DNA, 436 bp, Homo sapiens
agacaaatggccagaaatatcgctgaattctttcgctcagtatatgggaatcatccctgcaggaaagagaatgcgacccctgaggtggggtctatagatggccgccttaggtgtggacatcttctatggtcgagactgtagggatgaaataaaccccagtctcccatagtgctcccaggcttattaggaagaggaaattcccgcctaataaattttggtctatatcggttgctctcaaaaccctgtctcctgataagatgttatcaatgacaatggtgcctgaaacctcattagcaattttaatttctccccggtcctgtggtcctgtgatctcaccctgcctccacttgccttgtgaatattctattaccttgtgaagtaggcgatctatgtgacccacaccctattcatacactccctacccttatgaataact

SEQ ID NO: 690179 - DNA, 212 bp, Homo sapiens
gggctgcaggacctcccaggagaaggtaacaccaaacgctggcgatagcaacagtccgtcctagaggcattttaggtttagtctataagagagtgagcgagactacggatttcaccattggtgctttcagctaagaggctgggagcgtggggtgaattgaagaaggcagttcgggcctggggcagggagaggaaaccccaaactattgttaa

SEQ ID NO: 690180 - DNA, 699 bp, Homo sapiens
cagagaactaggctcgagagtttattgcttacaccatatgtcctgccttaaattccgttaaaggctgttcatagctcttcagacaattggtactctactctgcgtaaatattgattccttctgacacgggagccagggtatagcctacgagacatatcacgactggaaggtgacgcgtgtctcctgctcgacctaagccagtatgctttacgctccagctatacggcttgcaagccccttgcgggctcagggaactgctcgcccagtgtgcactgtgagtgtgatagcccacccgtgcatgagggaaggtgaccgcccaggtgtcccacataccactgaatctggcttacaaggcggatggaagcacgtactcaccgcctcaggggctgcggcctatgcagctgcctatatgcatctgtgtaaacaccctgaccaacacaagtgacagcactagctgaatgcatggtaccgcacactcccattgtagcacgttgcctattactatgctacggttcacacgagaagactacatgtcactatgctaagctccatacgggctcctgcttatatcctgcgcaccctgacctgtaatggtgagtgatatggccttcctaaccacactgatctccacttgggctatcatttcccggtgacgtgactcggccgatgctcctgcgctagcgcatgcttcatgtcggc

SEQ ID NO: 690181 - DNA, 151 bp, Homo sapiens
ggaaaaaattgtattgaaaacccttagtatgccgttgataaaaggaatttgggataattatggtgggggattattttttatacggtatgggccaaagctttactgctgtggaaagccaactgttttaataaaagatttcccttccccccca

SEQ ID NO: 690182 - DNA, 1094 bp, Homo sapiens
gacgggtgctccctcccctcgctgctcaccttggttcccaagagccgggcggccgcaagacggggtctggccatgttgcccaggctggtctcgaactcctgtgctcaagtgatctgcctgccttggcctccaagagtgctgggattacagctccgactcagattttgaacggatgtttggcatgttataccacagtgctacattaaaaaccagtcatgtggatgtggcacgaccacaacaaacaaacaagaacacacacaaaaacacactgttgtggggcggcaagaggacccacaaagagaacgtgttcacagaaaacacaatggtagagggacgcctggggcgccactgatggggtcaaagtgacaccagtggcgacaacaaggtggcacacaaagaagaagacacgcgggcacaggtgcaaactgagctggtggaattatctacacccaagattaaaaaaagccgcaccgggatgaacacgacgcaagccgtttacgacaaacccaatatccacgagagcggcgctaacacggagggggacaaaaacgggagacagtcataacaaggagcggactccccagcggcgacgccacgcatcaacaatcaacagccccgcggtccggggtgaaacatcagacagcacagcgagcagagacaggcagactgaagtcagagagcagacgaacgaaagcaaagaggacgcagaaagccggacagaacagacaaacggagacacgcaagcaagacacaagaagtcaaggaacgaagcgcgcgaagccaagcacgagaggagcaacacacagacatcagaaggccagcacagacggagagagcgacaaaccaaaacgacacaaagacacgagggacgaacagacacacgcagagcagacgacacgaggaggacgagacaaagcgacaagaggaagaagcacgagcacagaaagcaactacacccaaccgacggaagagaaagcacgagagcgcagcgaagaaaaagaagacgcagacagacaaccagcgagaagaaggaaaggacagaaacaacgagacatagcgcagctcaacgaacaagagggcagaagacacagaag

SEQ ID NO: 690183 - DNA, 627 bp, Homo sapiens
cgaggaaacagtattatcgaggagacagtatacacggagcatactgtatcaccgtagacagcggaatcacactagagtgtttccatcgagtgctcatagcatgtgtgtgaacaacacatagtggagcaagtctgaatcaaactattctttcattccagttagtgccaatattgacatgtacaaaaaacttagcttagtattcagtctactattgagatatctcagcctgataggatatgatatgatggctggttagatagtaagttcaatttctaagttcacaaatataattgaaatgttgtgcaaaaaaactcttaaaatcaactagtttcaagatcaacagcctgggacagacagaatctaaatcaaaaagccatttttacttgtgaaaataaactaaaattaatgtaaccaatttgaaaagtttcttttaaacaatctagacaagagtctagcctgtctttggtgcagaacgttagtacgtggcaaaatgaaattcccaccccagaatgtcagctctgagggggcagcgattttgtgcctgtatggtccatcactgtatttccagtgcctaaaagagtacttggtacctggtaggtactcagtacatattgaatgttaaattca

SEQ ID NO: 690184 - DNA, 211 bp, Homo sapiens
cgaggatccctactaaatgctgtcaatagaaaagaatggatgagcttcggtcatcagctacatgagtcaggcacggtggcagctttccattttagtcagtttgccagtatgtaaccagacagtacatcaattaaggagctttaatctcttaaggacattttttccttagggaaaatgaaccaaaaaattaaaaccattttattacccaggt

SEQ ID NO: 690185 - DNA, 408 bp, Homo sapiens
ccaggctagaagattaccatgtccattcgtgacagtcccttttgtacggacgagtaccatgcataaggatagcactggacatgttgcttgtatctttttaaatggaaaaagaacatccatagtgtaagatagctctgcagccagaaatggtcttctcacggaacatatacatctgtgaaatcaatggacagaatgtcattggattgaaggactctcaaattgcagacatactgttaacatctgggactgtagttactattacaatcatgtcctgcttttatctttgtatacatattattaagcggatggcaccaagcattatgatatagcctatatggaccataccattcctgaggtttaaaattcactgtcagccatggaaatgtagctgtacgtctccatgacttc

SEQ ID NO: 690186 - DNA, 730 bp, Homo sapiens
  misc_feature (140)..(140): n is a, c, g, or t
  misc_feature (235)..(235): n is a, c, g, or t
  misc_feature (276)..(276): n is a, c, g, or t
gagatgagagtagccatacagggaggagaatgagatcctgcccccagaccatctgaacggggtgaagctggagatggacggtgcacctcaagtcgcggcttccaccaggaggtcgttccctaggcgagaggaccatgggntggcgttatgagtgaggatcgcggagcgcagcggcgagagcacagaggaagcatgcagtggtcagtcgtattgtccagaggtggagtgtgaacanctgaccgtgaacgatcagctgccaagggacgatgcaggcgncctggatcatggacgaacgacggcgcggagccacttccacgagaggccagtggagggacgagacaagacacagcttccgctgccgctggacccgtgacggggacaggtcacggtgtcgttggcgacagagcatactaaggctgaagctctcttggggcgacgtacacaggccagtagctggagaaggcacgggttgccgacgacctgtcaggcttcaacgaaggaactcaccgtgtggtacgaggaacatgacatggaacgatcgctggcagaaacctgaagggaccgcgtggatagcgcacgcgcggaccatgcccacccgtgtcgagtagcctggttggcttcgtacgtgaggtgaggagaggtatcctggtcggtagcgcgtccaaacctccgacgacacgagccgggcgtggaacttgctcaggggttcaatggggtgaaaggagcattg

SEQ ID NO: 690187 - DNA, 176 bp, Homo sapiens
  misc_feature (4)..(4): n is a, c, g, or t
gtantgtgcaagttgggtatgcgagcagctcaccgcatttccagatgggtcagagacttccgtagggccctggtatcctttgtggccacaaacaccacaggattgggtggcatcagctgttgtttatgtttcttgactgcttgtgcttgcatggcttgtgatgctatgcaacctgc

SEQ ID NO: 690188 - DNA, 474 bp, Homo sapiens
  misc_feature (275)..(275): n is a, c, g, or t
  misc_feature (277)..(277): n is a, c, g, or t
  misc_feature (279)..(279): n is a, c, g, or t
  misc_feature (329)..(329): n is a, c, g, or t
  misc_feature (363)..(363): n is a, c, g, or t
  misc_feature (398)..(398): n is a, c, g, or t
ccaggctagaagattaccatgtccattcgtgacagtcccttttgtacggacgagtaccatgcataaggatagcactggacatgttgcttgtatctttttaaatggaaaaagaacatccatagtgtaagatagctctgcagccagaaatggtcttctcacggaacatatacatctgtgaaatcaatggacagaatgtcattggattgaaggactctcaaattgcagacatactgttaacatctgggactgtagttaacctcgtgccgaattcggcngnanagcacaaaggaagtgaaataatggactttggagactcagaagggggatgntgtgtggggcaagggataaaaaactacatattgngtacagtgaacactactcgggtaaacaggtaaacnaaaatctcagacttcaccattaatacaattcatctatgtaatcaaaaactacttgtatcccaaaagctattgaaat

SEQ ID NO: 690189 - DNA, 201 bp, Homo sapiens
  misc_feature (108)..(108): n is a, c, g, or t
aagatggcggctctgactcctggagagcggtcgctccggatgcctctgggtccttatcttatcatcctcttcttattttccctattcgcctctcttttcttctctccncctcctttaccccttcctctttcctctccttctccttcctcctttttttccttttcctccctttcatttttccattctctccccttcccctcc

SEQ ID NO: 690190 - DNA, 417 bp, Homo sapiens
agaggatcccccgtccgtcgaccgctggatttgactcagataggacccccttatggtgtctccatcttccctatttattttgggcccttgtgggctacattgtagatcaaagccaaggcccccaggaaggtgacatactcctggaagttcacctcctggtccttgttccggtccaagtcttccatcagccttgcaatttcagcatcctgcagcttcgagccaatggtgagctccttctggatcagctccttcagctccttcttgctcagggtgtgcttgtcaccctccctgccggagtacttgtggaagatggccacgaggaggccaatggcctgatccagggggcatgccatggctgagggctgggcttggagcggtagggaggcggccaaatgcgacgcgagcggtcgacggacg

SEQ ID NO: 690191 - DNA, 1080 bp, Homo sapiens
tcatgtaactataactggtattaagtgtagctgagtgcctggtgtggctggctgtgctgatgtggggtgttctgggctgtgctgtgctgtgctgggccctggcggctgggcctgattgagcctgggctgcaatggagctggaagagccctgagctgggaagaatgttcctgcagcaatgcctgcatgcctgtgctgctgcataccctgtgtgctgtgctccagtgtgaccatgacgcaccgttctgaccttcctgcactgtggcaacgactgcttgactgacgcaacgatgaacacacgatgccgccagcgctgtgcgctacgactcctaccaaccatcggtcaatggcgcaacgccctgacctgaacacgtgcgctgccctgtgctgccatgactggctgtccagtcttcaaagcatgcctggctgaccaacgattaccaaccaccccagcaacaaggtcaagagcgacccgcacgaaggcgcgtggaccagccgcgccagctcttctgcggagacacgaagctgagcggcctgaacgccttcgacattgctgaggagctggtcaagaccatggacctccccaagggcctgcacgcgggcgctgggacctggcctgcacggatgagacgctgctgtcggccatcgccagacgccctgcaacactagcaccatgcccatcacgggacagctctcggccgccgtggagaagaaccccggcgtatggctcaacaccacgcagccctgtgcaaagccttcatggttgaaccgacgaggacctcaggaagcacggaaagagcctggtgcagcaggtgcggaacccgctgagcgaggcgcctgatggccgacaatgctggcccacgctcgacgagctggccctgaagcgcgaagagcagtggccaggcctgcgatgaggacgagaaccacgaaccccaggcaccgaccagcaacacacagccccaccccgcaccaggcacgcagaaacacaccgagacaacaccccccaggcacccccgcgcaccccagagaccgcaaacacagccccccccacccaagacacacaacgagcgaaaacccacaca

SEQ ID NO: 690192 - DNA, 180 bp, Homo sapiens
tagtgattacagtcttagacttacctcgcacttacctcggagcttacctcggaccttacctcggagccttacctcggagccttacctgcacgtgttatcttctaagagggctcatgtacccatgccacagtcacgcccagaaacactcgctgattgctgactagggtaatgggctccgcc

SEQ ID NO: 690193 - DNA, 369 bp, Homo sapiens
tgtaagccactgccatgtaaaactctcctaccgcttgcaaaaggaaaactacattcggaaggggaagatgcccaagaagaaaatcgagacggtaagtgcagcacttttctaaagtaaacacacaaaatgattgccctgacgaaggtggatgcaaaactatgggaccggtgcgcacaacccacatcgcacaccccgccagctccgtgtgacgcccccagccccgttagcagaacggactaggcaccccaacctttctcggagggaaaatgcacgagtcagggccgcgatcccctccgccctggcacacagaatgtctccgggaatcgcccacacgagcccgggtccgccgtatccttccggcggcggccg

SEQ ID NO: 690194 - DNA, 243 bp, Homo sapiens
gactatgatgcttatgaatttgatgtgcccgggtttaggctttagggaatgcagtgggctctttatataatagagtcattttacgattcatttatctatactgttacattttgcctttccacgtctcttcttaggcacaccttgaaagtccaagtaaccttagattgaagggtatgctacctattgaaaccactcttcaacaggaagcagggaaatgtgaagtgacttcagtaacagaagaat

SEQ ID NO: 690195 - DNA, 634 bp, Homo sapiens
gatgctcggagacaacagcacgcatatcacaggacaacgaataaaaactcccacctcttacgttatacaaaaatcaactcacaattgaccaaacacctaaatgtcatagccgaaatgtaaaactgctagaaagcacaacacagggtaaacacttcaggatatagggtctgcgaaaatatttgcacagcataagaccttaaaaacacaggcacacaaaatcaaagatgaacaagtaggatttaatcataaatggacaaagtttctgcacagcaaaggagaccatcagcagagtggaccagacagcctacagaatgttaagaaagttcaaacaaatccaatgatatttatccctaggacgcaacgggaccgggttaaacatagggaaaccaataaatgtgatgcaccacattaaagactgatttacaaaatatattgtctcaaaaggattccaaaaacgctgttgagaccattcatcactcttttatgataaaaaaagaaaaactgttaatgcagaaggaaattaacataataaaggctatctatgacaagccccacaattaatattatcctcagtacttagaaaggcaaatcttagcccggcccagtggttcacgcttgtaatctcaatgctttt

SEQ ID NO: 690196 - DNA, 275 bp, Homo sapiens
gaaacctcatctctacagaaataaaataaatactagttagtgtggtggagtgttcctgtattcctagctactcaggagcctgaggcaggaggatcacttgagcccaggagttcaaagatgcggtgagctggagtgctgtggcgtgatctcggctagtgaacccccgcctcccaggttcaagcagttctgcctcagcctcccgcgtagctgggattacaggtgcctgccaccacacccggctgatttttgtatttttagtagagatggggtttcac

SEQ ID NO: 690197 - DNA, 187 bp, Homo sapiens
  misc_feature (16)..(16): n is a, c, g, or t
ctaggaaagctcatgntaacctattctctagacatcgcgattagagttgtgagggagtgtgtagattgatgagatgatgatccaacccgaggttgctgttcaagatgacagtatcaggagtccgcacttcagattactagatgaggagggactgctctttaattatcaggtgatgtttgcggggatg

SEQ ID NO: 690198 - DNA, 1050 bp, Homo sapiens
ggacgtactattgtctgactacaatattcaaacggagtctcctcttcatcttgtgtatgagacttcgtggtggtgctaacgaaaacggacacgaagaagtcttaaccacctcccaagaccgaatacacgcacacacgacgaccacgacaggttacagctggcctgtacctgaccactacttactacaccggtggactgacgaaactggccaaacttacgatcgcgcttcgatcgagacgtgcccctatcatgcactgacatggtgcgtgcatgggtgctgatattaatgggcacagctcacctttcgacccagaacacttactctgttgggcaccagtgatatggtccatgaccttataacgtggtgtcttcagccaacaaccccagcaacgcacaaacggtcacttgggtaattgacgcttcaacttacaccaaagtacccacatggcaagacgcacaaagcacacacagcccgaacaccacccaaacccaagaccaaacgaaaacacaaagcaaaacacccaaacccggcgcgcaccaagcaccgaccacgaccgacccaccgccgcgcgacacagcgcaaacacgacagacccacagaccgagcgcactcacacgaatccagccagacacacgggccggggggccgcgccgcgctggcactagctaaccgagatggaagacgcgcagtagcccgcacagaaggcacaagcaggacagcgtacagcccgacggcgcaagataccagcccaggggcaccgccgtcgggaaagcaagcgggagaaacggcacgcccgccgagaccgcccacacgcggcccccaacccccaccactcaactgcgagtcagccgccgccactccacacccacctcgctccactcctctatttaccctccctgaccccgggcgaccggcacactcgaccggacaaccccctagcgcctcgagagccgagccctagcgcccagcgagtagagcaagaggaacaagcccacccaacgcacccgcaaatggccgagccgggagccgcgaccacctccgcaccacca

SEQ ID NO: 690199 - DNA, 708 bp, Homo sapiens
aaatgtactagtaatttacaccgttaagctttagagaccgaattccattccaccagtttatcgacattagccatctgtaatttaaagaacaaaacaaacaaatcaaaagactgtcttggtagaggtcgtaatgagactcaacatgtactgccgttttcgcagtctatttatgacagtgtctttaagcagcaaatgagatagagtctaaaaaatgtcctgtcacttccattataagaagatctggattcatatctaagtgtatatgataatactgtaggcagttaagagtgcagaacaagtggtactgttgtctctaaatttaactcactttggtgtcttctgtgtactctagttcgaaacacacagtactagttttgagcatgatcgttgatttcttgatgaaatgctaatcttcagcccgtaccaaaaagtagagtggagcctctttgcactactactatcaataatagttgtgaaatcacgtctggatgtcttgtaacgcatttttttaataggctgacattagaagtaaaatctaaaaaagagttgtaacagaactggggcaagatactgagatatattactggtataatcacaatattttagtacgtacaccgtttatggactaagaaataattattgctaggaatgttgtcctgccatcagaagaaattatttgttcttgccaggttaggggattttgaagat

SEQ ID NO: 690200 - DNA, 865 bp, Homo sapiens
  misc_feature (54)..(55): n is a, c, g, or t
  misc_feature (634)..(634): n is a, c, g, or t
agcgggggggtgcggtgtacgaggcggtccagactataaaagcggctgccggannagcggccgtgcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggnctatgggctgggaagtggtgcaccagactgggcatcctcgggaaaaagccattggtctttaattcggcctttccttgcccgattgtttccaccattccaatccttcacgccattcctctagaaaagaagcgccgatgtgggccaaatatgatctgggaggctgtggacccaaaatcggggaaacgtgtgccaccagggtgtccaccaagacaggtctcgctgcaacatatg

SEQ ID NO: 690201 - DNA, 690 bp, Homo sapiens
agaggacccgaagtcaccgcgtatcaactccgtaagtgaggatttagcatcagacactacgcctcttttctagggcttatcaattcagaagctacacaaagtgtgcgctgtcatcattaatccactccattcatcactccgatacaggatcgccacggctctcgaagcgacggaatgaccgtttttggccgactctgtcgttcgtgaaggacagcaatcggccaacccgatacccagagctaaacccccggtatccggtacacaacagaatcatatttctccgccatccgcctctcgattaccactccccccaaagcttcggcaatacctcgactcgcaccattctgcgtcgcaacaggatagataaagtgcttcgccaccacccactggctagcccactgaacaaccgcccgcaccgcttcaccaccaaaccccagcccgtgtttatcttcacgaacccagatccccaactccggtgtttcactgccggtatggtgcagcccgaccaagccggtaaaacgagcacctacccgctccctgaccgtgaacacgatgtcgctgccatccgctatcgcaggcagtcactgcccccagacttgcgcgtactcttgcagcgaggcaggcggttcccaggacatgtagcgagtcagtgccggagtgatacaagcgaaagactcaacagggtcctgc

SEQ ID NO: 690202 - DNA, 881 bp, Homo sapiens
  misc_feature (54)..(55): n is a, c, g, or t
  misc_feature (516)..(516): n is a, c, g, or t
  misc_feature (540)..(541): n is a, c, g, or t
  misc_feature (545)..(545): n is a, c, g, or t
  misc_feature (553)..(553): n is a, c, g, or t
  misc_feature (649)..(649): n is a, c, g, or t
  misc_feature (659)..(659): n is a, c, g, or t
  misc_feature (664)..(664): n is a, c, g, or t
  misc_feature (666)..(666): n is a, c, g, or t
  misc_feature (697)..(697): n is a, c, g, or t
  misc_feature (724)..(724): n is a, c, g, or t
  misc_feature (726)..(726): n is a, c, g, or t
  misc_feature (728)..(728): n is a, c, g, or t
  misc_feature (733)..(733): n is a, c, g, or t
  misc_feature (737)..(737): n is a, c, g, or t
  misc_feature (746)..(746): n is a, c, g, or t
  misc_feature (753)..(753): n is a, c, g, or t
  misc_feature (756)..(756): n is a, c, g, or t
  misc_feature (814)..(814): n is a, c, g, or t
  misc_feature (873)..(873): n is a, c, g, or t
agcgggggggtgcggtgtacgaggcggtccagactataaaagcggctgccggannagcggccgtgcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagggngaaaggggggaggaggggaggggnncggngagggggnggggggggagtgcaagacagaatttcactgaacccactgctattcaagctcagggatggccagttgctctaagtgggggggggggggggggagtgncacagactgnatctntnaaaacattgtcttattttcttccttccattntccacatcaatcatcagccattcctanananaggcnatgngcctatttnttttgtnctngcaccaactcgggaactggcccaacaggtgcagcaagtagctgctgaatattgtagancatgtcgcttgaagtctacttgtatctacggtggtgctcctaagggacacaaatacgtnatttggta

SEQ ID NO: 690203 - DNA, 649 bp, Homo sapiens
ggtcggcagcggtacagcgaggtcggcagctggcacagcgaggtcggcagcggcacagcgaggtcgtgcagcggcacagcgaggtcggcagcggcacagctgaggtcggcagcggcagcgagtgtcggcagctggcacagcgaggtcgtgcagctgtgcagcggcggtcggacagcgtgctgcgctgctgtgcatcttcctgcggcactctgacatcatggctgaccacggccacgcatggcgacctcgtggctcgcgcgcggaaagcggctgctcacaagaggaacgacatgactcaacctgtggaattcgagaccagcgaggaggtggatgtgacccccacgttcgacaccatgggcctgcgggaaggacctgctgcgtgggcatctacgcttacggttttgaaaaaccatcacgcaatccaagcaaacgaggcaatcaagcagatcatcgaaagggagagatgtcatcgcacagtctcagtccggcacaggaaaaacagcaccttcagtatctcagtcctccaagtgttatggcatattcaggttcgtgaaaactcaaagctttgatcttgggtcccacaaggagagttggcgtgtgcaggatccaggaaagggggctgtttgctctcggtgaactaccattgaat

SEQ ID NO: 690204 - DNA, 274 bp, Homo sapiens
  misc_feature (48)..(48): n is a, c, g, or t
  misc_feature (78)..(78): n is a, c, g, or t
  misc_feature (85)..(85): n is a, c, g, or t
aggacagactgtgctcgacacttagaccgggatttggtaggccaagtntgctaagtgtacaatatattttttaattanacacctnaaacaaagaaatgtggtcactaaaaataaaagtatatatataggaattaatgtcctcttgctatagtcaagctgttagctatagttaccaaggtattcatgttactctaactctgcaaaagtgcatgtaatctggtagcaatgtagatattcaaataaaggcatttacataataaatttagggtagatg

SEQ ID NO: 690205 - DNA, 600 bp, Homo sapiens
cccagtagggactctgtgtgggggctcccacaccacatttcccttctgcactgccctagcagaggttctctcccctgccgctgagagggcctctcccctgcagcaaacttttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataaggggatgcctttaaaagcacccaagtcacctgttgaacaattttgctggttaaaaaatttctttccggccgt

SEQ ID NO: 690206 - DNA, 215 bp, Homo sapiens
  misc_feature (33)..(33): n is a, c, g, or t
  misc_feature (79)..(79): n is a, c, g, or t
  misc_feature (154)..(154): n is a, c, g, or t
  misc_feature (195)..(196): n is a, c, g, or t
atcgtagaacagaaaaagatactagtggaaaanctagagaaacctgaataaagtctgtatattagttgatagtattgtnccactgttaatgtcttagttttgataattatactatagttatgcaagatgctaacattaggagaagctggatganggatatgtcatagctccctgtactatttttcctatttcctnntaagtctaaaattattcca

SEQ ID NO: 690207 - DNA, 946 bp, Homo sapiens
agcgggctttcttgggaagatggcggctgtgtcggctgtatgctccaccagtctggaggctactctctctgataacgtgtccgtcgacggaatgccgctgcgtagcgtaagccgattttgcatcacgcaggcggatacaagcttccaaaggtccggagaaattgcgtgacgaccatcgctctggggtggctcatatacaggatggcatagtctcttggcaggcagataccacgcagctcactgcacagggatggctctgttgctcgaacaagaactgatcacgaaaatacactgtcatatctcctatatattctattgtttggtggtgctgggcacaggctgctgagcgacagcacaatggacgagacgcgcaagctccatttcctgtccaaaacttggtgaggctccactccctctccactgggccgtcgttccccagaagtggttgagcagttgcaaatcgggactgcgtgacatcagactgactttatcatgcgtactcgacgggttaccatttcggtgtcaagggcactagttttagcggggagtaggatgttactggaaccttcaccctctaacaggcaatctaatcctacaatggattcacactgactaaaggttgccttatgtcaccatggggttctggctccttggcagcaattggctgtatttgaagcataagtttaggccagacatggaggaggagggaagccaagaatctggtgaggcgaagccaatcgcaggctggcaatcttcaacgacctggggctcccgggagcaacattgacctctgcgtcatcagcaagaacagctggatttctccgcccatacacagtgcccaacaaagaaggggaccaaggcttggccggtacaggtgtgagaaagggactactgcagtcctcactgaagaaatactcctctggagattgagggtgctggagaaacg

SEQ ID NO: 690208 - DNA, 115 bp, Homo sapiens
aatgcattacgggagtggtgatgactctaaagcgagcattgctgcttcaagcatctgtattccaaaggcacattttggacccgccctgtgatccatttaaccctgtagttacggt

SEQ ID NO: 690209 - DNA, 110 bp, Homo sapiens
gctgcgttttgcgaggctgctagaactcatcaaaaagctatcagtgggagtagagttgaagtccttagagaggattatgatgcgaccgatagtgaccacgcaaactgggc

SEQ ID NO: 690210 - DNA, 862 bp, Homo sapiens
cgcagactacttacggctaggtacgaggctgggtggtgcgcggcatggcgctactagatgtatgcgcgagcccgctgaggcagcggcggaatcggctctcccgtgttgcgggaagcgggcgtcgatcggacccgaggacactacagtttctctatgcgatctccagagctcgtttgaccccggggaatgcagtccacagaattcttccatgtccctgggtggggactgacgaaaggaacgttcagatgagatggcccatggacctacccacgctcgccgttcaagttccagcatggagtgattgaatgctagtggattctcgggccttcagcctgggtccttacattagtgccttacgggtgaacaaggtgattgagattaacccgttacctgcattggtaccgatgtctggctgtgcatcagacgtgtcagtactggggagcagccttgcgtggtcagaggaaatgcaggctgtacatatctgtgaaatggagaacgtatttcagtgtcggaagtctccaagctgctgtccgaacatgattgtgccagtaccggggcgatggacctctctatgggcagtatgatctgtggctgggataacgaagggtcctgggactctactacgtggatgaccattgggactctgggtctcagtgcaagttttgttctccgactgggtcgtgggaacatcgttagtgcctacgggggtcttggcctgtgggtaatcgggctaatcttagcctgaagcaggctatgagcttggcgcaggggctattgcttatgcactcacggagacctgctattctggagggggtggtccatattgttccacttttagggaagatggtttgggttaaagtag

SEQ ID NO: 690211 - DNA, 1159 bp, Homo sapiens
  misc_feature (376)..(376): n is a, c, g, or t
gacataccattccctgagtccgatatgtctcgcttcgtgcacctataactagtgctcgactggcctaactcatctccttcctagtgcctgagagcgctcatcccatgagatcactccacataagcatctcaaggttctcaatctacgcttcaatccctaagtacgaaatcagatggtaaaagtctaaactttctctgcacacttcgctcatcgttgtctcgggtcttcattccgatcctgaccacttagaatgttcgacgttactgcacacccagattggcagtaagcaagccatctagtaacacaatgtatgcgcatgcatattactcaatacttatggtctcttatctcagacttaacggcacttagcgtcgtntatcttaatcatcttatgttaactttactcacatgatattcgaccaccccacttcgactaaacggataggacgtaattagacgcttgctcacgatgtattgtaaaacaacaatagaattgcacttctctagttacaaccacctgcgccaaatgattagatctaataaggtagtggcatccgcacggaaccacttgatcacagcccacaatctatcgcataggaaagcgctcgtgataaagcatagcccgctactattgtagaatatgggaagtgaacgtgtcccatcaatatcctgccctctgacatgcgtcgtgtttttccaaattactctgaactactgactgtttacctatcacctgtaacatcttgttacctgaccacccacaacacctgcttacgcgggtataataaaaataaacttggtctaaacaatgcgaccaattgactgcttcctgttctaatacatttcataacctattttgcaagctggctaggtcttccagtgttttttgactcgcttattcctcggaagcatgcgctttgcatcccaccagggctaagcctccataaggaggaggcttgtgcaaacctttagcaagggtgagggacgccagcaggaaatttcttcctttattcccaaacattccaaccattccttggcggcccaggatttgtgacacctccttccaaatcctccttggcacttccaacaggcttgttacgcaatagtttaacaccgttgcattaagttaactttccacattcacataacctgctctacc

SEQ ID NO: 690212 - DNA, 699 bp, Homo sapiens
ggctaggtacgaggcctgggttatcggccgaggccccccacctatgttgacctgaaccacctggtgtctgctaccatgagtggcggtcaccacctgcctgcgcttcccaggccagctcaagtgctgacctgcggaagctggctgtgaacatggtcccgttttccccgagcttgcccttcttcatgcccggctttgccccactgtaccagccggggcgagccagcagttaccgggcgctgaccgtgcccgagctcagccctagcagatgtttgatgccactgaaactttgatgtgcttgcctgcgacccccgccgtggccgcctaccttgtagcaggcttagcccgtccgctgatatcaagggggcctgacgatagtcctattggaatgcgaggtgcgtactgacgacaaatagcttgatatcgttccatatacactagataaatcaggcatctatttagtcgagtggatccccaacaatgtaacatacgtgctgtcttgtgacatccctaccttctgggggtctatgaaaatgtcctgccacctttcagttgtgccatcagcagcgtgccagtccagtgagctgttccaagcgcagtctccgaggcacgttcacggcgcactgtgccgggctgcaaggccttcctgtcactggttcacgtggcgagcgccattgtgcacgacatggagtccaccgaggc

SEQ ID NO: 690213 - DNA, 105 bp, Homo sapiens
tcatattcacatggacaataacaaatgcacttatggaacatacaccattagtgagtttggacagatatgcctggggggaaatttaaaaactggattaattttatg

SEQ ID NO: 690214 - DNA, 329 bp, Homo sapiens
agcctgatttaggccctgctttatcccggggcttcccccctgaaattaataaaacttatttgggtcccttgaaacttggttccccgaaaacccctttttggtttataatccccttttatgcccccccgcccttaattatctacccctgatgaggggtttaaactgggtagcacaaacacgaggcccccccttttgggaaattttaaaggaagaacccctttttaatgagatgaaaatatttaccgaattttaaaagctaatgcccattttgagaaaaggtttggggggtatattgctatgtaatttaataacctgattttttggatata

SEQ ID NO: 690215 - DNA, 990 bp, Homo sapiens
agcggagtcgcctgcgccaaccagcttctcaagcttgtagtcgtgtcgctcgcctggggtactccgctgggcggcgacgggcgcgtgggggagggggttcgggccgccacccgcgagcagaggacgcagagatgtgctgcacagcaggaagggcccgcgggctacggaggccagcaggcccctcgaggcgagtgatggggccgagtcgattcgacgcgggacatagcagggcaccgtgcgccaggtggctcttccgagcgggaccacgcgactggcaggcgcccgtgagaaggaggctccagtgcagggtcgggtctgcgctggcggtcggccgctgtagggtgctggccggaccgggcttggactgtggactgggggggcagatgagcgactgaggaggcgcgctcggtcaccccgaatccggcggtgttcctccggcctactcgtattccgtacacactgctacgtcgacctacgttcagttgtagcccttgaacggtgtggaacgggggcgaaaatggttgatagcaaaaagttaacatatggacgcgacttgtcgtcaaattggcacacgaacattagcaacgagatgcgtggacatgtggcaggcagctacaaagggactccccgcgagagacagagccttacccgtgggtccttgagacccacgcgcccttgaaagcggcccccagacaagcggtttcgttagaagacactcacgaatggggtgcatcgatgtgccatctgggcctgacatgtgccgtcacgacgcgtgtggaagacagaaagtctcggctcttcgccagttgtacccccagatggaacatggaaagggcaagcaactcccatttagaagcgtgacgtgtgtgaagttcgcacatgggtggggacacgaaggcaccccaaaggaaaactaacagtatgccgtcccccacattcctgattctggttggcaattaacctggggctcctggggcgatttaaccgtga

SEQ ID NO: 690216 - DNA, 320 bp, Homo sapiens
  misc_feature (218)..(218): n is a, c, g, or t
  misc_feature (261)..(261): n is a, c, g, or t
gaaccactgaagataaagattatgtatatatgtatttaaagggatttattatagggatctgaccgcatgccattgtgggagctggttaaacagtctctgtaaggctgttgtctttgcatctaatgctggagcttgaagtctgcagggcaggcactagggaagggaagatggatgtaaagtgtgggagaccgaggacacagtggagcccacgagcacgngctggaacccacgaggatggcctggaacccatgtcagtctctnaccacctccagcttcgatgatgtgggtgtcctgcagaagaagctggtgcccttcctcac

SEQ ID NO: 690217 - DNA, 129 bp, Homo sapiens
tggtaccggatgggcgacatttcaagattattgtgtttaaggccaggcgcaggggctcacaccggtaatcccagcacttggagaggttgaggcgggcggattgcctgaggtcaggagttcgagaccagc

SEQ ID NO: 690218 - DNA, 425 bp, Homo sapiens
ttaaatttattaataccacctccttggttcatcaccaacataccctacatcatcaaggggctgggggtgttttttggtttggtttttacctggcttgcatgcaaaggacagggatccatggattagggaacaacggatgaaaaagcccccctcatttgaacctaaacattgcctttgcttggtgaaaaaactgtgttaactgtcctgacctggacgattacgtggggaaaccccccccccccttgcaggcttgttgcctgtttaaaaaaggaaaaaaacccggcgctggcaagtgataggaaccttttggcccaaggttaaaaagcaggcttacatggctggcccttaagctttataaaatcatgtgggctttgaaattgtttttttatgggtttagcaaggatttaataaacccctgtatagta

SEQ ID NO: 690219 - DNA, 804 bp, Homo sapiens
  misc_feature (517)..(517): n is a, c, g, or t
  misc_feature (525)..(525): n is a, c, g, or t
  misc_feature (529)..(529): n is a, c, g, or t
  misc_feature (571)..(572): n is a, c, g, or t
  misc_feature (579)..(579): n is a, c, g, or t
  misc_feature (602)..(603): n is a, c, g, or t
  misc_feature (611)..(612): n is a, c, g, or t
  misc_feature (631)..(631): n is a, c, g, or t
  misc_feature (666)..(667): n is a, c, g, or t
  misc_feature (681)..(681): n is a, c, g, or t
  misc_feature (713)..(713): n is a, c, g, or t
  misc_feature (724)..(724): n is a, c, g, or t
  misc_feature (756)..(756): n is a, c, g, or t
  misc_feature (804)..(804): n is a, c, g, or t
ccgccgctctccgaggctcctgaaagttgcaacctctccctctcggcgaatttgggggtttctgaagcgcgcgaggtaaaccaaggttttgctcatggctcgtactaagcagaccgcccgtaagtccactggaggaaaggctcccaggaagcagctagccaccaaggctgcccgtaagtctgctcccaccactggaggagtgaagaagcctcaccgttaccgccctggaactgttgctcttcgtgagatccgcaagtaccaaaagagcacggagctgctcatcaggaagcttccattccagaggcttgttagggagattgcccaggacttcaagactgacctccgcttccagagccatgcggtgctggcccttcaggaggctgcagaggcctacctggtcggtctcttcgaggacaccaacctgtgcgccatccatgccaagcgggtgaccatcatgcccaaggacattcagctggctaggaggatccgtggcgagagggcttaaggtggctggtgnccttgccnttgncctggtgggcgaaaattcgctcctgggggctgggccattctnngtgtctngcgttttggcgctggcgtgaacnnacttatcnnatgtgtccgtggggaaacntacttaattactgggtccgtgtgtacgtaatggtnncagctagcgttacntcctggttggcccaattacttaatggcttccngggctagaagncgtggggaatccacttttcggtttcccggtanagggatccggttcttttaacattcaattccaaccctggcgtgggagan

SEQ ID NO: 690220 - DNA, 398 bp, Homo sapiens
cccaggtgggagtgcagggctcagtctggactcacggcaacctctacctcccaggttcaagtgattcttgtgcctcagctacctgagtagctgggattacaggtgcgcaccaacatgcccggctactttatgtatttttagtagagatggggtttcatcgtattggtcaggcgggcctcgaacttctgacctcaggtgattctcctgccttggcctcccaaagtgctcacaggcatgagctaccgtgccggccaggaatcttttatgtgcaacgttgtcagctgttaatgctcctatttatgaataggtcaccttggtttgaaaaaagcgtacaaggttttctaactccaaatctttccagccacaatatggctacgttaagcagaacaccgtcgaag

SEQ ID NO: 690221 - DNA, 215 bp, Homo sapiens
gggtagtcgggaggaacatgaaagtgatatgcttcttagatacatctagctggttgtaacctacttggtgctgagtggggcctccttgctctggagggggtcttcgtccatccttggtgggggggggtgcctcagccccttttcaggcctaagaaccgtctctaagagggtcaggagaactgggtccgccgctaggacagtgtattacaccccgt

SEQ ID NO: 690222 - DNA, 222 bp, Homo sapiens
gagtcaggatatatctctggcacagatactcggaatccactattctctacaaatcaaatgaacagatggtaaggatgtatccatctaggctttcatctaactacagggccatcctatcttcgccaagaagaagctaacagatttactgcaagcaaaataaggccttccttagaaaataacttctaggtcctcaggaacaaatgatgattagatccccaagtt

SEQ ID NO: 690223 - DNA, 444 bp, Homo sapiens
ttatctattgaacatactactaaaagaaagttactatttatgataatccgtttactgcatagaacatctgtcggacttttgctattaatcattttcatattcttcctatggtcctctctgttcacagaaatatcatctttgtaaacaatcttgtgtgagtacttaataaatcataatattgattcatttgaccatattaccataatcaccaattttaacagtctcctacattttttctatatcacttttcttgattaccatatgtctgtaataagaacacgctctttatataacagaatatttaattacatcagtttcccatgaacacaccagagtcacttaataattatattggccatttccactgatcggcaggaggctcttccactaatggctcccatagtttccattccctcatttttcttgccagatttagttcatgtc

SEQ ID NO: 690224 - DNA, 177 bp, Homo sapiens
gattcgaggatgtcagatgtaatgtatctgcctcctataagaaattctgggcatattataatagacatatctcagaagattgtgattgccttcatgttgtggagcccatgcctgttccgggggcctaatgtagaagcatactgtctacgctgtgaatgcaaatatgagggaagaagc

SEQ ID NO: 690225 - DNA, 797 bp, Homo sapiens
ggtactcaggcgactgaggtaggagaatcacttgagcccaggaggcggaggttgcggtaagccaagatcgcgccacggcactccagcctaggcaacagagcaagactccatctcaaaaaaaaaaaaaattgctgaattccaggtgggggggtttggcttgggttgaaattccagtttttacccagggttggtcggtagaaaaggggaggaatatttggatccgggtaagtgtgacttaattttccttggatacttataccaaacgtcatagttccttaaagcttagctggggccaggtacaggggcttcacaccttgtaatcccagcacttggcgagcgccgaggcaggcagatcatggggaccccaggaggttcaaggaccagcctggggcaacttggatggagactctggtctggtgccaaaaaattccaaaatattaggctggggcatgggtggagtcatggcctggtaatcggtagcacttgtggaaggccgaggcgggtggatcgcctgagctcaggagtccgagaccagttggggtaacacagtgaaaccccgtttctactgaattaccaaaaatttagcaggccgtggcatgtgcctataaatcccgggctatcggggaaggctgaaggcaggacgcattggcttgagccccgggaggccagagttttgcattgaagcccgagattggtgtaacctggtttccccagcctggggcgaccgaaaacacaaaacacaaaacaaacacacaacccttttggggcccgctctcgggcctcaaaaattttaaacc

SEQ ID NO: 690226 - DNA, 309 bp, Homo sapiens
gtaataatatgtatctatgtaatgtgaaaaataacagagaagcaatgtggtacatggaaagacagaggctttgaattttaaaagatttgaatttaagctttttggatttgaatttaagctctgtttctttctttctttttttttggagacagggtctactctgatgtccaggttacccattctgtggccactgcagcctcgacttcccaggctcaggtgatgctcccacctcagcctcacaagtagccaggactacaggctctcaccaccacgcccgtctaatttttggtggtcccttcttgtactagg

SEQ ID NO: 690227 - DNA, 334 bp, Homo sapiens
agatcgcagaggcttttcttcaagattctcagtcagagattcctctgcagcctgtgtgtgtcaccattggtgacctgcggcagtatgtacttcagtgcacctactgcttactgttgctttaggcactaattgctttctgggtttgaaagatgcagtggttcccccccctcccgaatccctttctacatgatgccctcctgaccatgaagccgaaccagagagagattttttcccaattggctctgtgactggcatctaactttatgatagggagggtactacccaggggactttagggagtgacagccccttatttgtacctaaccccttgacc

SEQ ID NO: 690228 - DNA, 428 bp, Homo sapiens
  misc_feature (374)..(374): n is a, c, g, or t
caggtctcgctctgttgccccaggcctggagtgcagtggccacaatcacagctcactgcagcgtcaaactcctgggctttaagggaatcttcccaccttggccttccatatagctaggactacaggcatgcaccaccatacctggctaatttttaaatttttggtagagatagggtctcgctgtattgcccaggctggtctagaactcgtgggctcaagcaatcctcctgcctcggcctcccaaagtgttgggattacaggtgtgagccatggtgcccagccaacaaattttccatgaagccaaatggtaaatattttatctttgcaagccctgtggtctctgtcacaaccacgcatctctgctgtggcaaaanatcaccttaggctgcacaggtgggtgtggctgcgttccagtgaagcttgattca

SEQ ID NO: 690229 - DNA, 503 bp, Homo sapiens
taaatacaaggagggggctataaacacccagtacagacatatccacaaggtcgtaaatgcttgctaaaaaaatagggctggatcttatcatgccctgttccccttgttctctgtgccagatcttcagttgccccgtgccatacagggattctttttctcatagagtaattcatatgaccagtttttatgacctcctttgggtctgaaatacttttggacacagaattcctttttttttaaaaaaaaacagagatgggggtcttactaatgttgcccaggctggttgtcgaactccggggctcaagcgatccttctgcctgggcctcccgaagtgcaggggatggcagcgcataaagcataccatgcggggcctgacccataatctcaagaggaggatttataaaaccatatcggtaaccacactgatggggcgtacatagttcccattttggccccaagtggtagtcatccaccttaaagcagaaaaacaaaaaaacagggga

SEQ ID NO: 690230 - DNA, 1452 bp, Homo sapiens
  misc_feature (696)..(696): n is a, c, g, or t
ctacttgtggtcctttataatgagggtcctgctttgttgggaggaagaggtgtgcgcccccccctgtcgtcaagcattgtgtgtgttataaactagcacccaccgacaggaaagtaagggtggtgtgtgcctctacagtaaagcacgctcggcacacaaaagaatttattaaggggcgcggcccgcctctcccttttgtgggccaccaacaaggaatgggtggttgcctacaaagaaggcccgccctctttggtgtgtgattatgctcctcgccctcctcattggtggcccgccatgacagatttatttcctccgcgctggctgtccatacaaagtgagtgtgtttgttcgtactaagccgccgcatgtggcgccccccaccggagggtccctctccttcttataggagagtgtttcgccgcctgcaggctcctccagcatcgttgatgaagtggggggggctccccccccggcttggcgtggttatttacctgtctcctgtttgtgtgtgctccgtctcccttgtttcttttctcgatgccaggcgtcctgtgacgtgcgttgtgcacacctcttctctgcgcaacagaagagttgttgtcccccctcatcaccgcccctcatatagaagagagaaaattggtggtaataccccaccacccctctggaggacaccacaggttgctctccttctcngcggtgggagagatttcttcggagcagagaagagagagagagagagatttggggggtgataaaggctcacagcagcattagtcacctcttcaccagcgctctgttatgatctcatcatctcatagagaagggggagagactctttttgcgtgttgtggatatagagattccccccctctgggtgtgtgttctttccccaccaaccacccccctccgaagatcatctagggtgtggagcaccacagagaggctctcacaaacagagagggcccctctctctctgatacgcgcgctcatagcgcgagagagtgtagagatatagagagacacatctctcgagctcttgcgacacaccacacatagagtgttctctgtttcggagacacacacgagacacaatattctctcaaggctatatagagagagatagttcctcacacacacactccacagagaatatgtggagagcggcgcacacacactcttctatatcacacagagagtttaaactctttgtgacaccacagggagacacacaattctccacaactgagatccacatcacactcacatgtaaggctatagcctgttatgagagccttgcacaacctttaataagcccgacagcgtgccccacatgccaactgtgagaagtaacccaaactggtttttgggttttttttccccctccagttttaaaggttaagggtaaaggattttaaccccttaattaaataaaaccttggttttccagga

SEQ ID NO: 690231 - DNA, 1710 bp, Homo sapiens
aagtcgttaacaaagaacagttgcatgttactgaaagaaagggtgtccaggccttactcatcgaagtggtggaaaccccaaaatatgtagactgacgaagcgattttgccaactgctatgttcgagagttattatcgagtgttggaagatgacgatcacgatcagagaattctaggacgagagtggtagtgtacgtggaatcgattcgtccatcttaggaaatggtgtgttctgtgatgttggttgagcatcgttccttgcaatggactggtaatctaggaaacatgccatgttacatccttttgtaccagagttctcagcaggaccgcaaaaccagtgcctagcaactcattggactgtgcctctcattctgaaccgttgtagacgcgctgtacgttgactagcacattagaatagtcagagcgatgagacacggctagcacgaaacggtgcagcaatactgtggagtgtagtcgactcttagcagagctactacaagggcctaacgcgagcagctagacaatgttaattgtgcacgcgatagttcgtaccagccccaagagggttgacctgtgcatataactatcacgttcctgcccgtgggtgaaataagagtgatagggccaaagctccttggaccaacgggccactggagtacgacacttcttccgccacccttacggacatattcacacgcacatatgtggacgcgtccttactggtttgaatccattgctacaacattccacctttggtacaccgttagcgcgaggacggacaagttcggcgacctatctgttcaccgttcggagaggcttgaaagagcccccagttttaaccaatttccacttggttatgtaacatcactttttgagcgccgtaatcccgtggtgacgtcggcgcgaacaaacatgtggaccataacgtatataaaaccgttaaagaaatatggcacgtccttgggcaaagaaaccttttaaatcaaccctttaatggaacagtttggccccccaataattatgcttttgtgtccaaacccctactgaggacagcggcccagaaagggttcccacacgattcaacacacaggcaccactggactttcgttggcacaagacaacaagacgcataaatttcggaaaccacacgttttgtcacacagcttgtggacacaatgtttccatcaacaacaggaacacgaggcgcaactcgcagcggagaatctgacgaaaccctttaaatagttggaaacgtaaccaacactgtatgatttgggtgccgggcattctggataacaccattacacaaacacgcccaatgaaaggatatataccggcgcatttttaaccatctggcacaagccaattgttttctgccacatcaaggggagatggaattggagaaccccgaggggacttgagtccccaacaagaggaccagggttccccacgtggggccaagcgtgtagacccgctggacacaccatcgaaagacacggcgggaccaaacagtcagagagagatacaacagacaatctgccacgagaagcgcagagcagaaaaaagcggcgattcacaggacgatcactgatgacagaacaagcgagtcgatcatctcacaccacgatgagcacgagggacgaatcgaaaatgagaagcacaccagaaagacagacacatgagacacatcgagcgcagcacgaccgatcaa

SEQ ID NO: 690232 - DNA, 172 bp, Homo sapiens
cccttcccggatgatataattttatactcaaaaagccctaaagactcccccaaaaagctcctggaactgataaataacttcagtaaagtttcagaatacaaaatcagtagcattttttaacatttgagagtcaaaccaagaacccaatcccattttcaatagctaaaactga

SEQ ID NO: 690233 - DNA, 530 bp, Homo sapiens
taagccaaaccatatacccaaataaagtataggcgatattatagaattctggcgctttagatatagtaccgcaagggaaagatgaaaaataataaccaagcataatatagcaaggactaacccctaatacctatctagcataatagaataaactaagaactaactaagcaaggagagccaaagctaaagacccccgaaaccagacgagctacctaagaacagctaaaaagagcacacccgtctatgtagcaaaatagtagggaagatatataaggaagaggcgacaaacctaaccgagcctaggtagataagctaggtagtaccaacgactagaatctaaaatatcaaactaatacaatattagcactcacagaaaccctactacaaatacctcctatagtaaacatattaaactatgtaaagtaccatacagagcgacacacgctactgaaagagacatctaacggaaacaaaatactatagttaagatgacgagtaaacaacaattataagcagcccataagcacgga

SEQ ID NO: 690234 - DNA, 1678 bp, Homo sapiens
  misc_feature (976)..(976): n is a, c, g, or t
ggtgctgtggactaccatgtatctctcgctgctgggtgtctgcatgggctgtcggcctggaccttgccagccgcaatggcattccaagttcgcaccacatcatggcacacttttgcaaagatcatccaccatggagcactcaaagtcccatcaaaaacacatcccagcaacaattcacccacagtctcatggcaacacattgtgtcagctggcaagccaacacacatcatcgccctgcagctcgcagcagcagcagcatgacaaaccaaggctctgcaacatcatcatcgtgcatatcggggaatcatattcagcgtacttgttcatggaacacacatgcttgcatcatccacatggagagcccttgcaagcaacacagcacagcacaaacacctcacattcatttgagtagttgtccctcaaagcatcacgagcgcacgttgtgtagtgttggctatttccatttcactccccatttcgctcacacacaaggaatgcaacacagcctgcagggtgtgggctaacaacttcacacccatgccatgccttgtgcgcaacagccaaggttcatcggcattcgttagtggcgcacatcttggggtacggaccaccaacatcccaccagtggcacttcaccttttcaattcacgcgcaactccagatatacgtgcacccacagttcttccttggattggcgccaataccacaggaccggcacactgttgcgaggaccggacacaaggcccccccaccccacacgtatagagggtgccggacttggcggttccacgaatccaacatctgcgaccctttgggacactttaactttacaaaataaccttggggaactagttggacacgcttctcgcatccgacagggcactcccccagtccaatctccgtatcgacactaaccaacatacccacggggtactaggatcacatatcatcccctagatgtaagcacccagacaangtaaacacaaagtcgccgccacatactaatattcaccaccaatataacttacccgcgcagtatcgctcagttgtgcctttcaactaaacaaattacgctatatactatatagtaccgacactactatggcaatcgtaccattcagacgtatgtccgtcacccaattatccacacacgacaacctacacacactctgtgctaaccaaccaacactagtctcttcactacattcactcaaacagtatgatctccacaacacactacataacacacagtacccacccgatcatcccaactcctgtccatatgacataccagacacgtctaattccattagctttccaatactactctaaacaactcacatctaccagacagacggcctatcgacagacaatgagccacagaactcacgaggcgtggaagcgacgatcacacgacgcatatacgacgaacgagcaaagagagacgcgagcaagagagaataaatccgcatgctcgctaccactcacaacagtcaaacagcgaaaagcaacgcagaccacacaacaacagcagctgaagggcgcattgagacgcaccatactcccatgcacgccacggcaactcaccagctgcaatgacaggcaagcagaacgcagaagcagagggaccgaaacagaagcagcggaggacagcgcagacggcgagcgccgcgcacga

SEQ ID NO: 690235 - DNA, 381 bp, Homo sapiens
  misc_feature (16)..(16): n is a, c, g, or t
tcatactccttatgcncatccctccttatgctcatccctccttatgctcatccctccttatgctcgatccctccttatgctcatccctccttatgctcatccctccttatgctcatccctccttatgctcatccctccttatgctcatccctccttatgctcatccctccttatgctcatccctccttatgctcatccctccttatgctcatccctccttatgctcatccctccttatgctcactaccaccttcactcacagaccacaccttcgccaaaccattccacccaaataacgtcatcggcgatagaaatagaaacctggcgcaatagatatagatacgcaagagacagatgaaaaaattataaccaagcatcata

SEQ ID NO: 690236 - DNA, 333 bp, Homo sapiens
  misc_feature (16)..(16): n is a, c, g, or t
tcatactccttatgcncatccctccttatgctcatccctccttatgctcatccctccttatgctcgatccctccttatgctcatccctccttatgctcatccctccttatgctcatccctccttatgctcatccctccttatgctcatccctccttatgctcatccctccttatgctcatccctccttatgctcatccctcctttatataaatgcgtaggggttttatgttaaattgtcctttgacgtatacttgaggagtgtgacgggtgttgtgtacgcgcttcagggccctgtacaactacagcactctactctccgtatactgctaaat

SEQ ID NO: 690237 - DNA, 263 bp, Homo sapiens
cccttaacggttctgacagaaacgaggctaagtcaccccttcagcatcgacgtctttaaggattacatctatgtgttcaacttacttcaataatcgtgtcttcaagatccagtaagtttggccacagcccttggtcaacctgacagggggcctgagccacgcctcttacgtgctcctttaccatcagcacaagcagcccgaagtgaccaacccatgtaaccgctagaaatgcgagtggctctgcttgctgagccccagtgggc

SEQ ID NO: 690238 - DNA, 216 bp, Homo sapiens
cagacatttgcgatggcagtcatttaaaaacgaaacaaaacacactgattacaacaatcaagcagaagctggtatattagaataagtgcgtacaggccgggagcggtggctcatgtctgtaatcccagacactttgggaggccaaggtgggtagatcatgaagtcaggagtttgagaacagcctgaacatggtgaaaccctgcagggacccactcg

SEQ ID NO: 690239 - DNA, 201 bp, Homo sapiens
agttcctggtccccactaagtagaataaagaaaaacggttataaataaaaaaaaaaaaaaaaaaaaaaaaaaaaaaaaaaaaggggggtgttgttcccctccccctctgaaaaccactattttaccggggggtgttcctttctttaagagaggggggagttgcccccacacaacaagaataagagcaaatttaactccagg

SEQ ID NO: 690240 - DNA, 164 bp, Homo sapiens
gtatccccaccaggctgggccccagtattacgacttcataatacactgcctgtcatctgatcagcatatactgacttgtagccattaagtaacttacttcttatgttgctctattagtatgttgtaattgtcttctttaaattttgatttttcactgacggtga

SEQ ID NO: 690241 - DNA, 344 bp, Homo sapiens
  misc_feature (334)..(334): n is a, c, g, or t
aagcatgtgcaaacatgcccggctaatttttgtatgcttttgtggagacaggctttgccatgtttgccaggttggtctctaagtgatccacccgccccagcactttgggaggctgagttgggtggatcacctgacatcaggagtttgagactagcctggccaacatagcaataccctgtctcaaagatacaaaaattacccaggcttggtggtgtgtgtctgtagtcccagctactcaggaggctgaggcgggagaatcgcttgagcctgggcggcaaaggttgcagtgagccgagaccatgccactgcactccagcctgggtgacagagtganctccgtctgg

SEQ ID NO: 690242 - DNA, 1121 bp, Homo sapiens
  misc_feature (353)..(353): n is a, c, g, or t
  misc_feature (952)..(952): n is a, c, g, or t
  misc_feature (998)..(998): n is a, c, g, or t
  misc_feature (1028)..(1028): n is a, c, g, or t
  misc_feature (1048)..(1048): n is a, c, g, or t
cggcacgaggagctcaccacctacaacatgctcctgaaaccccccctgtaacagctgaacattgtgctcatagactctgtgctgagtatcatttcagcacttccagaggataagggagtagacctcatatgtcctggagaaggccttcctcagtacccatgccaacactgaaactgtgtttgaagcctttctgctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatnccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttgcggaggatgttaaaaagttgtaccactcagaagccttcacgtgtcaacttcggggacaccgaagaggccaagaaacagatcaacgattacgtggagaaagggtactcaaggggaaaattcgtggattgggtccaaggagcttgacagacgacacagtttgtgctctggtgaatgacatcttctttcaaaggcaaatgggagagaccctttgacagtcaaggacaccgaggaagaggacttccacgtggnccaggtgaccaccgtgaaggtgcctatgattgaagcgtttaaggcntgttaacatccagcactgtaagaagctgtncagctgggtgctgtgatganatactgggcaatgccacgcatcttcttcctgcctgatgaggggaaatacagcacctggaaaatgaatcaccag

SEQ ID NO: 690243 - DNA, 604 bp, Homo sapiens
ccagtatacttgtgcgagatgagtgaagcagattactcaaatgtattacttgatataggaaaagagtagaacttgtgcatattaactttgaaacgggaatgtggtcaggttccggggagtggtatcttatctgactagcccaggttgagcctaacgtaaccaaaagttcagtagcaagtcgcgttcggctgggcacatcgctgtcgcggctgctgctagtggtggtgggagtgggaaggataggaggattttatattcaaagcccagactatagtattatgtcttcggaaaaatggaaaggaaccttcctgcccctatagggatgacataatcagtatcatggcaaggagctctgggccccacatggtcttgtgagccaggggaagtccggattgctttggctgagagtgagcgtagtagagcactgccgtatgcatggaccggatcatatggttgcaccttcgggaggtctacaagaacagtagattatctcatgtcagaagagacttgagtgcatgtctgccctgtcctcatgacatggcatcggttacctggacagatactctgatgcgcctcggatgtctgtccacataaatgcaggggt

SEQ ID NO: 690244 - DNA, 1037 bp, Homo sapiens
  misc_feature (353)..(353): n is a, c, g, or t
  misc_feature (868)..(868): n is a, c, g, or t
  misc_feature (914)..(914): n is a, c, g, or t
  misc_feature (944)..(944): n is a, c, g, or t
  misc_feature (964)..(964): n is a, c, g, or t
cggcacgaggagctcaccacctacaacatgctcctgaaaccccccctgtaacagctgaacattgtgctcatagactctgtgctgagtatcatttcagcacttccagaggataagggagtagacctcatatgtcctggagaaggccttcctcagtacccatgccaacactgaaactgtgtttgaagcctttctgctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatnccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgtcctccgtaccctcaaccagccagacagccagctccagctgaccaccggcaatggcctgttcctcagcgagggcctgaagctagtggataagtttgcggaggatgttaaaaagttgtaccactcagaagccttcacgtgtcaacttcggggacaccgaagaggccaagaaacagatcaacgattacgtggagaaagggtactcaaggggaaaattcgtggattgggtccaaggagcttgacagacgacacagtttgtgctctggtgaatgacatcttctttcaaaggcaaatgggagagaccctttgacagtcaaggacaccgaggaagaggacttccacgtggnccaggtgaccaccgtgaaggtgcctatgattgaagcgtttaaggcntgttaacatccagcactgtaagaagctgtncagctgggtgctgtgatganatactgggcaatgccacgcatcttcttcctgcctgatgaggggaaatacagcacctggaaaatgaatcaccag

SEQ ID NO: 690245 - DNA, 393 bp, Homo sapiens
ggtgcacagcgtgtaattaccttgagaatgggaattcctggatcaatgcgacctctcattcaagaaatgctgtagaattctgaaggacatgagacccttgagcccaaggtcaagtgggaacacagcagagcacaggcctagcgatcttacccagattagaggaaaacagtggggtcaggcagtcaccacttgtgcaataagacattttctaggtactctaaacatttcccagaacctctagattcaggagttaaaatgcgagaacatttttactggtggttagattttggactggaaagatatttctcaagaaggagccagaaggtttcatatgtgtcaatatatatactcctcactgtgtgacttacctagagataccaactttttcatttt

SEQ ID NO: 690246 - DNA, 820 bp, Homo sapiens
  misc_feature (353)..(353): n is a, c, g, or t
cggcacgaggagctcaccacctacaacatgctcctgaaaccccccctgtaacagctgaacattgtgctcatagactctgtgctgagtatcatttcagcacttccagaggataagggagtagacctcatatgtcctggagaaggccttcctcagtacccatgccaacactgaaactgtgtttgaagcctttctgctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatnccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcaccatggagtcctgcagggcctgaatcttagcctcacggatattccggcagctcggatacatgatagcttccaggacctgctacgacggtgaaccagccggagagccagctgcatcttaccaccggagatggcctgttgctcaccgatggcctgctagtggatgggttcttggaggatgtcgaacgctttgcctgtggacgccttaactgtccggtacgggggtggctagaacctgctcagggggacgcgggtccacacagagagggggacgactcgggggagctctgccc

SEQ ID NO: 690247 - DNA, 182 bp, Homo sapiens
caccacagggggatggacacactaaaggcgatggacacacgaatggggatggacacaccaagggggatggacacacaaagggggatggacactcaaagggggatggacacacaaggggggatggacacacgaagggggatggactcacaaagggggatggacacacaaagggggatggacac

SEQ ID NO: 690248 - DNA, 335 bp, Homo sapiens
ggaactcgaatgccattctttccactctcatttgccacgtgattgtggggtggaatttttatcttttttctccctactgtgcatactgatttaattttaccaaatgtagacaaatttctttggccaccattggtttggccaccattggttcttccatccattttttttctggggtgaggtttgatcttagtgaagcctagtccaggttatgggtcttactgtgtgagctgctgaccagagtatcagtatcgcctgagagcttggtggtgcaaggtttcaagtcctaccccagacctactgaatcagcctctgggggtgggacaccgtctttgttt

SEQ ID NO: 690249 - DNA, 938 bp, Homo sapiens
tgggcaaggatgccctcttcacaattctccatgacctccgtacccctaggaccggttttcagtatcattggatttgccaagccggatcaaagtatgttgaaggaccacttgatatcagtcactcctagtacagtcatcaggtatggtgaaagtgtacattcgaccatgatgtcacccactgtgaggtgcacagacatcaacggggccctgctagagggccatcaggctcctcaacaagtacgtggcccacagtggcacttggacgacccggagcgtgtccctcatcgtcttcctgacggatgggaagcccacggtcggggagacgcacaccctcaagatcctcaacaacgagccgagaggccgccgaggccaagtctgcatcttcaccattggcatcggcaacgaggtggacttcagtgctgctggagaaactgtcgttggagaactgtggccgtctacgacggcgcgtgtcacggaggatggagggacgctaggctcgcagctcatcgggttctacgatgaaatcaggaccccgtcctctctgaccatccggatcgattatccccccagctcagtggtgcaggcacaagaccctgttcccaactacttcaacggtcggagatcatcattgcggggacctgggtggaccaggaagctgggatcacctgcagcagtggagtgtcaccgggcagcacagtaaggaatgcatcatcctgaagagcaagaatggtgcctgtgcgggcctcgaagcggacacgatgtcccaggaagcgccaggctgagggctgaaaaggggcccaccacatggggcttcggggtcccacgcaagggcggggccggggaaggaagacggcaaagacgcgagaggcacacgcagaagacggtcaacctaacaaagggggcccctacacgagccgtgttgcacaggaggaggcggc

SEQ ID NO: 690250 - DNA, 436 bp, Homo sapiens
  misc_feature (3)..(3): n is a, c, g, or t
  misc_feature (39)..(39): n is a, c, g, or t
  misc_feature (57)..(57): n is a, c, g, or t
  misc_feature (112)..(112): n is a, c, g, or t
  misc_feature (155)..(155): n is a, c, g, or t
  misc_feature (425)..(425): n is a, c, g, or t
  misc_feature (430)..(430): n is a, c, g, or t
cantgtggtaagttttgaagttcgcaaagtgtaagaacncccattgttattgttttnccaagattgttttgtcctgttttgggtcattataatttaggatcactttgttatnaccctgcaaagaagcccaggggagattttgatagtgattgccntaagtcctgtaaatcaattagggaatattgccatctgaacaatgttaagtctttcaatcaatgaacattgaatttatttccatttatttaggttgtctttagtttcttttgacaacattttgtacttttccatatacaagtctggcatttgttttgttaaatttattcccaagattgtttttctttttgataccattgtaaatggaatcattttcttaagttcatttcagattgttaatttctactataaagaaatacaattgattttgnatatngatatt

SEQ ID NO: 690251 - DNA, 835 bp, Homo sapiens
  misc_feature (1)..(1): n is a, c, g, or t
nacgtagggtgagggggggagggagtaggagagcacgcccagcgttttggtccgtgtttcgtgaacccctggttaacgcctttgttacgcgcgttttttgccgcgccccgtcccctgggagtgcacgagaattgtttattccgacccactatttgggtgcccaaaacctaaagggttcccaaaggtcggcaaattgtgcctgacaggatgtgcaaattttggccaaaaacagtttggccggtgtttggccaagctatgccagaaaggggttgcccgtcgtcgcgacaacggcgcgattgttacggggcccctccccgcaagggtggtcccctgattcaggggcctgggtccgcacccgtggctgttggccctgcccgtcaccacatggcgctgggtcaccctgcgggaaatataggagcggcggtgccccagcgacacacggggggcgtggtcccattgggggaccactgtgcgtgtgcgcctcggttaaagttgcgtttcgcttgtcgagacacgccaagccaagtctgtgtgaaacagggggcgtcagcatctaggtcgagaatgggcgccctcgcccctatgcgtctgtaagattcccgctctccgagaccgcgggttcagaatccccagtcctgtcccccatatttgtttctatcaccatggctggtcaccaccagaacaatttggctttttttggatatccggcatcttgctaatctgtctaacccccgatgacattctcgctatgcgcccccagttgctcccgccgacagcgaccacccaatgacacagttctctcccaccaaaaaaatcaatttccccccaaaaatac

SEQ ID NO: 690252 - DNA, 1301 bp, Homo sapiens
tctacgggcgtataaaccggtcccggaaagaagattccatatagaccgactgcagaaatgggagtgtctgcaccggtggctcggagatggaggcttgtcgcggtgaggtgcgcagaccgatggttcacggatagatgtgattggcggtgaagcctggagacacccagaaatagctggacgcgcatgtggaatgatcggtaagaggggtgttgtgagaacatgcctttcatttccacggaccagtatggtcatatgcattcatggatgcactcgtcatgtgcgatcacgtaacgaggtcatgcatcccccgataaactcgttactacaggctattcatgaagggtgaacattaccattcatccatggcactccggagttgcttgatggcttggcacatcgtatggctgtgaacctcactatgatgtaagtgagcaaggttctcggaaaccatgcctagctcatagaggtgtgtgacgacgggtccctgtttcagaaaatcgaactcaggaggcgcaatagagggcttgttgtagcactacttaccgtgagaaggacctggaatgtggtgaaggtggacggacctgcactagaaccgaagcaaggaaagacgtcggccgcggttgagggttgcttttcggacacgggaaccagagaggtacccagatttggactaaaggctgccttccatgggctccaagtgttgagcttgtgcgctgaaagaagtcggtaccatttatgtaaaccgaattgggaagaaggaaggcaatcacggtcaaaggaattttctgtaaccttattacggttcatcacgtcccttaagacccttggggagagaacccaaggagcttcggaacaagttggaacccccttggggacaattcgagaaaagggacacgggaattatattggttgcacgctggcttaaaaaggcacaattccgagagacgcaaacaaagcgcccgtggttcccagcgagttcgtttggggatgacaatatccatccgtttttcacccaaggaaagagacttgtgtgtcccccaaggaccaagatggcaacgaaccgatcgaaaagaaaggggccaagaaatttcctttctggttaatcgacggcaaggaccatcccatttccgccgttgggaatgggtgtggcccgttccgttgcccccattggggattcctggggaagttgggagaaagctttggctctctttggcacgcaatatattcgaccggttcaccattgctttgctagaagaagaagttggcacttttaagaagtgattaatttcccagagaggaga

SEQ ID NO: 690253 - DNA, 216 bp, Homo sapiens
ggcacgagaaaagagaacagaaaacaacaaaagaatttttgtttggactgttttcactaacagtgcacataactggagttttgaacgcttaaggcatcattacttgggacaattttaatgtttattatttacatcactttgtgatttacacagggtttcaattctgtaattacatatttgctcttcaaagggtccaattctcatgtcctttggatt

SEQ ID NO: 690254 - DNA, 201 bp, Homo sapiens
ggtggtgggggtagcgggccgcggcgggtgtggggggggagtggcgtgtcgcatctatttttatttaaaactcacagcaggccaggcatgatggctcatgcctacaatcccaccactttgggaggcgggggcgggcagatccctggagctcaggagttttaaaccagcctgtgaaacatagtgaggccccatgtctgagcc

SEQ ID NO: 690255 - DNA, 348 bp, Homo sapiens
ggccattatggccgggaagagagacagggaaatgctgtaaccgcggttaacacgcacgtgaaggttggttaaggggaagacctgggttttagtcctgtctccatcaacctcaggaaagggaacctcatggaaggaagggaaggcaatgccgaggatgtgctcctgagcaggtgccacaattcttaacctgtaagattgctgacagaaaagtgagacctcttccaccccagggtctcctaagagaatgctgctagccaaaaaaggatctgctgataattgaggaagagcatctttaaaaggacactcaactacatttcagaaccttaaggatctaagggttggttctac

SEQ ID NO: 690256 - DNA, 127 bp, Homo sapiens
ctcgcgctcggttcccctactcttactacttaacactttacacggtacgtttacaaccttactaacacactaccactactttggctgacaggacttacggggactcctctacgacgtcgacccggca

SEQ ID NO: 690257 - DNA, 388 bp, Homo sapiens
  misc_feature (158)..(158): n is a, c, g, or t
  misc_feature (318)..(318): n is a, c, g, or t
gccaaaaaacctttttctttataattttggggggggaatttacttttttccccacaactttttggggggcctatcggaaaggcccgggggtatcggggtacccgaagggaatcccccaagaaaacacctttttttttgggagggtcattcatttctcnaacagcaagtaaaaattaataattttcatgatttgaaaagccttcgctttgaagggaaaagtcctaatagtagaagaaccccccataaacctggaggggttatatggatgccccccccccctcccccccatttgaagaacccgtatacataaaattttgncaaaaaaggaaggaatcgaaccccccaaaggtggtttcaagccaaccccatggcccccatgactttttca

SEQ ID NO: 690258 - DNA, 331 bp, Homo sapiens
tactttcaataattaattaagatattattagattttggaagggccagggaataaagaaaattaaaattaaagccttaggaaacgttcccgattcaagaccctaaattaaaatacagctgctgggcaattataattacattcaaagggaaagagaatttgactcataaatagaaaagcagtttccaccaggctttcaagtacggttaatcccaaaacacaggtgcctggaagatcctcagccaccccttttattcaaaccccaacccttggggactgcctgttgggttcacagaatgttttttactcaaaaggacctttcatccttaaagcc

SEQ ID NO: 690259 - DNA, 282 bp, Homo sapiens
  misc_feature (7)..(7): n is a, c, g, or t
gggaganttagaggatccccgacgttgtacctctgcaggtaagctctgtagggtatcgcaaaaaattctctcatagccaacttttcatgaaacgagagctcttctcattcctgtgttcgtagattttccattcatggattttttcacacgggaccaggatcaggaaacgtgtatttggtgaacaatttccgcagggcaaaaaaccacagaggggtaaccaggacccgtcgggggtacccgaggctcgaatttcggtactcaatggtcataggctgttttcct

SEQ ID NO: 690260 - DNA, 211 bp, Homo sapiens
gcggccgtgttagcggctggtgcatcgttgtgtaattgctgatgtctcagtgaagctgccatgctgcaaaggcctgggtgtggatctactgctaataggggagaggaggatgaatttctgggggtgaacatgggtccctctaggtgaggggaacaattttctgaagagctgattttccttctgaaaggtcagaggcaggacctctttggtg

SEQ ID NO: 690261 - DNA, 105 bp, Homo sapiens
tatcaatcgagccgtaccttcggtgcgatgatcagtaccttggcttttttcaggttcaactggccttcccggccgacgccgggcagggtgatgtggcgtacgtag

SEQ ID NO: 690262 - DNA, 294 bp, Homo sapiens
  misc_feature (48)..(49): n is a, c, g, or t
  misc_feature (148)..(148): n is a, c, g, or t
ttttggggggggccccccggggggggggcccgggggggggttttaaannaccccccccctaaggggggggttttttggttttttcccccccggggcccgggggggggggggggggggccccccttttttgggggcccccttaaaaaangggggggcccccctttttttttttttttcccccccaaccccttggcccccccccttttttctttgggcccggggggggccccccccccccaagggggcaggggggcccggcccctttttttttattttttttttttttttttttta

SEQ ID NO: 690263 - DNA, 280 bp, Homo sapiens
ggtcgaccaataaacagcatgtggtttttattgggtggagggtggaaggcaatccagagaaggaaacaagcccaggtgtgcactagggctgaaggtcactcagataaaaaaaaaaaaaaaaaaaaaaccctgactggacattaaaatcagagagggagcctttaaaataccagtgctggccaggcatggcggctcacacctgtaatcccagcactttgggaggtcgaggcgggcagatcacgaggtcaggagattgagaccatcctggctaatgtcgacg

SEQ ID NO: 690264 - DNA, 190 bp, Homo sapiens
  misc_feature (182)..(182): n is a, c, g, or t
gatcagaggatcctagttaagggctaccgtcatccattgtgatggtctggccccactcagtgactgaccaaaatactggagcctgggagagagcttggagcctgctatccgctggctatgggaggggctgatgccagatcctgaggttccgtgaaaacaggtaaacagcaccccggttgtcnctcctctc

SEQ ID NO: 690265 - DNA, 444 bp, Homo sapiens
ctgcggaaaaagacaccagtaaaagagcctcagctgggcacagatggcggatgcctgtcgtaccagttactcaggtggctgaggcaggagaactgctcgcatcccagacgtggaagttgcaaatgagtcgagatcgtgccattgcactccagcctgggcaacaagagagaaactccatctcaaaaaaataaaaataaaaagaatgaaggcttaccaagaagcctaccccagattcaaaacatagggaacatgcaagggcccttacgatgacagttctttgccaatctggtctgccatcccttgacacccaccaggcttgcaggcgtcttaagcagttccgggcagcaagcttgcagtgtatcctaagccctctgtgagggaagctggtatggaaagagccaaatacaacagagaaggaaaactgagagtggttcattggagtca

SEQ ID NO: 690266 - DNA, 1486 bp, Homo sapiens
  misc_feature (149)..(149): n is a, c, g, or t
tgttgttttatgtgttggtttgttgtgtagtgctgtgtggtgtgtttttgtgtgtgttgtttgtgggtgttgtatgtgttttgtattggtatttttttgtgttgtttttttttttggtgtgtgtgcctgagagtgagatggtgtgtggncgcttatatcacttgtggtgtcaacacccctgttgggtccccctttttatttttgggggcgccgcgctgggtggacccaaacacggggttgtttttatctgtggtcctcgtgtttgttttctgtgtttctatatggtgtgagcgccctcggggggacaatttttgtcctcagggggctctccccttgtgtgtgtttggaatatgtgtgttgtgtgtctcctctgtgggggccacaagtgattgctctctcctgggtggttgtgtccgtcggtgctttatttttcctgggtggctctgtgtggtgtcgccccctctgtctcgtcgcacaagaggtgggggggtcgtccccctcccccctgggggggttttttttgcgctgttttcttctgcctgcccccctccttttcttgtggtttcctcccccgccccacaaaggtgtgttgttttgtagcggcgcgcggcttgtttatggactgttgtgtggttggggtggggggagacacccacccgctgtgtgggggtggacacaaacacactctctgtgtttgtggggcgcggcgcagctgcttacacgctccattggggggattggtggcgctgcgcgcgcttatatattgttgtgttgttttttgttgtgtttttgtgttgtgtgtgtttgttgttattttttattgtgtgggggcgtgagagctcctcgcgaggggttttataaacactcgtggtgcgcgcgcgcgagaagtggggacgcaccacacgccgcgcgggtggtgggcgagagagcgcttctctcctcccacggtgtgtcacacacacggtggcccagcggagctctttgtggtgtgccaccacgctgttgtttgtttttataatatagcgtccgctcttctctctccacatatgtgtgagagagaggcggtgtgttactcacaggagagatctctcctcttcccctctctctttaacctcccccccctgtttttccttaagagagagagaatgtgcgccccccctctctcttctctccacaggcgcaccacccgcgcgagagggggtatatatcacccttgtgtgtttgtgtggaaaaatatatagaaaacccacaatttttttataaatttgtcccctcaaaacctttttatatatttgtgtttatattttgtgaaaaaaagacccctctctggtcccccccctccccccctcttttgttccccccccccaagaaaatatttaagctttttgtgttccccgcgcgaggggggggggggcccccccgcgggttccccgcaccccgacactttagagagccccccgttgaataaaaaggcccccccctctta

SEQ ID NO: 690267 - DNA, 105 bp, Homo sapiens
acttagggtggctctctggtgagttttaaaaacagttattaagccaactagtgaccttccttcgatgacatattctactatgatagtacgttattcttgtacatt

SEQ ID NO: 690268 - DNA, 243 bp, Homo sapiens
  misc_feature (240)..(241): n is a, c, g, or t
aaacgttcaaagactaagaggcaaatgcagactcagcatgagtgagagaaaaagaggagagtgaggcagagaccttgtgatcttggagcagttgtaaagttcaagaatgaatgactccactggaaatataggacaacaccaagtttctgagaacttatcagggcagtttctacacaaaacctgttgcaagcatcccagagaatcacttttgaaatggaaagggcccagagcctagggccnntt

SEQ ID NO: 690269 - DNA, 1979 bp, Homo sapiens
  misc_feature (703)..(703): n is a, c, g, or t
atattatgtcagcaagtaattaacttatgtttaaaaggtggccatatcatgaaaccttactttaaatacaatagtttcaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgntttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaaaaaa

SEQ ID NO: 690270 - DNA, 366 bp, Homo sapiens
  misc_feature (142)..(142): n is a, c, g, or t
  misc_feature (209)..(209): n is a, c, g, or t
  misc_feature (232)..(232): n is a, c, g, or t
tactttccacaggtcacacgacctgacctgactatttacaactcacacgaacctgacctgactagatttacaggtcacacgatcctgacctgactagtttacaatcacacgatcctgacctgactagttacaatcacacgancctacctgactagtttacaatcacacgatcctgacctgactagtttacaatcacacgatcctgaccntgactagtttacaatcacacgancctgacctgactagtttacaatcacacgatcctgacctgactagtttacaatcacacgaccctgacctgactagtttacaatcacacgatcctgacctgactagtttacaatcacacgatcctgacctgactag

SEQ ID NO: 690271 - DNA, 1521 bp, Homo sapiens
  misc_feature (2)..(2): n is a, c, g, or t
cnaggctcgcatgcactactggcacggcgctagcttgagctctagatatactagtgtggctccccggtgcctgctatcgccactgactaggattttttctgacgtgtggctcgatccttctgtgcgtcgtattggcgccctgtagaccatctgagccttgtgctcgccgcccggtactgaatggaacaacacacaaggcatgagagtagcttggcgacaggaaagacgcactcgtcgcctagatatgcgctcgtctcgaggttgcccacatcttcccgtagtatgggcagaccaccaggtcgtactgttggtataccacgcgacacgagcacacaggcacagagactgcatcagatgccgcagctaacagattgatgcccctgacgaccattcctgacctgagagcacacggagggtacccaacaacgcgaaggataacgtcaattcaagtgggataggccactcgctcggagatcctacccggagcgcgagagcctcgtcgtttgcgcaccgaatccaacgacgtttcatttggcggtccccaccgttgagggtgtttgggataccttgtagtggatccattaactcgcccaaccatttcgtgacctcgattacaattttgaggaggattgcacgcacttggtaagttggtgcccaggaacgtaaccaccccaggggtgaaagccatcggcagacaccgggttgtctatttcgattctgagtgtagacttcacccacggcgacagtttagtatcgaacacgtgagtagaatcgccgcaccttttgcacggaacacacttgatgtccgctgaaacaacaaattccaattcccgcctatgacgtttagttggctcaaggaacggcgtaccacactggttccctaggttccccgcgattgtagagtcgacaagcagcgatctcgattatgccctttcgaggacattggggaatgcccctaagtgtagaccatcccgcatagttcgcaaattcgccccgcccattctgttacaacgcacaagtgcgagtaggccccattccactccagaaggcaaacttggcaggaagcaaaccagaaaagtccgccacctgggccttcgtttatatccgccaaaagcttggtttgcgcacggctctaggttctgctaacctatgcgatgcgcattccaggttttgtacaatgccaagccccaagcataggaggctcgtatccaatgacgcacttgcggcatccggtcacatgcctgaaatgcgtgcaaacccacgccgtttggataaggttggcgtaccaacttttgcccttggacccccccccactctgttgccattcagccactctacattgtctcatctttgtcgacaaacattccgtaatggtgccatccctcttcgagcaggccataatgggtgaagcaatatcggaggatatgacaatagcgcgacggccgccaccaacagtcaaagagaaactaaatgggctccgttacccccatgtgtaaggggcatgtctacatcatgtcacat

SEQ ID NO: 690272 - DNA, 745 bp, Homo sapiens
ggagacgtacttcgccgagactcgtcggggatttcctgcttcaacagtgtgctttgtgacggaacccggcgcgtcgtttcgcccacctccggtccggccgtgccattagtccagcacctccgtcaacctcttcaccgcaccctcggtactgccccaaggcccccggcgccgcttccagcgctcgacgcgagactcatcactgccacgcccggcacgtccgacactctacccttcagatcgtccgcctattgagcgacccgacgtgcaccctcgcaaggtgcgcccagaaactaccaaccaggaactcagaaggcccgccatcaacccgccaagatcaacctgggagctctacgcctcctacgttatacctgtcccattgtcttactaacttttgaaccggcgatgcatgctggctcttgaacgaacctttgaccaaaacgtactttcattcaccaaatctcatgagcgagcagggaacactgctgagaaaactgattgacgctgcaagaaccaaccgaggtggcccgaattcttccttcaggatattcaagaaaccagaactgttgatgacctggtgagaagcgggctggacatgccaattggcagtgtgcaattacattttggaaaacaccacatgtgcaactcagttcactaactgggaacttgcacaaaactgtggccactgaccaagaattgaccccccaatttgtagtgaccttccattgaagaacacatttaccctgac

SEQ ID NO: 690273 - DNA, 222 bp, Homo sapiens
aatttaagggctttgggacttaagttactgaaaaggaggtagaaatactctttcattcaaggtcaatcagtttgcattggcttctcatttcttttggggattgtggctttgattcagccaaatactccactattgagtttgatttccttgggtatgcattgttcgtttaaccagtactttaaattgaggctgaggtactgcattaaaggtcctcagtaaaga

SEQ ID NO: 690274 - DNA, 341 bp, Homo sapiens
catgctgggagctgtgtgtgtgtaaaagctgctagataggttgggagctttgcttgcgtggggttcacagctgacggtagaaactggtcgtgactggtatgcccctagggagacgttgggactgtagaggctgacgggaggcagaggctgggcctggaggatccaccaagatgcaggagctgggcctggagaggctgcaaagaagcatgagctgggcctggtgaggtcaacttgagaaagttcagggccaggagagaaggctgggaggcaggagctgggtctaaagaggccattgtaacgatggagctgtgcctgtggaggctgttgtgaggcagtagcct

SEQ ID NO: 690275 - DNA, 667 bp, Homo sapiens
  misc_feature (399)..(399): n is a, c, g, or t
  misc_feature (405)..(405): n is a, c, g, or t
  misc_feature (409)..(409): n is a, c, g, or t
  misc_feature (457)..(457): n is a, c, g, or t
  misc_feature (472)..(472): n is a, c, g, or t
  misc_feature (482)..(482): n is a, c, g, or t
  misc_feature (484)..(484): n is a, c, g, or t
  misc_feature (489)..(489): n is a, c, g, or t
  misc_feature (492)..(492): n is a, c, g, or t
  misc_feature (512)..(512): n is a, c, g, or t
  misc_feature (526)..(526): n is a, c, g, or t
  misc_feature (528)..(528): n is a, c, g, or t
  misc_feature (530)..(530): n is a, c, g, or t
  misc_feature (534)..(534): n is a, c, g, or t
  misc_feature (564)..(564): n is a, c, g, or t
  misc_feature (575)..(575): n is a, c, g, or t
  misc_feature (579)..(579): n is a, c, g, or t
  misc_feature (584)..(584): n is a, c, g, or t
  misc_feature (598)..(598): n is a, c, g, or t
  misc_feature (612)..(612): n is a, c, g, or t
  misc_feature (623)..(623): n is a, c, g, or t
  misc_feature (654)..(654): n is a, c, g, or t
gaaaggcttgtaaaaaaataacggcaaatgtccggttcctctccccaagcaaagatgtccttttccatagaccgcccatagagattaacctgaaaattaagatccaccccctccagttcttgtccggcccgctggccttgtttctcttgcggtgtttaacgttcccttgtgtcgatatttcctttcagacaaaggaaataaaggccgcctgaagttctggtgcacgaatgtaaagagcatggaaatgctggtgaagcacaaggccaataacatcctcacctagggccccctggttccccgtcgtgtctcctttgactcacctagagaggcgtttgcagccaatgaagctggctgctcagacggtcgacattgaatttgggtgggggttgggatcctgtntaaagnacanactgttcttgctctaaaaacaggactgtccctgatgggagccaggccncagggaggaggcttntttgtgggtntntcctncanagggtgggggtctcagggtnttaggtgatacggnananaaanaacgtgccaggcaggaggccccctgaagtntgtgtactccnaggnggatntccatccccatccncctgtacggacatnttttccgttgnggtttgagaatgttcctataataaacccctntgctttgttttta

SEQ ID NO: 690276 - DNA, 293 bp, Homo sapiens
  misc_feature (259)..(259): n is a, c, g, or t
tgacaggagcttagcacgagtcttggagagtgggtgtggtcagctgacttctttctagatcactattaagccattctgctgggaatgatatctggttgacctgagtgcacagtcaagtttaggggacagggcagagggcaaggaacaaaaagggagacgaaggaaggaatgagcaaggcaggggaaaagaggaaggaggacgaactggtaacaaggtgtgggcacggagtgtggctagcagagcctctgagggaggtgngccccaccagaacagaggctccctctgcctgggg

SEQ ID NO: 690277 - DNA, 866 bp, Homo sapiens
ccatgcatcgtattcacacttggtgcgacggcaacatcatgaccattggatggataacagaggtctatggatattatgatgagctgccaaaaccgaatatggaaatgctaatgcctgtagatactgtaccacagttgatgacgtgctcgcagaagcggtttcagtagatgaccagattgtgtgtatcctatgcagattaatctcctgagtatctcaaaactacgtggatcaaattcatagaccaatcggaaacgggaatcgaggaatagttccttcaataacaggtaggcattattagtgatcgtggtaatgcgtcgagatcgcttgacagatgtggatcaacgttaggagctcatcaatcgcccgatgagcatgattcggctatattagcgtagccaaaccgcgcttaccatcctatatgtaacatttgttgcataatcacgcgaacttaagaaactgccattcgttgtccacgaagtcagcatcatactaggttgcacgtaagtgctataactggtatgttggatgcagatagcttgcgtgacagtcattggtctgctcctgagttactggtctatgcggtgtgctcggaaatgattgctctcgatcagtcggtgctgtgccaagatgattgtaagatataatcaaagtatgaaccaaaatgctatgatatctcggtcaagttgtccagatatcttgaaccgtgtaatttcctcccagaattgatcgagacccataatatcccttgtgaaggctgtacgcacatacctgctgacgcgcattttttctgccctcttcttacccccaaattgtccctttgtaatttaccctctacaatatacttttttaattggggcactcttgag

SEQ ID NO: 690278 - DNA, 111 bp, Homo sapiens
  misc_feature (14)..(14): n is a, c, g, or t
tctgttctgtggancaggaggcagttgttttccgtccggcttctcccacaccgaagtgcgcgcctccacctcatggaagactccgatggatatggacatgagtcctcttag

SEQ ID NO: 690279 - DNA, 827 bp, Homo sapiens
  misc_feature (22)..(22): n is a, c, g, or t
  misc_feature (143)..(143): n is a, c, g, or t
  misc_feature (145)..(145): n is a, c, g, or t
  misc_feature (177)..(177): n is a, c, g, or t
  misc_feature (246)..(246): n is a, c, g, or t
  misc_feature (330)..(330): n is a, c, g, or t
  misc_feature (355)..(356): n is a, c, g, or t
  misc_feature (371)..(371): n is a, c, g, or t
  misc_feature (436)..(436): n is a, c, g, or t
  misc_feature (446)..(449): n is a, c, g, or t
  misc_feature (453)..(453): n is a, c, g, or t
  misc_feature (461)..(461): n is a, c, g, or t
  misc_feature (466)..(466): n is a, c, g, or t
  misc_feature (481)..(481): n is a, c, g, or t
  misc_feature (490)..(490): n is a, c, g, or t
  misc_feature (502)..(502): n is a, c, g, or t
  misc_feature (520)..(520): n is a, c, g, or t
  misc_feature (525)..(525): n is a, c, g, or t
  misc_feature (532)..(532): n is a, c, g, or t
tgatctcgccgcggttccgcgngcctgccgcgccgccgccagcagagcgcaccgggccgatcgggcgagtggccatggcgggcgccgaggactggccgggccagcagctggagctggacgaggacgaggcgtcttgttgccgntngggcgcgcacacgccggggcccgcgagctggntgcgctctactcgccaggcaagcgcctccaggagtggtgctctgtgatcctgtgcttcagcctcatcgnccacaacctggtccatctcctgctgctggcccgctgggaggacacacccctcgtcatactcggtgttgttgcaggggctctcantgctgacttcttgtctggcctggtnnactggggtgctgacncatggggctctgtggagctgcccattgtggggaaggctttcatccgatccttccgggagcaccanattgacccannnnctancacacggnacganttcatcgagaccaanggggacaantgcctggtgagnctgctgccgctgctaaanatggnctacaanttccgcacccacagccctgaagccctggagcagttatacccctgggagtgcttcgtcttctgcctgatcatcttcggcaccttcaccaaacagatccacaagtggtcgcacacgtacttgggctgcactgctggggtcaccctcctgcaggactggcattgtcattcctgccacgtaaacagcatcgaatccaccacgtttcaccccaagagacctactttctgcatcaccacaggctggctcaagtaccctctggagaagataggcttctgggacgccttggagacctcatccg

SEQ ID NO: 690280 - DNA, 1905 bp, Homo sapiens
  misc_feature (1905)..(1905): n is a, c, g, or t
aaatacagcctcaacagattaaaaaacaaaagtcacacttaagtgatccttctagtcacatcagcagtgttctgccttatatgtagtagtttgggcatcatcaatcccttccaccaccagcccctgaagggcaaaggctcaatcttcacggcatcaatcccacgtgcagcatttcccaccacaagcagcaaaagcaccacgccatcagtgcaacatagtccagtacttttccagtcacatcgcagtgcatcacctattcacagggccacatcattcggcactcgttctggaccaacccaccacaccataacatcaagcttagcacaccagcatccacaggcattatgcgcatcccaacgcacacagttgcattcactgtgcaggtggtatcagggcattgcatcactttatggacattgtcaaacacagcacaggccaccatccacctcttttgtcgccccacacccatccacataggccatttacagttgatcttaccacacaacacaacaaggcacggtgcacaccatggtagcaacacaaaacacagaagaacaaaacagccacaaatatcgcgcgacaacgcattggccttaggcataccacacatagtgatacaggtaacgatacaactcattacacgtggaacgtgcacactgcttcttggttcacttcagttcacttcagaacattccacccattggaggactacacggcagcaataaccaacgacacagactggacactctggcttatcgcacaccacatatccctacacgtgaacacatctggttaggccgatacacacatccacacggtacattcaaacaacaccaccacaccacacgcaactatatcacattacttcattccattctacacaccagacagacaatagacaggaagaggagagaaatcggttcgaccacaaccacaaggaataccataaagcgacaggatatgacccccacacaaagtagtgcaccgtgtgacacacacacaaaaaagcgcgggcgaggccacatggcggcccaccaatggcgaccacaaacaaaattcaccaccatcgacacgcaaattccaacgcacaccatcaacattgcgaaaaacgaggggcgacaacaacgaaaacgcaacacaccccgacaccaagacctacactcacaatcatcacccacataccgatgggaaaagagtacccccatctagcacaggcaacactacatcgcgcacaccacaccgcgtactacaacaggtgcacaagatgacaagactgcgcaagccacacaggagtctaacacgcaagcaagcgacagacgctgcaacaccacccaacgagcagcatacaacaaccaccgaatacacagaggagaacaccacatggcactcagatcaacacagtgaaagaacaaaacaccgacccaggtaaaacaccagcccacaaaccacagacaaacactgccgaagctgtgacaccgaggcacacacatcaagcaaccaacaccgcaagcacacaacgcaacaaaggatggacacaaccaagatgcgggcactgctcacagcacacaaagagcggcaaccgcttccatagcatacacactaaaaacgagctatcaaataactatttaataatacacactactacttacaatttataatactacaaaaaatagaataaagataacacagacacgaaaacacgacataatcacaaacgcaagcaaactcatctcatccacctctacatcatatcacattaaagacaaaactacacatcacaacagaacacatacacaaccacaaaactcaaataaaaaaaataacatctaataacaaaaactcaccaacagaaacaacaaaaaagacatctctcgatactctatatctacatcaaccacactacan

SEQ ID NO: 690281 - DNA, 386 bp, Homo sapiens
  misc_feature (34)..(34): n is a, c, g, or t
  misc_feature (377)..(377): n is a, c, g, or t
  misc_feature (379)..(379): n is a, c, g, or t
  misc_feature (381)..(381): n is a, c, g, or t
gccccccggtatgttgcccttgccatcccacagnggagcacctttccatttattaatttatttgtaaattagaattattaatatactcccgagttaatagccccgaggttgatagaaacccacttggagggaaaactaatgcaggaacagaaaaccaaatactgcatgttcctcatttataagtgggagctaacattgagtacatatggatgcaaagaagggaacaacagacactgggaaaggagaggatcaaaagactccctgtggagaactgtgcttattgcctgggtgatgaaataatctgtacaccaaacctcgctaacatgcagtctacctacataacaaacctgcccatgtacccctgaacctacaattanantnatttt

SEQ ID NO: 690282 - DNA, 480 bp, Homo sapiens
cctacaaccttcctgtactatttttttttcttggcttgtaaatgtgtgcttataatttctgcaagtcaaattgtgatgcagatgagatacaagtataaacttgcatggtgcatccagaaaataaaaagcacaagtatacaggtttagttcaacagcttattcccttataaagaaaaaaaaaagttttgaattaatagctagtttatcttcagttgtaaaaacttggaggtttaaacaaactcaagattttatatacagctaaattattttacatttcccaaatcttccacagttacagcatttttaaacaatagtaaattgctctcattcacagactctcacgtgtttaagacttatttccacattcccaattctcagattaaaaattttcacaattatattaaatccatttgagaatttctgttccacaaattacgagtttttagaaattctgattttcaaattttaaattacaaaaat

SEQ ID NO: 690283 - DNA, 1196 bp, Homo sapiens
ttgtgtaatattggttaatgatgatacagttaatatgtttaaataaattttgttgttattttcttatataacgactagacatatagtatagaatattttaccgataatttacacattgggaaatatatttgatatgaattccaatgtcgctggttttgtcaatttgtgataatataattaagggtgtatggatgtttattgaagtggttaatggatagaggggtgaggtgtaggcagtttactatgagggggttattatatttgcagtggttgaagggcatcatttccgattagtagtgtcttacaaggtgaaggaagactgtgacgaggtacgactaccatcggatgcaaaaaattgtcaacccttccggctaaccgatggaggtcatattccggcttaattcgccgcccacccatgccgttgctaataccttatttctgatggctgggatctgcgccaagcagcttccagcgggaatggcgtatacgtgtgaatccgaattctgcttgtcatgtgtcttccgaggccccctatggtattgcaatcgttttctcttttccagcctctggtacgcgttggtctctgactgggcattgtatttgagctggaagctgcaggtcacgtaggagcatcggtgacgtagcgagcgaacatcgtagatacgtttgtatgctcagcgtgtcgcactagtgtcctagtcaataggagctgtatttgccagtcatatggaggctgtcattcagctgaggttcccctagttctcaggctacacccgtagaccaatacctatcgccaataatccagtttcactagtcatagttcagtcggctgtaaatcgtaagcgtttcttcccagcaacactttgctcggcctatccggaagtgccccgacgttagctcggactaccaccgatgcatacaccacatgaaacatcctatcatctgtaggctcattcatttctctaacagcagtaatattaataattttcatgatttgagaagccgttcgcttcgaagcgaaaagtcctaatagtagtatagaaccctcacataaactctggtagtgactatatggatgccccccacgcgctaccacacattcgaagaacccgtatactataaaatctagacaaagaaggataggaatcgaaccccccaaatcaacgtctcaagccaaccgcctgctcaagctgggg

SEQ ID NO: 690284 - DNA, 417 bp, Homo sapiens
gaagaaaatcagatggatctgtgtcctctagctgcaaataacaagtaaaagctataaaagatactgagagcagagaacgtctctacacaaaagacttctgacattacacctcagcaagcaacagctgttgtccaagcaggaaatttccccacaacagccctcaaggtctgcacagcacattcaagatgtcagcaggcaaaatctcaagcaacacgttcagcccatcaaagcaggcaagcttccacaggttctcgatttctgcaagcaagtcaagcaacatccagccagccacctccctggcaaacaaatccattgtccatgaggcaatccctaaaactcccaggcctcagacgcagtcagaatcatgctgagattaaagccatttctactccagcatgacataaacgcaggtcaaag

SEQ ID NO: 690285 - DNA, 102 bp, Homo sapiens
ttcatgtattgctgcttctctctctacggcctcatccaggtaccgctgcttttccgttggctgcagacttgctaccagtcggacgcccatgcatcattggtg

SEQ ID NO: 690286 - DNA, 491 bp, Homo sapiens
acgctagctcactgttcaggcttatccatgtgaacttctgcctctgacggtacgcaggtataccatctatgacacatctgtctagatttcatacctgagcttatagcacaggcagaaccgttgagaaaaccagatatttgctatccaagtagctttctcaactggtgatatacgaatcatagcattaccaaagtcattggtggtcttagcgtcagtcagggacttttacagttacaaggtaagcggtatgcttttatgccaatcgcaagtggctcttttgtgacattcctcctgttgaggatatatgtcttgcgatcaaatagggcagttgtgcctcgatgtgcactcagacaagagacatgatcattattaccgtctcacaaataaggagaaccagggaggtccaatctgtaagatcatctataaaggatccggacacgaacatggatcctgatgtcgctcgtcatgatgaagacagtatgaataatatt

SEQ ID NO: 690287 - DNA, 523 bp, Homo sapiens
ttttggaagttgaagctggaggattccttgaagccaggagttcgagaccagcctgggcaacaaagcaagaccctgtctctacaaaaaataaaaaataaaaattacctgggtacagtggcacacacctatagtcccagctactggagaggctgaggcaggaggattgcttgaagccaggagttcgagaccagcctgggcaacaaagcaagaccctgtctctacaaaaaataaaaaataaaaattacctgggtgcagtggcacacacctatagtcccagctactggagaggctgaggcaggaggatcacttgagtccaggagtttgaggcttctgtgagccatgatcggaccaatgcaccccaacctaggcaatacagagagagagagaccttatctcaaaagaaaaaaaaaaaaaaacattgagtctgggggttaatagcacagcaatccaccattttatctttgctgcccaagacaacaaatatggacatggctttctgttccttaaacccttttaaaaggtt

SEQ ID NO: 690288 - DNA, 164 bp, Homo sapiens
  misc_feature (64)..(64): n is a, c, g, or t
  misc_feature (74)..(74): n is a, c, g, or t
ttaaggatcccacgctcctgtgcaagcacatcatgtctatctgaatggagctctcaagaacaancattgcttangaagactgcgctggaaacttattttaataacacccatgacaacactctccagatctgcttaccatcattcatgacaacaaagcagtctgg

SEQ ID NO: 690289 - DNA, 363 bp, Homo sapiens
ggcctggaatggcccagggtccccaaggcaaagttggggttggtcccagcctgaggctccaggtgatgccctcagctccccgggggggggttccccatttagttgggtgcaggggtcattgcttgtcagctcagggcccttttcccgcttgccttttcccctacatttgtgcctgcacatccagaaatgcctcctttccgctgcctccaggaagccccccttgagcccgggtcaagggttgcagcacttcccgttagaacacgccccccctcactgttttttttgccttacagcccccatgggaaaggtgcaacctttttgttttttttaaagaaagcccaaccttaaagggttttccttgca

SEQ ID NO: 690290 - DNA, 389 bp, Homo sapiens
gatgaggagaccatagcaagccactagaaccaaggccagctgcagtgttgatcgatcccaatcccgaataaagaataaagatctctcaaaaaaaaaaaaaaaaaaaaaaaacacattggtgggggggcagacgccacagaaacagcattcaaaaaacaatctcggtgggcggccgggggcccaagagatggaagtacaatgggcacaaacacggggtcccaaaggagacactcggggccaagagaacatggaggtgtgtttccacccaacattaacacaacgcgccgggggagacacagagaggggttgtgaccaactccaacgagggggacaagacgacaaacagcgggcccacaccacaggagtccaacagagaggccagaaaaaaa

SEQ ID NO: 690291 - DNA, 301 bp, Homo sapiens
  misc_feature (33)..(33): n is a, c, g, or t
  misc_feature (66)..(66): n is a, c, g, or t
  misc_feature (101)..(101): n is a, c, g, or t
  misc_feature (223)..(223): n is a, c, g, or t
  misc_feature (289)..(290): n is a, c, g, or t
gcccatatcagggctggtctctgtggaactcancccagggctgcctcctctttgtcacccccaaantggggcagcccagggacagcccagggtgtgttcanaatgggttccttctgcagggcaggaagggcagattgttaaagggctgcggcccagaccaccctggtccctctccgggcagtgactcagacccacactgtgccgtgcagactttgccctgcanacccgcttgacggcgcactgctcacttctggggggccctttcagaggcacttttaaagcaaataanncatttattgtt

SEQ ID NO: 690292 - DNA, 284 bp, Homo sapiens
ggtgcgacctaaagaaaaacaaccagacaggtgcccaatgacacttacaaaggtgatttattatcttgccaagtttaggctgggcatggtgactcatgcctctaatcccagcattttgggaggctgaggctggtggatcaccggaggccaggactttgagaccagcctgaccaatatggcaaagcatcgtccctgctgaggatacaaaaattagccgggcatggtggtgtgagcctgtagtcccagctactcaggaggctgagaacaggagaattgcttggatt

SEQ ID NO: 690293 - DNA, 144 bp, Homo sapiens
ctagaggacccttcatgtcaggcttcatgccgtcagaggagtctcaggagacaggaagtggctgtgctccacagttgcaggtgagcgtggcggtgccctgctcaggcactgcaggaagcggcgcttatgctctgcactgttgcc

SEQ ID NO: 690294 - DNA, 882 bp, Homo sapiens
  misc_feature (882)..(882): n is a, c, g, or t
catcgataataaccaataatcatacaaatcaataaaaaaggaaaccccttaaggtttagccacagaagaggcttttatccctcaccacctgtttttgttccagcaccaggaaccaatgaagaagatggtggggttattctttctcgggcgatcactgcgaccaaaatgaaacgaaccatctcctaaccttccctgcccgtattatcaaatacatcagctctattctacgccacctgcgcatacacccattcgtttccactcatacacccattctcatttttttttcttcacaaccaaactacagcccctctcattccagtccgcgtacctcagccgccccgcccacctcctacacccccccctccacaccccacaatgagcgatctgcgaaaatatcaaaacaaaacttcccccacacccttcacactccttccgagactcttgtcgccccgagctatccatctcataagatacccctcgcccccggcctctcactattacaaataacacatcaatataaactttccccctcaaactacagccccccctaaacctcaactcgtgcccaaccgacattaaatctaagcaacctgccccctcccgagcttttacacagatcatttctcatcatacttcacttttcgccgctccccgtacaacataacaaactcccaccacaccatccacctctccctcaccccgcccacacacttagctctctatactccccatcccatcgctcccacactccgacctctcctcatcgctccgttttgtccgattaccgattaaacacatgaattcgaaaccactctgcctctcatcacgcagacccctcaacaccctcgtcccaactcacactcttttctctctttctccttn

SEQ ID NO: 690295 - DNA, 411 bp, Homo sapiens
  misc_feature (52)..(52): n is a, c, g, or t
  misc_feature (56)..(56): n is a, c, g, or t
  misc_feature (93)..(93): n is a, c, g, or t
  misc_feature (96)..(96): n is a, c, g, or t
  misc_feature (111)..(112): n is a, c, g, or t
  misc_feature (137)..(137): n is a, c, g, or t
  misc_feature (142)..(142): n is a, c, g, or t
cacgagggcacatgcagtccatcgcgccgctgatcgacctgccacaggtcanacgncgcctgatgcgccaaccacgattccgcgctcttgccnaangccatttcgagccgnnccgccatttcgggcgtgatggaggnatggncgttgacgatctcggacagcgttttccgggacacgtccaaggcagtggccgcctcggtgatggtgagcttcagcggttccagccagagttcatgcaggatctcgccaggatgcgggggattgtgcaggcgcatggtgtgtttcccttggtgggatgagagcgaatcgaagcgcaggagattgcctcaacgcgctgccccactcttccagaaaaaagcccccttcaaaccctcacctccaccgtccgaaactgctcgttcgactccagga

SEQ ID NO: 690296 - DNA, 127 bp, Homo sapiens
tcgggattctgatccaacatcgagatcgataaaccctattgttgatatggactctagaataggattgcgctgattatccctagggtaccttgttcccgtatggtcaagttattggatcaattgagta

SEQ ID NO: 690297 - DNA, 1143 bp, Homo sapiens
  misc_feature (884)..(884): n is a, c, g, or t
  misc_feature (888)..(888): n is a, c, g, or t
  misc_feature (892)..(892): n is a, c, g, or t
  misc_feature (909)..(909): n is a, c, g, or t
gccttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagaatggctacccaactgttgcatcagtaccccattctatcatcaacgggtacaaacgagtcctggccttgtcgtgttgagacggattacaccttcccacttgctgaacaaggtcaagcctttntggntganccatctgcctttgtggntgctgcccctgtggcttgctgcacaaagctgctcctgttgtgtgaagcccaagctaaggttgaacgccacggaagagtcggagagtcggaacgagcactatgggcattcggtcctcttggactaattcaccaaaaaaggaaccaattagccaggttgtactgtggacaaaccaggcaaccttacgggctacgttctttacaaagtcacgacaaacacaaaaacgacacccaaac

SEQ ID NO: 690298 - DNA, 164 bp, Homo sapiens
  misc_feature (68)..(68): n is a, c, g, or t
  misc_feature (161)..(161): n is a, c, g, or t
acctctagtgtgtggagtagatgcgagtagtacgaatataatagtaactagatgtatgtagggtgtcnggagaactgctatatcatcccaaagggcattatcgagaatcacaaaaacatagctcatcatcccaccatcatagcaccatcaccctccttaanctc

SEQ ID NO: 690299 - DNA, 391 bp, Homo sapiens
  misc_feature (55)..(55): n is a, c, g, or t
aagaggtggataatgtttcctaaagtgaatggcatgtgtaccaacctctgaaggntaaatactgtaagaatgcagtctcagatgaggagcatgagaaaggaattcagacgagttggaattgcatgctttggtattatgtggaggagaggaaaggagataatattaatgatagaatgacaaagttgagttcttaaacattaagaaatttttaatgtttttccaatatttcttcaaattttatcattcatatagatcacaaaactgagtgatcatgagagaaaccaaacattgcctatcttcacttttagacacttggaaagaaactgcagcatttttcctgaaggtcagcagatttccagtgacgtcaccttaattattccccactgtacac

SEQ ID NO: 690300 - DNA, 1031 bp, Homo sapiens
  misc_feature (772)..(772): n is a, c, g, or t
  misc_feature (776)..(776): n is a, c, g, or t
  misc_feature (780)..(780): n is a, c, g, or t
  misc_feature (797)..(797): n is a, c, g, or t
gccttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagaatggctacccaactgttgcatcagtaccccattctatcatcaacgggtacaaacgagtcctggccttgtcgtgttgagacggattacaccttcccacttgctgaacaaggtcaagcctttntggntganccatctgcctttgtggntgctgcccctgtggcttgctgcacaaagctgctcctgttgtgtgaagcccaagctaaggttgaacgccacggaagagtcggagagtcggaacgagcactatgggcattcggtcctcttggactaattcaccaaaaaaggaaccaattagccaggttgtactgtggacaaaccaggcaaccttacgggctacgttctttacaaagtcacgacaaacacaaaaacgacacccaaac

SEQ ID NO: 690301 - DNA, 225 bp, Homo sapiens
agagatacatccccccctggcatctctggagaggaagaaggatggggtgtgcagaaggggctttccccaaacggctccccaggctggcacttctgggccggtgccccactcagtccctgttgacctcccccaccccccgcgaaagaggaaccaaaaccagaaaagaacaaagcatcctccgccccggacccttgaggctgggtctcccccagccctgccactttc

SEQ ID NO: 690302 - DNA, 124 bp, Homo sapiens
tttcagaacctaggggtcctactccaggggaggcagctccatctcgggaagaccaatctgcagagaacgagtcctagtcaagtggaacctaaattctcagtttacccccggaagggagcccaaa

SEQ ID NO: 690303 - DNA, 352 bp, Homo sapiens
tgagccggaatctcgctctgtcgcccaggctggagtacagtggcgcaatcttggctcctggcaagctccacctcccgggttcacgccattctcctgcttcaggctcccgccaccacacccggctaatttttttgtattttcaatagagacagggtttcaccatgttagctgggatggtctcgatctcctcacctcgtgatccacctgcctcggcctcccaaagtgctgggattacaggcgtgacgaccacccccggccgagacatggtacctgttttttaattaacctattatcctttaaatacagttctctagtgggcctctctgatgttgcttatagaataaaacgtcga

SEQ ID NO: 690304 - DNA, 877 bp, Homo sapiens
  misc_feature (104)..(104): n is a, c, g, or t
  misc_feature (132)..(132): n is a, c, g, or t
  misc_feature (141)..(142): n is a, c, g, or t
  misc_feature (291)..(291): n is a, c, g, or t
  misc_feature (308)..(308): n is a, c, g, or t
  misc_feature (320)..(320): n is a, c, g, or t
  misc_feature (331)..(331): n is a, c, g, or t
  misc_feature (345)..(345): n is a, c, g, or t
  misc_feature (347)..(347): n is a, c, g, or t
  misc_feature (370)..(370): n is a, c, g, or t
  misc_feature (384)..(384): n is a, c, g, or t
  misc_feature (419)..(419): n is a, c, g, or t
  misc_feature (441)..(443): n is a, c, g, or t
  misc_feature (476)..(476): n is a, c, g, or t
  misc_feature (483)..(483): n is a, c, g, or t
  misc_feature (517)..(518): n is a, c, g, or t
  misc_feature (587)..(587): n is a, c, g, or t
  misc_feature (603)..(604): n is a, c, g, or t
  misc_feature (629)..(629): n is a, c, g, or t
ctcccccaggatgttgcggaggctgctggagcggctgcacgctggcctgcttgtgggctcccagctggctgtcatgatgtacctgtcactggggggcttccgangtctcagtgccctatttggccgagatcngggaccganntttgactattctcaccctcgtgatgtctacagtaatcctcagtcacctgcctggggccccagggggtcctcacgctcctcaaggtctgccctactgtccagaacgatctcctctcttagtgggtcctgtgtcggtgtcctttagcccangtgccatcactggcagnatgattgtggangctggaagtcnccgggtagaaccangngggccggtaccggcctgcaggtngtgagcgccgctcncgaacagccatcattgtgcctcatcgtgccctggnagcacctgctgcgtcctgctgnnncgtaccgacctgcaccccttcttgcagcgccangcagctngcttgatggcatctatgtcatccaccaggctggnnaatggaacatttaacagggcaaaactgttgaacgttggggtgcgagaggccctgcgtgatgaagagtgnggactgctgttcttgnnacgatgtggacctcttgccagaaantgagcacaatctgtatgtgtgtgagccccgggtgaccccgcctatgttgccgtcgctatgaagcaagttgtggataccagcctcccgtagcccccagtacttcggattgagtctcacgcacttactcctgaacaggtacctgagagatgcaatggcttccccaatgaatactggggctgggggtggtgaaggattgacgacattgctaccagggtgcgcctgggtggaatgaagatctctcggcccca

SEQ ID NO: 690305 - DNA, 1100 bp, Homo sapiens
  misc_feature (841)..(841): n is a, c, g, or t
  misc_feature (845)..(845): n is a, c, g, or t
  misc_feature (849)..(849): n is a, c, g, or t
  misc_feature (866)..(866): n is a, c, g, or t
gccttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaacagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagaatggctacccaactgttgcatcagtaccccattctatcatcaacgggtacaaacgagtcctggccttgtcgtgttgagacggattacaccttcccacttgctgaacaaggtcaagcctttntggntganccatctgcctttgtggntgctgcccctgtggcttgctgcacaaagctgctcctgttgtgtgaagcccaagctaaggttgaacgccacggaagagtcggagagtcggaacgagcactatgggcattcggtcctcttggactaattcaccaaaaaaggaaccaattagccaggttgtactgtggacaaaccaggcaaccttacgggctacgttctttacaaagtcacgacaaacacaaaaacgacacccaaac

SEQ ID NO: 690306 - DNA, 92 bp, Homo sapiens
gctggtacggtcggaagtcgtggatcgccgccatctcttccgtgaggcgcgctgagacccggaccggccctcctgagaggatgccggtgcgg

SEQ ID NO: 690307 - DNA, 520 bp, Homo sapiens
tggttctgtgctcaagtgagtggcttcattcactattcatcctttgtgactggcttatttcattcggcataatgtcctcaaggttcatccatattatagcatgtgtcactatctccttccttttgaaggccgagtaatactccactgtggtgttggaccacatttttgtttatccactcacccctctatcaacacctgggatgtttccatatcctggctattgtaaatagtgctgctatgaagatggatgtacaaatatctgagtccctgctttcaattcttttgggagtgtatcaagaagtagagttcctgaatcatattttttaattttttgagaaactaccatactgttttccatagcagatgcaccattttgcattctcaccagcagtgcacaagggttcccatctctctacatcctcgccaacatatgttatttctggttctgaaagtggtcattctggctgggtgccatggttcacaccagtgatcctaatactttgggaggcacagatagcag

SEQ ID NO: 690308 - DNA, 914 bp, Homo sapiens
ggatcccaggaatcctgtgagcgtgcaccagtgagcagagcagtcatctacgcgtccatctgacttctggcaacgaccgtggtgtcacacccgcggtacctggagctgctggagcgcacgagtcggcccctcaaagatcctgacggcaccaggtgctcaacgacccgtgacgatggaggtggagcatctgatcctcggtcgagtgcaaaggcactcacttggcaacgacggggcgcccactacatcctccgacctgcatgcagcaccttcccccacggacactcaacttcctgccccgtgccatgggcgaggacgctgccctgagggaaatagcgccccagacgaccgtgaattcccacacgtcgtacaaccgagaacaaagatatgatgacatgcggcccaaaggagcatgaataggaagtgactattcaagggaagcagaaggataagcgtcctctttaatgaaagctggtccgctttgcagcatgaatgcaaggaccagaaacgaacagacccagcatggaacgaacccacccacgcacaacactggaaaaagcggatggcaccaatcgcatccaattaggagcaccaaaagctgaagggagtccatacgaagaaacgtgagtgaccgagaaaaagtagaaggaagcgaaggggcaacaagaagacaaaagaaagacaggaacgaaagaagaaaacgaagcgcggcgagacagcaccaagacgcgagataaagcaagacaggcagagggaagccagcagaacaggagaaagacgcgagaggggaacagaaagaggacgaaggcgacaaggcagagcgagatcgaacgaggaggagaagagggagagagagaagaaccgaaaacggagaagaaaaacaagagagcacggggggaggggagacgcagggcgac

SEQ ID NO: 690309 - DNA, 349 bp, Homo sapiens
  misc_feature (315)..(315): n is a, c, g, or t
attcttctgcctcagcctcccaagtggctgagactacaggcgcgcaccactacgcccggctaatttttgtatttttaatggagacgggtttcaccgtgttggccaggatggtctcgatctcttgacctcgtgatccacctgccttggcctcccaaagtgctgggattacaggcttgagccaccgcacctgggcagaggcgggtaaattttgattttactttttcatatagcaggggctgccatctcttatcccccaaccccatgacagggcagctgtgggggactgcagtttccccattcctcgttgcagcttgntgggacctggggggtgaggcaataaagggacctt

SEQ ID NO: 690310 - DNA, 768 bp, Homo sapiens
  misc_feature (334)..(334): n is a, c, g, or t
cgccgccttttcatcccgcgcgtccagtctctccacgccgccttttcctcccgcgcgtcccgtctctccacgccgccttttcctcccgcgcgtcccgtctctccacgccgccttttcctaccgcgcgtccagtctctcaacgccgccttttcctcccgcgcgtcccgtctccccgccgccttttcctcccgcgcgtcccgtctccgcgccgccttttcctcccgcgcgtcccgtgtccatgtctcctccttgtaacattggagagatttccttcactttgtgcctttttctccatcgattgatttctttgttttacgtttaacaattaaagtcnaatttctaagagtgtttgtttcctctttattttttattcacagcatcccctccgtgtttttatgttcttgaggatttcaattaggttttccttctccctgagttctcatctgttccctaattatctcttgtttcctaaagggtccatttttgttttttaatcgttattctcctcttactcctctgtgagtaaatctctgtggttattcattcgtattaaagaccaaggaactgaattgatttttcttgatggatgagatgggtctgtataatagtagctacatccattgcccactcacacattctatcattaactcatttaatctgcacagtagccctatagggcagagtttctctcattgccattttacagaatagatgactgaggaccagagaggttaagaaattatctccaggacgcgccatcgtgcgctt

SEQ ID NO: 690311 - DNA, 353 bp, Homo sapiens
tgggtacagtgacgggcttatgtacagggtcttatccgtagatggtaagttctgggtatcaggctcggtatgaacatgtttaacctctattattgaatatacaaaagttataagaagcaattacgataaccaaaatttccagataagctctatcctcatatccattttctactacacaaggcaggtggacttggcacattcttatccatttgttttacaacgaaacaaagctggtgcctggtgaagaccaaactgacttgcgttgcaggctacattagcgtacgtggcaaacggcacaacgtagcaaccaacggtctcacgggttcagatgcttttggcaccatatcactggt

SEQ ID NO: 690312 - DNA, 280 bp, Homo sapiens
aacattttcttatttttcagggagaaccaacttaataccacgaccggaaataaaacgggcacccctccctgaggaccggggacttccacaggttaccaccggcagccaccccgggggcaccacccaactcagagccggctaaacttggggcccaggccctgaaaaaggccaactgcccaaggaacttaaaactcggggggccctaaccaacccggtgaaccctggggaaccgaggtccccgggcaccccaaacctccagccagctcgggccacccaaccg

SEQ ID NO: 690313 - DNA, 353 bp, Homo sapiens
  misc_feature (164)..(164): n is a, c, g, or t
  misc_feature (263)..(263): n is a, c, g, or t
tgagaggtcctttggctcctgggactctgcccgcagcccacgggggcctggaagtaccagggggactgtaggcccccaggttccccaggagagaggcgggtcacaatgtgagggcttgggtccagagcacctgctgggttgattctgttttccctgtagccagnccatgaatgcccagagactctgcagaacatcagctggtgctgctacctttaaagcatttgtgatcagtctcttgtttagctatgattcattagttgatnctgaaattgctcttattgaaatttgatagatagcattaggattgttaagtactgtttttcaaataaagattgtttaatataaaaaaccca

SEQ ID NO: 690314 - DNA, 138 bp, Homo sapiens
tagaatcacgctcggtacccaccactcctatagatcagtgctcttccgcaatgctgaacaaacggctaatcatcagcctaataatgactaatcacatactataccttccaccacaaaaatgatatctatacatcaaca

SEQ ID NO: 690315 - DNA, 292 bp, Homo sapiens
  misc_feature (124)..(124): n is a, c, g, or t
  misc_feature (147)..(147): n is a, c, g, or t
  misc_feature (168)..(168): n is a, c, g, or t
  misc_feature (213)..(213): n is a, c, g, or t
  misc_feature (221)..(221): n is a, c, g, or t
  misc_feature (252)..(252): n is a, c, g, or t
  misc_feature (261)..(261): n is a, c, g, or t
  misc_feature (268)..(268): n is a, c, g, or t
  misc_feature (280)..(280): n is a, c, g, or t
  misc_feature (282)..(282): n is a, c, g, or t
cccctgggggttgcaggttggggtgcctcaggcccctccttcagcctgtggccccctttggggcacgatgggggctcccccctgcccagtttgcccctcgggttgggggagtatcccaggcctntttgtgggacctgggcccctgangggccttttcagcccgttttnaggacaaacagtcccccaaggtagggtacatcccccccccccagntggtttgnttggatttcctccagcccccgggggcatggnccccctttnttttatncaaaattaaaancnagtttttcca

SEQ ID NO: 690316 - DNA, 201 bp, Homo sapiens
ccctccccaactcccgacactcagcagactggtttttaaatttttttctttcttggacattcttacaacatattttttgacttaagaatgacatctttagacgcatttcagagccaatgatgatatttgctttagataattattatattattataaaaaaacccatattattttgaattcaaataaatttttatcctggta

SEQ ID NO: 690317 - DNA, 491 bp, Homo sapiens
  misc_feature (8)..(8): n is a, c, g, or t
  misc_feature (89)..(89): n is a, c, g, or t
  misc_feature (91)..(92): n is a, c, g, or t
  misc_feature (100)..(100): n is a, c, g, or t
  misc_feature (111)..(111): n is a, c, g, or t
  misc_feature (114)..(115): n is a, c, g, or t
  misc_feature (125)..(125): n is a, c, g, or t
  misc_feature (140)..(141): n is a, c, g, or t
  misc_feature (147)..(147): n is a, c, g, or t
  misc_feature (150)..(150): n is a, c, g, or t
  misc_feature (152)..(152): n is a, c, g, or t
  misc_feature (158)..(158): n is a, c, g, or t
  misc_feature (161)..(161): n is a, c, g, or t
  misc_feature (166)..(166): n is a, c, g, or t
  misc_feature (174)..(174): n is a, c, g, or t
  misc_feature (186)..(186): n is a, c, g, or t
  misc_feature (194)..(195): n is a, c, g, or t
  misc_feature (199)..(199): n is a, c, g, or t
  misc_feature (205)..(205): n is a, c, g, or t
  misc_feature (208)..(208): n is a, c, g, or t
  misc_feature (211)..(211): n is a, c, g, or t
  misc_feature (214)..(214): n is a, c, g, or t
  misc_feature (216)..(216): n is a, c, g, or t
  misc_feature (223)..(223): n is a, c, g, or t
  misc_feature (227)..(227): n is a, c, g, or t
  misc_feature (237)..(237): n is a, c, g, or t
  misc_feature (260)..(260): n is a, c, g, or t
  misc_feature (277)..(277): n is a, c, g, or t
  misc_feature (295)..(295): n is a, c, g, or t
  misc_feature (299)..(299): n is a, c, g, or t
  misc_feature (307)..(308): n is a, c, g, or t
  misc_feature (336)..(336): n is a, c, g, or t
  misc_feature (340)..(340): n is a, c, g, or t
  misc_feature (345)..(345): n is a, c, g, or t
  misc_feature (455)..(455): n is a, c, g, or t
  misc_feature (486)..(486): n is a, c, g, or t
agttgtgnggtttctccaagataaatttaacagctccagcttcagtgtttatcaaaatacaaaagaaaaaagtagaggttgtctttttngnngggaaatnggacccttgcnggnngggggagagnaagctagatgagagnnggaggnggngnggtcgnggnggggngggggtgngggggggggggntggggggnntggngggggnggnggnggngnggggggngagntggtgggggngtgtgtgagggggggggggtgtnggggagggggggggggngtgtggggagaggggggngggngggagagnngggggggtgggtgggatagggtgggtgngggngggtnggggggggtgggcggatagtggggtgggtgtggggtgggagggtggggcctgggaagggtgggaggggagggagaagcagatgggtatggaatgcagggtgagggaaggngaagggagtgggggggatgtgtagtgtgagnatgga

SEQ ID NO: 690318 - DNA, 947 bp, Homo sapiens
  misc_feature (182)..(182): n is a, c, g, or t
  misc_feature (184)..(184): n is a, c, g, or t
  misc_feature (192)..(192): n is a, c, g, or t
  misc_feature (198)..(198): n is a, c, g, or t
  misc_feature (625)..(625): n is a, c, g, or t
  misc_feature (710)..(710): n is a, c, g, or t
  misc_feature (785)..(785): n is a, c, g, or t
  misc_feature (817)..(817): n is a, c, g, or t
  misc_feature (829)..(829): n is a, c, g, or t
  misc_feature (844)..(844): n is a, c, g, or t
  misc_feature (847)..(847): n is a, c, g, or t
  misc_feature (887)..(887): n is a, c, g, or t
  misc_feature (903)..(903): n is a, c, g, or t
  misc_feature (928)..(928): n is a, c, g, or t
  misc_feature (932)..(932): n is a, c, g, or t
aaagggaagctgtgacgtgtagattatttacggggcagactggtaagcgtgccctatcgtttgtccagcagaagtttacgtcttccagtcgttaagtcttttttgaaatagtctgtaaagtaagtggacatgccggtataacgggttaacagtgtcaaaactggggtagaagggattttatntnttcccaanagggtnccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtgacatttctaccagttgtttcagtaacatattggtcttggcatttcttggcactgtggttctgctgttattatttgttgatgtcttattgtttgtgagccttttgttttttttttaaagaaaaaacaaaaactaanttgggactaagttatgttaaaaattgttgttcagttaccaaaaaaatttatttttcctcaaaatcccctaaaatttcctgaattnccattccaagttctttttaaaactcctttccctgcctgaaataaccaaaaaaactttttaattttcccacctttncctaataattccctaaaaaaaatttttgaaanaaatgccttttnccaatttgaaaatgnttnttggccataccttttttttgcccgaaaaaaaattttttcnctgttaaaccacaaantggcccttggtttccaattttttgntttnttaaaactggaactt

SEQ ID NO: 690319 - DNA, 237 bp, Homo sapiens
tatggcatcatttcctggaggtcaacatgaagggctttgacatctgctgtggctctgtcctctccgtttatgtgggctcggggcctccctaggccactggcctccaccgctatgtctggctggtttacgtgctggactggccgctaatgtgtgacgtgcccatcctctgctaccgttctggtgaccaccgtggcatattcatggtggcgtccttccgtaaaaagtatgtgctcagga

SEQ ID NO: 690320 - DNA, 413 bp, Homo sapiens
  misc_feature (91)..(93): n is a, c, g, or t
  misc_feature (100)..(100): n is a, c, g, or t
  misc_feature (106)..(106): n is a, c, g, or t
  misc_feature (115)..(115): n is a, c, g, or t
  misc_feature (122)..(122): n is a, c, g, or t
  misc_feature (162)..(162): n is a, c, g, or t
tctagaggatcgccaaggttacatcacggggagggaaactccttagggggacacttacagatcttccttctgcatccattcaccatgcttnnngtaagtntcgatnttgatgttntccccanggttacagaagagaatggtgagcaattgccatgttacttngtcatggtaagcctacaagaagttggaggagttgaaactaagaactggacggtccccagaaggctcagcgagtttcagaatttacaccggaaactcagtgaggtatgaatactcatgaacgcagtattctagaattactgcacaagagctcatttcaattttacacataagaaagctgattaatcttcttcctttgctgttgatactggcacagtggcattttcatcctgacatttggaaatttactcata

SEQ ID NO: 690321 - DNA, 157 bp, Homo sapiens
  misc_feature (9)..(9): n is a, c, g, or t
  misc_feature (27)..(27): n is a, c, g, or t
  misc_feature (116)..(116): n is a, c, g, or t
  misc_feature (149)..(149): n is a, c, g, or t
ttcctgggntgaatctaaaataaattntgaaatgggttagggtagagtgaaccatcatcttactttactttccggatattcttgtattcctttccctacgtgttaaagacctacanattttccttagctccccagtgcagtggacatgnttcaggtc

SEQ ID NO: 690322 - DNA, 213 bp, Homo sapiens
accacccacccccaccacccaaccttagggttacaagtaaagatgttccccaaaacttctggctgattttatggctaaaaagttttcattggatttattaataacccatgttttaccttttgaaaaaataaatgaaggatttgacctgcttcactctgggaaaagtatccgtaccattctgatgttttgagacaatacagatgttttcccttg

SEQ ID NO: 690323 - DNA, 103 bp, Homo sapiens
gagttgtgggaggaagagagggctgggaaggtaagtgtgtgcattggtgtgtgtgtgagggttcacctgccaatgctgagtacgactgagcactttaggtcta

SEQ ID NO: 690324 - DNA, 100 bp, Homo sapiens
ctagagttcccaggcacagctctactttaattgtttctgaaacccttaaagtaaggagcagcaatttcctgtaatagtgcaatagtaaatatttaggcta

SEQ ID NO: 690325 - DNA, 367 bp, Homo sapiens
ttcaaccgggcgaaaccatctttatcgaaaatggcagcagcaatgccctactcgcccggactctgggcgagcagaagaaaaatgtcactatcatcacggtcagcagctacatcgcgcatttgctgaaagacgcgccttgtgaagttattttgctcggtggcgtgtatcagaaaaaaagcgaaagtatggttggccctttgacacggcagtcatccaacaggtgcatttcagcaaagcatttattggtattgatggctggcaacctgaaactggatttaccggtcgcgatatgatgcgtaccgatgtggtcaatgccgtgctggaaaaagagtgcgagaatagtcctgactgacagctcgaaatttgg

SEQ ID NO: 690326 - DNA, 135 bp, Homo sapiens
actgtaatatgtatttactcactacttgaaatgtgtcgttgtatttacttgcctgcagaaggtcagcccacaaagcagacttacctgttctgtacttctgggccagcacagatcctgagcccatagtaggtgctc

SEQ ID NO: 690327 - DNA, 237 bp, Homo sapiens
cggtcatcgtcgtggtcgttgggtggaaagataagtgaatataatatatgggcttggagtcagataaattgtagtttgaatactgtctcaaattcttattcattgtatggcattcatcaactgagagtctgcttatcagtctggtgggataaaggaggtaaaataatcactctccaatgacaaatttgagtatctgtttaattttgacaacacatttgaaaaccacgacgacgacga

SEQ ID NO: 690328 - DNA, 238 bp, Homo sapiens
caccggctgtgtgtctggcactaggtgagtgtccgagtttctagtatccgtgtcatcgtaactagtgaatctgctctctttctgccccgcccttcgctacggcttcatgcatatctcccccattgccaacactctgtaggcggactcccgctcccgccctttctcctcatgcacccggcctcgtctctgtagtctctgcacttgtctcccattaaggtcccatccatggtgcggcgga

SEQ ID NO: 690329 - DNA, 1105 bp, Homo sapiens
  misc_feature (585)..(585): n is a, c, g, or t
  misc_feature (661)..(661): n is a, c, g, or t
  misc_feature (668)..(668): n is a, c, g, or t
  misc_feature (685)..(685): n is a, c, g, or t
  misc_feature (692)..(692): n is a, c, g, or t
  misc_feature (704)..(704): n is a, c, g, or t
  misc_feature (728)..(728): n is a, c, g, or t
gtctcgtgatttggcttcttcctcggcgttttgtccaattcttgttcttatttagtgtaagcttgttggtgtatcttgtgatcttgtttcatacttatttggtttttgtcgtcatttcctgttatgatgttttccttttattgcacatgatctgtgattttccctggctcaatacctaatctcttgccattttactgggttttttatagctatcctgatgtgtcttttttcttttcacattagtttgtgtcatttttaccatcttctttgtgatttcttgtgtgggttccagtcatttatgtattcggtttcctgctaaactttggtatgttttctctgtgtctgcattgctctgtatatgactgttcctagggaacctttttttacaattgatgggactgaccatcttctcacaacttcaggtacttcactgtgtcccggtacatgtccccatgaagatgaagtccagtctacaatggacatgctcctggggcctccctcaagtcctgtgtgtattgaacggcacagaggcggcgctagctgagccacctaaatcccaggacggtaagggccgggcggggccancctgccgcaggctgtccgcagcagcaagatcgcggctgtcggcctgcaagcagcagtgaggctggcagcctgcagncgtgtcnaggagcccgccaggtgnccgcgcnaggcctcagtcntcctgcgggttccgccgccctccnggagaggtggccgccatgcttcttgtgccgaccacgccccaggacctccggagcgccctgcagggccgggcagggggacagcagggaccgggcgcagccctcccccttcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctacgtctttgggtttggatg

SEQ ID NO: 690330 - DNA, 217 bp, Homo sapiens
caagatctagaaaatagcttcagaagggcaaatccaagaattattggccttaaaggaggtagagagagagagataatggtggaaagtttattcaaagggataataagataccttcccaaacaaaagatatcacagtttaagtacaagaaggttatagaccaccacgcagatttactaaaggagattactcacggcatgtatacaccctacccaggtc

SEQ ID NO: 690331 - DNA, 945 bp, Homo sapiens
ggtacccggagcacggaggatctcgccgggttaacgttcacctcggtgtgctgctgcaaccctccgcttcctctcctaggcgacgagatcccagtggactagaagtgcaccatgtctattgcgtcaagatccatggccgagggatcatctttgacggtctcgcgcggcaatcccaacttcgttggacggttgatctcgttcagccttcaaaaggtcgtcttcaggacgcttgcgtgtgcccatgtggtgctttgcagatctggtatctatcgaggccctagatgctcccgcgtgacattgatagagactgcgcttatgattgggcgaacgtggtgtcctcctaaatggctgtatggagcgacttcccattaaagaactctgattggcgcctggacctcggtgtagcgaaccgaaaggtgaactgtgcacagagacacaggagaacgcatgttgactacaacacctggatgtgatgcgaccgatgcgagtgggaacaagagcaaagtactagtccgaagggtttggtgtcgtcgagagcggccgctttctcgcgtgctgttgttcgcctctggccagttgtgccctgagtcgtgtgccgtcctgtctgactaaggagcgggtccccacactagtctcgggcccctgaattacgcttgaacttcgagctcggtcatactaacttgaactgaccattccttgacacggttcaaccgcgggtaacaaaggagttcatccattgggcacggattcacactgctaggtggaaccatgggtgaggcaatgcattcgagggttcgcattgaatccttccacagtcacgattggcactgaaaaggttccacgggaaggccaatgggcggtttcgcgagccgggagcgttcacccgcagagctcgaagtgaatggctcagtcaaccgacagaaaattatgggaggagattgccac

SEQ ID NO: 690332 - DNA, 642 bp, Homo sapiens
  misc_feature (12)..(12): n is a, c, g, or t
ctttggaaagcnttcccaagaaagatggaaacaaagaagcccagactctgaagactacaataaatacataattctagatcgcgagcggccgcccttttttttgtccgccacacgtaactgagatgctcctttaaataaagcgtttgtgtttcaagttaaaaaaaaaaaaaaaagaaaaaaaaaaaaaaataaaaaaaaaaaaaaaaaaacaaaaaaaaaaaaaaaaaaaaaggggggggggcccgagaaacctcccgggggggccccctttgttcgacgagctttttgtgagaagaagggggctgccaaaagataggtgtctgttagaaaaacatcagaaaacgggaggggagattaaaacaacaccggaagtgataggaggggcatagaggctatgaggtcggagggatgtctcttgagagaagagggaaactattctttattggtgggggggggggaagaactaggtggaaaaagtacgcaccggagaataatgtttaagaggtggtaaagggtaaatattcatgacttggagggcggtttattatggtggtctagacgtcacggggatatgatggagggaggggttagaaaaatgtgttctctacggagaggtgatatctgaatatatgttttccgggg

SEQ ID NO: 690333 - DNA, 639 bp, Homo sapiens
ggccgggcgcgggggttcacgcctgtaatcccaggtctcagtgagggtaagcaggcgggaggataggcttgagcccagcgagttgctgaagtacctgtcctgggtcaagtatagcgagaccccggttctcaccggaggcacaagagaagtcaaacaatcacaataaaagcaaagtcgacgcaccacggagagggctatgaaagaactgtaaatgataccagaacgtaaggaggcgcgtcgagtgaccgaaatcacgtgtcgtcaggcaaggcacacaataggacggtcacccgaagacagaacacgagatagacaactttggtgggaaatcgatgctcaacaattacacaaaagcgcgcgcgggagggtaacgaacgggcgtgtggtggagaaaaacagactcgagacgagtgcgtgcacacggggccgggcttccaaaggaggagagacacaacaagtggagaggccacacagggcgagaaggaaaagaaactaactacatatgggccgacccacaagccgggaggggggacagaatggctcccagaaaaaataaccaaagaaagaaaaaagcaaaattccaaaaaaatttggaacagacgccaagaagaagaagaaaaaggctaaaccgaaggaata

SEQ ID NO: 690334 - DNA, 756 bp, Homo sapiens
  misc_feature (1)..(1): n is a, c, g, or t
  misc_feature (70)..(70): n is a, c, g, or t
  misc_feature (126)..(127): n is a, c, g, or t
  misc_feature (134)..(136): n is a, c, g, or t
  misc_feature (144)..(145): n is a, c, g, or t
  misc_feature (157)..(157): n is a, c, g, or t
  misc_feature (162)..(163): n is a, c, g, or t
  misc_feature (194)..(194): n is a, c, g, or t
  misc_feature (196)..(196): n is a, c, g, or t
  misc_feature (218)..(219): n is a, c, g, or t
  misc_feature (222)..(222): n is a, c, g, or t
  misc_feature (227)..(228): n is a, c, g, or t
  misc_feature (254)..(254): n is a, c, g, or t
  misc_feature (289)..(290): n is a, c, g, or t
  misc_feature (293)..(294): n is a, c, g, or t
  misc_feature (319)..(319): n is a, c, g, or t
  misc_feature (338)..(338): n is a, c, g, or t
  misc_feature (567)..(567): n is a, c, g, or t
  misc_feature (586)..(586): n is a, c, g, or t
  misc_feature (603)..(603): n is a, c, g, or t
  misc_feature (607)..(607): n is a, c, g, or t
  misc_feature (630)..(630): n is a, c, g, or t
  misc_feature (744)..(744): n is a, c, g, or t
ncccccggctactgcctgggaggaaaccccgctgttcgcgttgctcacattcgccttttcgagtacaaanacagcttcaaggggcctcacctgtgtgcagagcgacgggaccttgcccttcttggnncactcgnnnaattctannccaaattcaaancaaannctaatatcaccaactttaaaaaaccaaaaangntcagtgtggacaaaaacaaaannggnctttnngaactgggaagttgaggtgacatttnttttttttttttttttttttttttttttttttttnnctnncaattttggtatgcagaaaaacaangcttggagggccctgtgtntggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtnatgatcaataatggctttncaccagataaaaaagantatnaattttgtgccaaagtggaaaanatgattatccctgcacaagggcattttggaatatctgctgcaactggaggtcttgcagatgaccatgatgtcctttcttttctgactttccagttgactgaacctggaaaaganccgcccacacca

SEQ ID NO: 690335 - DNA, 694 bp, Homo sapiens
  misc_feature (222)..(222): n is a, c, g, or t
  misc_feature (236)..(236): n is a, c, g, or t
  misc_feature (391)..(391): n is a, c, g, or t
  misc_feature (422)..(422): n is a, c, g, or t
ttatgaggggtttggtggcgcggtcgggggggcccccgctgtttttccctataaaacgcggggtctccctccggtttttttgtggggggggggatatttttccccggcacttttttctctggcttttttggcccttttaaatgttgtttaaaaacgggttggggggggggtttttcgggattttttccccccggtgggggggggttttctaaaagccccccngcccctctgaaaanattttttttaaaaaagggggggccgggaacccaggtgtgtcccttcccccttccggggggggttttccaaaaccgggtggccttccctgctggttgagggtttttttccccccccctccccgtggggggggggacattgggcccccgaaaaaaanaataaaaccccccccccccgggtgggggggnggggggtttttttttttttttaaaaccccccccggggaaaaaaagggggggggccggggggggttttttttttttcctttttggtttggggttttgcccccccccccccccgaaaggggcttttcctttttccggggtttttttttgggggggggccccgccccccccccccggggtttttgggggggggggggggtttttggggggcccccctttttttttttttccgggccccccggggggttttttggcccccccccccccctggggga

SEQ ID NO: 690336 - DNA, 124 bp, Homo sapiens
atacaacatattcaatcgagctcgttaccccaggtagactaacactactactaatcagccataatcatacaaagcccccgcacaacaggatcctcccgaatcaaccctgacccctctccttcat

SEQ ID NO: 690337 - DNA, 423 bp, Homo sapiens
tgcggtggctcacgcttgtaatcccagtcaataatttgggaggctgaggtgggtggatcacctgaggccaggaattcgagaccagcctgaccaacatggtgaaaccctgtctctactaaaaatacaaaaattaactgggcgtggtggcggagtgcctgcaatcccggccttttctttctttttttgtggagacagtcttgctctgttgcccaggctggagtgcagaggtgcaatctgtggttcactgcaacctccggctccacctcctgggttcaagcaattggtcctgcctcagcatcctgagcaagtcgggatttacacggcactgcggcaccacactccaggctcactgatgcaactcgtcggcggcctcaccctcgcacacggagcccagaccggctgcccgccccgcccagacccccc

SEQ ID NO: 690338 - DNA, 1042 bp, Homo sapiens
  misc_feature (15)..(15): n is a, c, g, or t
  misc_feature (33)..(33): n is a, c, g, or t
  misc_feature (39)..(39): n is a, c, g, or t
  misc_feature (941)..(941): n is a, c, g, or t
  misc_feature (1041)..(1041): n is a, c, g, or t
acgggacaaccaaantaaggctaggtcgaggcngggtgntgaatcggccgaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggcgtggccggcgtgtgtcctacccttcgacacggtgcggcgggcatgatgatgcagccggcgcaaggagctgacatctgtcaccggcccgccatgtggggaaactccaaaaggggcaggccctcagggggggccncgccggggaggggccccgcgcaaacaagaaaggggcccacacacgggaaaaaaccgcacacaaatttgccttagctagccttttgttgttttttcctggng

SEQ ID NO: 690339 - DNA, 759 bp, Homo sapiens
  misc_feature (26)..(26): n is a, c, g, or t
  misc_feature (34)..(34): n is a, c, g, or t
  misc_feature (49)..(49): n is a, c, g, or t
  misc_feature (65)..(65): n is a, c, g, or t
  misc_feature (70)..(71): n is a, c, g, or t
  misc_feature (79)..(79): n is a, c, g, or t
  misc_feature (91)..(91): n is a, c, g, or t
  misc_feature (103)..(103): n is a, c, g, or t
  misc_feature (106)..(106): n is a, c, g, or t
  misc_feature (124)..(125): n is a, c, g, or t
  misc_feature (129)..(130): n is a, c, g, or t
  misc_feature (174)..(174): n is a, c, g, or t
  misc_feature (183)..(183): n is a, c, g, or t
  misc_feature (188)..(188): n is a, c, g, or t
  misc_feature (200)..(200): n is a, c, g, or t
  misc_feature (222)..(222): n is a, c, g, or t
  misc_feature (248)..(248): n is a, c, g, or t
  misc_feature (274)..(274): n is a, c, g, or t
  misc_feature (278)..(278): n is a, c, g, or t
  misc_feature (284)..(284): n is a, c, g, or t
  misc_feature (293)..(293): n is a, c, g, or t
  misc_feature (306)..(306): n is a, c, g, or t
  misc_feature (368)..(368): n is a, c, g, or t
  misc_feature (385)..(385): n is a, c, g, or t
  misc_feature (395)..(395): n is a, c, g, or t
  misc_feature (412)..(412): n is a, c, g, or t
  misc_feature (415)..(415): n is a, c, g, or t
  misc_feature (419)..(419): n is a, c, g, or t
  misc_feature (431)..(431): n is a, c, g, or t
  misc_feature (434)..(434): n is a, c, g, or t
  misc_feature (441)..(441): n is a, c, g, or t
  misc_feature (497)..(497): n is a, c, g, or t
  misc_feature (508)..(508): n is a, c, g, or t
  misc_feature (522)..(523): n is a, c, g, or t
  misc_feature (526)..(526): n is a, c, g, or t
  misc_feature (535)..(535): n is a, c, g, or t
  misc_feature (577)..(577): n is a, c, g, or t
  misc_feature (612)..(612): n is a, c, g, or t
  misc_feature (614)..(614): n is a, c, g, or t
  misc_feature (618)..(618): n is a, c, g, or t
  misc_feature (661)..(661): n is a, c, g, or t
  misc_feature (679)..(679): n is a, c, g, or t
  misc_feature (695)..(695): n is a, c, g, or t
caccattttttataccaatctccatntttttttnaattctatttattanttttatatcttttttnacttnncctccttntatcttctcttnattttccttttnctnaattttttacctttcacnntcannactttttacactctcatttccccttactttcttaattacttctnccccttctntcatnttcccatccttntctattatatctactccaatanatacactcttcatatctattactttntttattatactctttttcctccctanttcnccatcntttctcctntttacatttattncaacacctccttcaactactttttccacatatttctcctctttcattatataacccttttcnctctctattactaatcnctttaccatnatcttcttctctccctntcnattntttacatctacnttntctctcncctttatcactatctttctttttatcctcatcttctctatttcctcctcctcttcntttacttctanattctcactctttnntantttatcctncttcccaatcttcacatcttctacacttttttctctcatttnttccatttttcatcccctcttatttttcttcttantntatnctttacatctctattcattataaatatttcaaatacacttttnctcacatctcctatatcntttcttcctaccttcnctcctttcaccccctctatctccccacccctcttctttctcccaataaaatcatctttttcttt

SEQ ID NO: 690340 - DNA, 498 bp, Homo sapiens
gatccccgcaaaggagccaggagcgtagcgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttcttcagcgctagcccctgttttgcacagccgagtactggcgagtatgttctatgttgggcctcctgctgcaaaacaataaacagaggacgcaga

SEQ ID NO: 690341 - DNA, 671 bp, Homo sapiens
aaggctctagaaaaggttcgcattgcgatccatccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggtgtgggagggaaccgtggcgtccctgcgtggggcccatgggtgagacactccagtactgagacctagagtccagatgcttgtaggagccaagtcgtgttctaagtatttatttaaaacataagaatcacggttttccattttgtaaaataaaaaatccacttttcaagtcattgtcatgcctatggttccatgtttgtacaagctccattggggtggtctatttcaaccatgaggcagctcgttttggctccttaacaagcaggaatttgcatggtggcccgctttcactacgatatttttcctcttgcttt

SEQ ID NO: 690342 - DNA, 352 bp, Homo sapiens
  misc_feature (352)..(352): n is a, c, g, or t
cagagacgctgttattcagacattatgatctcgatgcgcaaatggcattgcacatcctcgatttgccggtgtgacatatataccggctgccggatctggcgcattactggaactcaggagcgactgcagaaggggccaatgctcatggtatcgccacgctaagtatcagacatcgtgctcatgacatcacttgcacactatcgctgaacgaagtccatttactgacaaatgcctagtcataccgtaaggtgtagggccatgtctaatggtttgaacgtgaactcgtgcttagctcctgacgttcaggcacatgcacacgccttggaccctattgatcgacataccactgtgn

SEQ ID NO: 690343 - DNA, 284 bp, Homo sapiens
  misc_feature (1)..(1): n is a, c, g, or t
ntgctgggtgatctagaggatcccattaggcgcgttctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaacgcgccttaatggatcctctagatcacccaca

SEQ ID NO: 690344 - DNA, 251 bp, Homo sapiens
  misc_feature (1)..(1): n is a, c, g, or t
ntgctgggtgatctagaggatcccattaggcgcgttctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcaga

SEQ ID NO: 690345 - DNA, 443 bp, Homo sapiens
  misc_feature (30)..(30): n is a, c, g, or t
  misc_feature (34)..(34): n is a, c, g, or t
  misc_feature (246)..(246): n is a, c, g, or t
tttggaggaagggggaggggggcccaaaancaanacccccctccccggggggtgggggatttttttaaaaaagtgggccccccggttttcccccttgaaaagggggggggggggcccccccatttatttggggttggtcccccctttgggccccccgggttttcccttttttgttcccggggggattttgggggggaatgggggggggaaaccattttcccccggggacccgttttgcctggtttnggattttttacccccccccatagggggtttgggcccccggggccaaaatttggggggggggcccccctaaacccaaaccccttcccccccaaaaaattggggccggttaaaaaaccctgggggggggtcccggtttgggggggttccccgggggattttttttaacccctttaaaaaacccccttttttttttttga

SEQ ID NO: 690346 - DNA, 282 bp, Homo sapiens
gcggccgcctactactactactactgctcgaattcaagcttctaacgatgtacggggactgcgtggggcccatgggtgagacactccagtactgagacctagagtccagatgcttgtaggagccaagtcgtgttctaagtatttatttaaaacaaaaaaaaaaaaagaatcacgttttcccatttgtacttcagcgctagcccctgttttgcacagccgagtactggcgagtatgttctatgttgggcctcctgctgcaaaacaataaacagaggacgcaga

SEQ ID NO: 690347 - DNA, 2338 bp, Homo sapiens
  misc_feature (122)..(122): n is a, c, g, or t
  misc_feature (2136)..(2136): n is a, c, g, or t
  misc_feature (2157)..(2157): n is a, c, g, or t
  misc_feature (2160)..(2160): n is a, c, g, or t
  misc_feature (2162)..(2162): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccacgcacctctccacagggcggcctggggtctggagatgggcgctgggcccacgggacgcagatggggccacgctctgcccgtggctggcccacgttcctggtctgcagtgctgcctcctccccagcacccctggggcacagagggcagggtcacagctgggaagaggcggggggtagaaaccaaggctggcagaagtgtagccgggctccctgataaatgctggaggaccccagggcacctgcacttactgtaccctctctgagagcatttgtatgatctcatgtctcagctctggaggctggaggtcccagaaaaccaaggtatggtagattcagtctctggtgagtacccagttcctggcttctagatggcgccttctccctgtgtgtcctcagatgatggatgaggccagggtgctctctggagtcctttctgtaagggcactgatcccatccatgaggcctcatgactcccaaagacccccactttccaacgccatcacttgggagaggggcgttttcagcgtgaatcttggggaanctgaaacagggtgacacctgngtncntctcactctgtagctcccgaaggccactccagcccccattccaacatgaacagtggaagtggtcggggtccccaaattggcagctgtggttccccggggttcacccgtgagaaatccaccccaagggggtcccccccgcgagggaccaaaagcttccttcaagcttttttttggtc

SEQ ID NO: 690348 - DNA, 911 bp, Homo sapiens
  misc_feature (7)..(7): n is a, c, g, or t
  misc_feature (74)..(74): n is a, c, g, or t
  misc_feature (89)..(89): n is a, c, g, or t
  misc_feature (109)..(109): n is a, c, g, or t
  misc_feature (124)..(124): n is a, c, g, or t
  misc_feature (162)..(162): n is a, c, g, or t
  misc_feature (178)..(178): n is a, c, g, or t
  misc_feature (243)..(243): n is a, c, g, or t
  misc_feature (245)..(245): n is a, c, g, or t
  misc_feature (303)..(304): n is a, c, g, or t
  misc_feature (361)..(361): n is a, c, g, or t
  misc_feature (442)..(442): n is a, c, g, or t
  misc_feature (445)..(446): n is a, c, g, or t
  misc_feature (450)..(451): n is a, c, g, or t
  misc_feature (454)..(454): n is a, c, g, or t
  misc_feature (462)..(463): n is a, c, g, or t
  misc_feature (695)..(695): n is a, c, g, or t
acaaaanactgatgacaaatttttaggtcaaggtagtatccattaaaaagtactgatttaaaaaactaaataanttaaaactgcaacangcaaaaaagaaaaccaaagnggtccacaaaaacantctcctttccttactgaaggttttacgatgacattgtnatcattaacacaggtnttttactactaaacttaaatggccaattgaaacaaacagtactgagaccgatacttccaccactnantaagagtgggagtggcaggtataagggataatattcatttagccttctgagctttctnngcagacttggatgaccttgccagccccagcagccttcttgtccactgctttaatganacccaccgcaactgtatgtctcaaatcacgaacagcaaagcaaaaaaaaagaaaaaaaaaaaaaaagctctaaacaaaaanggnnatannaanaaccatannaacaatggcagcatcaccagaattcaagaatttagggccatcttccagctttttaccagaacggcgatcaatcttttccttcagctcagcaaacttgcatgcaatgtgagccgtgtggcaatccaatacaggggcatagccggcgcttatttggcctggatggttcaggataatcacctgagcagtgaagccagccgcttccattggtgggtcatttttgctgttaccagcnacgttgccacgacgaacatccttgacagacacattcttgacattgaagcccacattgtccccaggaagagcttcactcaaagcttcatggtgcatttcgacagaatttacttccgttgtaacgttgactggagcaaaggtgaccaccataccgggtttgagaacaccagtttccactcggccaacaggaacagtaccaataccaccaattttgtag

SEQ ID NO: 690349 - DNA, 1578 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcaga

SEQ ID NO: 690350 - DNA, 1555 bp, Homo sapiens
  misc_feature (122)..(122): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtaaacaacacccagcctcgctacctagcctagtgtgtgtgtcttttttttttttctatttttttttttcttgg

SEQ ID NO: 690351 - DNA, 459 bp, Homo sapiens
  misc_feature (41)..(41): n is a, c, g, or t
  misc_feature (63)..(63): n is a, c, g, or t
  misc_feature (109)..(109): n is a, c, g, or t
  misc_feature (354)..(354): n is a, c, g, or t
  misc_feature (448)..(448): n is a, c, g, or t
ccagggggttcgagttcgaacagctgaggtttgaggattgnttttattagggccttccacggngacctcaatgtcagttttctttgaattactcccaccacttcgtggncttttgggggactgcaaagctctagtgtttattttactagccatcccaggaggcaagtaggaaataactagttcaggttttttaacaacgaacttgattttattactcccgtggacgatcctttcaagtcgtggaattccaaaccaggtagggcttcggaagggaatcccctctggcaagccttccacatagaagaactccgggtttgattcaaacacaggatatggtacttttactgcctcggngagtccaagagcttgagcaaatttcaaattaaaaatctcttccacttgctttcgtagcttggtaattctgacactccaatcttctttgactggngtattcgttct

SEQ ID NO: 690352 - DNA, 2428 bp, Homo sapiens
  misc_feature (122)..(122): n is a, c, g, or t
  misc_feature (1623)..(1623): n is a, c, g, or t
  misc_feature (1629)..(1630): n is a, c, g, or t
  misc_feature (2428)..(2428): n is a, c, g, or t
cacggatcggcagcgggactgagccgcgcccacgtggaagccgccgcaggcttcgcgcggggccccccgggtgcacgcgggcagggccggggtctcccgacgcacgaccccggagagtgttnaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcctggccaaaaaaaaaaaaaaaaaaaaaaaacaanaacaannaacaaaaaagaaaaaacacaagacaaaaacaaaaaaaaatcaaaagaaaaagaagaaaacgaacaacagaacagaactagcacagaagactaatagtataggagagacaacacacgagcaggaccacacgaccagacgcatcggacgaccgcaaacaagccgtccctgcccatgcagctatctaaacgaccacgaggcatacacaaaacgtaagcacatacagacacactataaggggcaacagccgaccactggcacggacctatgagcccacccctactagcaagaacaagacttgatccggagctgggcaagccgtacacataagaagagaaagaacaataaaattctacagagtaaataagaaatgcagataaaaaagtaacagcagggacacaacatgatcacttgagtatactaatttgatcaaaataattgaaaactgaaggatattaaaaaaatcaaaaaagatatctgaaaagagaaagaaaaaacactaaaatagcgaaataaacacactaggagaagcaaacatacagacgagaggcagaacaatgaagcgcaacagacaaaactacaagagagaagcgggagacaaaagcaggcaacgactagcactgagacagtgagcaccaacaaaaaccgaaagcgaaaacgacagagcaccaaacctagaaaccagcgcacagcacggcaacgccacgaggccacacaaaagcaaccgacgagagcaaaccaacgacgagaatccacagcgcaagtcaaaaacagacacaacaaacacagcccgacgcgacn

SEQ ID NO: 690353 - DNA, 170 bp, Homo sapiens
cacaaaagacgcctacaagaagtacatcaaagattacatgaaatcagtcaaagggaaactcgaggaccagagaccagacagagtaaacccttttatgacaggggctgcagaacaaatcaagcacatcctgctaatttcaaaaactaccagtctctattggagaaacatga

SEQ ID NO: 690354 - DNA, 284 bp, Homo sapiens
  misc_feature (127)..(127): n is a, c, g, or t
  misc_feature (165)..(165): n is a, c, g, or t
gtctctcgtgcagctgcctggtcatctcagttccgcacggttgggccgcctagaaagctctgcagcatggtagatcgatccaggctctctactgatttaaggtcaggtcagatgaagtatcctagtntcaaatacaggagctgtgcttgctgtgtgcagcggacncagcacacacggccagttcctatcctagtgggtgatactggtggggaggattgtggccagagctgacccctccccaagacatccctcggggctacctttcctcctcctgctccccccgg

SEQ ID NO: 690355 - DNA, 254 bp, Homo sapiens
  misc_feature (89)..(89): n is a, c, g, or t
  misc_feature (122)..(122): n is a, c, g, or t
  misc_feature (133)..(133): n is a, c, g, or t
  misc_feature (145)..(145): n is a, c, g, or t
  misc_feature (226)..(226): n is a, c, g, or t
tatgtgcgcttcggcgctgctgtggtgagctgagcgtggttctatgacaagcacatctggctctccatatgggacccggcacctcgtangctgtttcactcgcatccagagggccacctgcntgcgttctccntcatctgcctcnttcctgggcgccaacgccgtgtgggtacggggctgttggtgactctgctctacagcaccggggcaatgtgtccacggctgnagcccggcttgagcgtcgacacatgtcg

SEQ ID NO: 690356 - DNA, 156 bp, Homo sapiens
tcttccggcagtagggactcatgggcagtagtctggatgagggagatacaacttcctttggaaactccggcgatacaactcctatgatattagcagagacacccggtatgtttcgaaaggtatatgctggatcacagcggtaaccatttcgagatg

SEQ ID NO: 690357 - DNA, 206 bp, Homo sapiens
gccagttttaagctcacttgagtgaagtttaagtcacaagattctgtttaacatgctttccttgttttggaaacaaccaaaaacttcccttttttgttacgggattttgacctacaaatcctaatcatgtttaaaatgagccggtgctgggtagatgactattgtgcctgcgcggttcgactcatatgttaaggagaagttgaaat

SEQ ID NO: 690358 - DNA, 107 bp, Homo sapiens
atccactatagatttttcaatgtatctcaaggtacgggaacagcagtaaaggtactgaaggagacggtcagattactgcaattctggaccagaagaactatgtagaa

SEQ ID NO: 690359 - DNA, 713 bp, Homo sapiens
gtctttagaccgtgcgagtcaatgcctgactgacactgcgtgatgcccagggtaacacagggccacgctcaacgtccaacttcttccttaagatcatctcaactattggatgatgatccgaagtggacactcgtgagaacagacctggtgctctacgatcatatgcagcaaatgctgatgtaccttcccagaacggctgtgctgctgatgggcacacaacaccatgatgcgctaggtcgtccgagggcacctggaaaacatcccacctctggagagactgctgcctcattaacgggggaatgggggcttagtgttcaccaaggaggacctcactgagatcagggacatgtggctggccaatgacgtgccagctgctgcccgtgctggtgccatgagccccatgtgaagacactgctcctacccatagcactggtctaggacccgatatgacctgctttgtacaggctgtaggtgtccccgcttctcgcggggccccattgaaatcctgagtgatgtgctgctgatcaagactgtgcacaaaccgagtacgcagcgaggcactctgttgaacatgctcaacatctggaccttatcctatgggctgagtcttcacaggtgttgcacatgtgagaatctccacccttgggagcttgatgtccaacatgctccgcttctcgcttggtgggcgccccctgttggccgtggctgcctgc

SEQ ID NO: 690360 - DNA, 1382 bp, Homo sapiens
  misc_feature (33)..(33): n is a, c, g, or t
tcgagtgctcttcgtcccggaatgtcgcccggnggatgtgtcttacccacactgtgttctgttagcgcgcccccactggggccccaggagggcctagagtactctggcccgcgggcaagattttgggcgccccgggggcccacgtcgggggtttaccctgcgcgcgggccttctttttggggcgcttcttgttcttggggaccgcctcttttaatgtcgccccggggaccggctgtggggttgcccccgccaccaatgatacccaggcgttgctcaggagacattctcttggtgacacatctgtcgtggtttccgggtcgtttcgttaaaaaacgcggctcggccaaaaatacccccagcacaccaaccggcggtggtggcgggacgggccaaatatctgtgcgcaccggagcgaatgtcgcaaatgacgggggatgtccccgcgccacaaccgggtccccgaagagcaccaatagtcgcggggtgtacccgcggcgcgcttaagataggggcgccgcttcccgcgggttcgagaaccccccccacaataggggcgaacaaaggggcggggaattccccgacccggcgcgggcgttccgagagaggcgccgggggggccaccccgcgcgcgcgggggtctccccccgcggggttggcactcgcgcggggcacagcgcccgcgtggagaggccctcacacgcgcgaaatgggtgcgcgataccgcgggtcacaagaaaacctcgcgacacacacggcacaccacacggtgtcccgctgtcgcccgcgcttgtgtccacacacacacacccacgcgagaggtggagaggggcgctctttgggggagaagaacgcgcggagaggggggagcgcagcctgcgtggaaccccttgtggcacacactgtggcgctgtcttctgggaacagccacactgtgggagagccgggagaggctgttctgttggcgcgctttccagacacacagggggggcaccctctctgtgtgtgtttcctctgtcacgattcacgcgggtggagcacgcgatatggagaagccccacacccggggggcacaccacaagagaggtccacacgggcacagcccacagggccacaacacacgcccacacaaacgctggagaaggccacatggagaaggcacatctttctacatcacaagccctatggtgtggagagccctcttgcacagggtctctcgagtgaactcttgagagtgtttggagatggagatgggtggagatggagagggtggcacaggtggggcgctttgcacagggccacacttttggcacagaagaacctttggggtttttataggggtcctcaagatgcctttgtgattaaaaaaaagattggtttatgga

SEQ ID NO: 690361 - DNA, 125 bp, Homo sapiens
gaacgggtgatgcgtgttgttgagggactggcctggaaaaggccagagtgtcagtgggtgggggtctgctgctcaccacgccgatgaggtcgccgcgagcgtactcgcccaccagctccttactt

SEQ ID NO: 690362 - DNA, 254 bp, Homo sapiens
gcagattggggcatactcgaggctgggtaggacgatggacctgcagcttcccaaggaaagggtggacactggatgtagctctcagaaaccagaatcttgataagaaattgaagttgttctcatattcatatatgattatcataactcctgatttttcttttctttttttgagagagggtcttgctctgttgcccaggctggagtgcagtgacacaatctcagctcactgcaacctccacctcctggactcagca

SEQ ID NO: 690363 - DNA, 1024 bp, Homo sapiens
  misc_feature (805)..(805): n is a, c, g, or t
  misc_feature (1024)..(1024): n is a, c, g, or t
ctacttaacctacagcattgtacaattagcttagtaacactatggaataagctaaaacatatcacagttttatacatgggccaaaacatgacattgagtatgtggtcacatgcaaaacacggatgacatgacataacaacactcttgggtggtgactgaggcatcacttagaaggcccagacgacttttccactatttcacagcatttccttttctcagaaggactcttaatatttccatgtaaactctagatcttgggagcaattaagatggcattacaatttctagggagcattttaaggaaacaggtccgggctcttttcataatttccatgtctatacagtatggaattataatacgaaacatctttacactgagtctgggcttctgggcactttggcacttattcaggggcaaaaagtctttcgattacttatgcctctatagagcttaatttctggagaaattcaacagtcattttcaccagcataatctatatctcacggaataactacataggacaaagtcagcttaactcattttacaggccctaggtatctacattactaatataatcggatacgaccttgccaaatctggccgtgcacttcagctcaatacgtagtaccaaataaaccttcatcattgaggacatggccaagtctactcacggcactcacctctaccattggattccttcaatactcacacttccagtgtacaacaccggtggttacttctctcaacaacatttcggaaaccaagtacctggttaaactgtccaatcccagcaacgcatgtcgncaacgcacgataccttggggaaccaagtttgggaattgtgcaacaacacatttgcacgacgaattggctacaccagggcacacacacctacacctttacaacctcacgcatgctacaacagcgccaagaccacttcgtaatgtcggaacacaaccgactatcggtctgacacactaaacaccgtgtcactccccaaaatgtgtcaactgcccgtcgcan

SEQ ID NO: 690364 - DNA, 482 bp, Homo sapiens
ggggggggggttttaaaacccgtttttttccaagggtttttaaagcatgaaaaagctggccctacataattttgaggggcggttgttttcctttggggggccaatttttttcacccggggctggaaattaggcctgaacagggtcccctgagtgaggctggtggatttggggggggggagaggggaaacagggctccctttaatcccacgaagtcttggaaaaggggggatgggacaaatccagcttaggctttggggacatgtgcaaagggggattcctgcggggggatcagcctgctccataggcagtcaagtgttccccttttattccaaaaagacttcaaggcaaaaaggccagggggggcagatctaactttggatgtaagcccaggaggtttcccgtttagattttaaacccaaatcatccgtacttaaataaaccatattttaaaaataactggccatattattcggcgggaggc

SEQ ID NO: 690365 - DNA, 135 bp, Homo sapiens
tagaggacgcgcaaagatcttgactgcattctgctctgccctagaggtctgtggaaattgaagtgattattgacagtatctggcagaagaaatttctaagcagcaaagtgttcaagatgtacctgactgcttcta

SEQ ID NO: 690366 - DNA, 228 bp, Homo sapiens
ccacgcgagtggcccccgggctctcacggcgcagcgtgccccttcgctccccggaccgccaccgttcgggaccggcttgagccgcgcaacttccgcgcacacgtggtgccggggcagggaatcccactcatgccaagaacgtgaataaggaccaaggctgaaccgaagctatctctgcgatcaggcggaagaagcgtctcatgatctgagtgccctggctgacaggaa

SEQ ID NO: 690367 - DNA, 254 bp, Homo sapiens
  misc_feature (109)..(109): n is a, c, g, or t
cctgtggtcaggctgatcgtgaatcctgactcaggtgatccgctgcctcagcctctgggattataggcgtgagccactgcgcccagcctccagttttcttttctttagnagcagcggttttaaatcctgttgggcttcaagttctctgagaaatttactatgtctctccacaacaatgagctcccatatttccacagaacacagtcacatgtcagctcagctgtgtgggtacgctctgctgtgccggggtaccg

SEQ ID NO: 690368 - DNA, 312 bp, Homo sapiens
ggtgagtagtgtggggggtggcacgtaatcctccacacgaggcatactcagtacagtgtgtccgtgcaggtaggggatcccgcggcatcacgtagatgcggtcaaccagacatgcagcgggtccttgcaccatgcgccagactggtgctctgactcgtgtgtgggggtgggctccagaagctactgcagggtccctgggcacacgaagatgtaagggacacagtcgtactgcacctccaggtacttgtaggtcccaggacaggggtcaggaaaggcatccgagccggcgaccaccacgcactgtctgcggtt

SEQ ID NO: 690369 - DNA, 1328 bp, Homo sapiens
ttgctgcgtttgggccccggcttggttctccctggttttttctacgtggctgtgccctctcctctggtggttttcgttggaccctcttgtttttatctggctggtctccctgccctgttcctgtgatcgtggacattttccctgtttgtgtgcacatgcggtgacctccctcgactggtccctctccccgcgtcgtgtcacattggcgtgccaaatttctggccccttgcgtgacacccttgacggttgggctttccctacttgcccccttggtggtggcctgccctgggtcattgtgttaacccgtcaagtccccatcgcagcttcttagggttgttcttggagtcccatacccccgtgcccgctgggcccaattcgatggcaagccctttgtgttcctccgtttatgtgcccttgagcctcggttcccgtcccctttcgggcattggacctgcacagtgcttgacctccgcaatcccatgggtctaacgttgacgaaggtcaatgacctcgggcttcatgtaaagcacctctgggcgtctggatgatcccccgctatgggtacgcgccccccggtgtgccttgaagactgcgctcttgctcaactccctgctcccgccctgcccaccccccctaagctggaagccacaaggaggaatatcctacgcgcggatcaaacggctctatacctccgccggcccacaagcaggagccgtgcgcccagcacaacggctcagaggcccgcccagccccgcaaaacggggaggcggctccatccatgtccgtgccgccccacagaccccccaatatacgggtcgaaggccaaaggcggtccaccagctagaccaggttgcttggggacgggtgggtgcttatatatgtagaaactgtaggatttctgttgttctctcgtggtctcactttgttacattagtttctgtccccgggagcctcacgggctactgagagactgtgctccaggccagggggttacacctgccctccgtggtccctacactgggctccaggggcttctggtgcggttccgggaagaagccacatccccagaggtgacaggtgagctcactgcacacaccaccagcctctgacttgactgtgttgtcacagaggtgaggctgggccatcctggtctccagcttaaacaggagtgaactccctctgtccacaggcctcccttactgggccccatacagcccaaccctacccctcctcacatgggtcctgcaggagaggagacccagccttgaagtggggatcagtagaggcttgcactgccttggtatacggacccggagacgtggctaacc

SEQ ID NO: 690370 - DNA, 728 bp, Homo sapiens
  misc_feature (44)..(44): n is a, c, g, or t
  misc_feature (267)..(267): n is a, c, g, or t
  misc_feature (362)..(362): n is a, c, g, or t
  misc_feature (384)..(384): n is a, c, g, or t
  misc_feature (434)..(434): n is a, c, g, or t
  misc_feature (491)..(491): n is a, c, g, or t
gatttggggtggaagcgatagctgagtggcggcggctgctgatngtgttctaggggacggagtaggggaagacgttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtctngccttcttcttaggtttgcagatgatacatatacagaaagctacatcagcacaattggtgtggattccaaaataagaactatagagtagacgggnaaaacaatcaacgcttcatatntgggacacagcaggccaggaaagatttcgaacaatcacctccaagttatnacagaggagccatggcatcatagttgtgtatgatgtgacagatcaggagtccttcanataactgtcaaacagtggctgcaggacatagatcgttatgccagtgacaacatgtcaacaacaatggggtagggaacaaatgtgatctgaccacaaagagcagtagtagactacaacaaccagcgacaggaatttgctgattccttggaattccgttttggaaaccagtgctagaatgcaacgactgtagaacagtctttcatgacgactggccgtgagatcaaaagcgactggtcc

SEQ ID NO: 690371 - DNA, 519 bp, Homo sapiens
cctaacggagctgactattgagaacatgtgtgggcagagactgtcaacacaggccatcatttctcatggggcaggaactctgtccatgttgctgggctctgattcaggtcaagcacaaagccgcggtctgatgagacatagaggctggaagaaccagggcaggaaaaggctgcatcttatggtctcaaggctgatcccagggaggctcccaagttccttctccagccgctttggataaccacttactaggttattgctccctttgtcaggaagacatacacttgagtgccctggatcagatagactttatcatcccaggaaaaggcagcatctactgttgaaggaccctgaggccagtgatgagcaatgggccagctatgccatccatcacggctggagtccagacgccagtagtgggagccagtgaaggcataggtggcaccgcgatggtcagacagcagtgcagtcaggccaggatctgggctacaacgtgaatgcataggatgggtgctatttcca

SEQ ID NO: 690372 - DNA, 141 bp, Homo sapiens
ccagcacatgaagaagggtgtgaaggctgaacaatcatggattatatctgatcaattgtagcttataggaaattatatgacagtttatagcacgggttctatgaaaacgttatttataatagaaatcaactcaaaactatt

SEQ ID NO: 690373 - DNA, 325 bp, Homo sapiens
  misc_feature (6)..(6): n is a, c, g, or t
  misc_feature (43)..(43): n is a, c, g, or t
  misc_feature (76)..(76): n is a, c, g, or t
  misc_feature (90)..(90): n is a, c, g, or t
  misc_feature (99)..(99): n is a, c, g, or t
  misc_feature (116)..(116): n is a, c, g, or t
  misc_feature (120)..(120): n is a, c, g, or t
  misc_feature (139)..(139): n is a, c, g, or t
  misc_feature (149)..(149): n is a, c, g, or t
  misc_feature (167)..(167): n is a, c, g, or t
  misc_feature (236)..(236): n is a, c, g, or t
  misc_feature (243)..(243): n is a, c, g, or t
  misc_feature (252)..(252): n is a, c, g, or t
  misc_feature (263)..(263): n is a, c, g, or t
  misc_feature (267)..(267): n is a, c, g, or t
  misc_feature (271)..(271): n is a, c, g, or t
  misc_feature (277)..(277): n is a, c, g, or t
  misc_feature (282)..(282): n is a, c, g, or t
  misc_feature (293)..(293): n is a, c, g, or t
  misc_feature (295)..(295): n is a, c, g, or t
  misc_feature (313)..(313): n is a, c, g, or t
aaatcnatctggaatcaaaaaacggtggattttggcaaatggnccttgggcccccccccctcatccctggtttggncccctgttggccanagccctttnccctgagcccccccccnacanaatgggggccagccccctngcctgcctgngtttctcccccaaccccnttaaatggggagggaaaaggaggaaaggggagggggcctgcccccccctcagggatttgggagggcccngcccccntgggctttncccttccctgngggntctntccccnacccntttgttaaaancnaacctgaataaaactccnagttttatatta

SEQ ID NO: 690374 - DNA, 818 bp, Homo sapiens
gcctgggcgtggtggctcacgcctgtaatccacagctgcttcgtggacggcgcgatgcgtagggcgaatctcatcgatcgtcactagatttgatgaccttttctctgcgctatacacggtgaaccgcccggtctctagctacagatactagcaacaaaattcagtctgggcgttacgttgggcgatgcgctatctatcggagacgtgcttactcgagaagtgctgagcgcagcgacgaattgtgcgtgttgacccgcggaggcggagcttgcagtgagccgagacagcgccactgcactccagtctgggtgacagagcgagactctgtctcaaaaaaaaaaaaaaaaaaattgtctttttgattttaccaattttccttggatttggaaagggctttttacgcaaccggtgactttcgggtttaccaaaaaggctcagaacgacaacgactggtcgtacattgactcatacggttaatttttcacctttcgcaatatagttcctatttcggacacttgtcctggttggcaactcaggattgcaagaaccccaagtgtcttagcaacctccggttcacccttgggcgctttttctaacgcagctttttctaccattgggaagaccccgaggaatttttccccagacatttccacgcgcattttactaagtgactctactggaacaatcctagcgtaagaactcccggggggggcgaatgcgcgaactttgtgacgtcttcacactgttcgcgccttttacgcaacacgcgttgtcccccgggtccctggatcgtattttacctagcggttggaacccaa

SEQ ID NO: 690375 - DNA, 524 bp, Homo sapiens
ctagaggactcagatagagcatacccctcaccaagcttgctttatcatccttgggtgtctttgacaatgcatcccctgctttcacatgctctagtgttccttcaccaggcctttgtcgccccacgttgggcagccaggaatgttggggtgatcagatccaacaccaggccttggggcaacgaagtctggcagagtcaaaggaaagagaaaagacagtttgagagagaaagtgggtccaggtggccaacgcaagtatggaggctgtgaaggccctgagctctggaagcccagactatttattggtggtcaaacaaagaaacaggtggtgagaatgtgtgggtcaaaagggcaagcacatgatctacagctgtgatagtttagcatttcctttgaagcatatggaacatattctgctacttgagataatagggagcatgttcttccagtttaagctagaagcaaggagccagcaagtctagactcattccagaggccacgaggggtatggctctgatcgggtaccg

SEQ ID NO: 690376 - DNA, 113 bp, Homo sapiens
tcattcttccagtctatcagcctagctctctcacatttagtatacttcttgcgggggctctggaacaagccttggataatgagatccatgtcaacttcctcatactacagaac

SEQ ID NO: 690377 - DNA, 221 bp, Homo sapiens
ggtcgcagtaaaagagagcataccattgccattcagagaattcctccagaaatgtaaaagggggcagtaaaaacgggataaccacctttacttttgtgcaagacaaagtattttcctgcttcagatgagtggaagcacctctctttaccttgaggacccagtcctatggtatttaattacactgtcgggagcatagaatggtctggcaccgtgccctctcc

SEQ ID NO: 690378 - DNA, 400 bp, Homo sapiens
  misc_feature (268)..(268): n is a, c, g, or t
  misc_feature (373)..(373): n is a, c, g, or t
ttgagacagagtctcgccttgtcacctaggctggagtgcaatggcgcgatctcggctcactgcaacctctgcttcccaggttcaaacgattctcctgccttgagtagctgggattacaggcacctgccaccatgtccagctaatttttgtatttttagtagagacaaggtttcaccatgttggccaggctggtctcaaactcctgacctcgccgaactccacccgaatcggtctcccaaagtgctaggattacaggcgtgacaaccgnaacctgggggcatctagggttgattccgtatctttgccattgcggaatagtgccgcagtgaacatacatgtggcgtgtgtctttaggtaggaactatttatattnctttgggggattattacccagttaaag

SEQ ID NO: 690379 - DNA, 372 bp, Homo sapiens
aaagggatctggagtatgtccgcgacgccaacgctgaatacattgttcgtgaaacatcttttccaagtttaacatgccagtgtcgggcattgccactatgcccccgttatcgtcaattttctcaagacatatctggcattctgtcgtgcacgttggccaataatctttaaatagtttgaacatatagtaatttctgtcttttaaacaaaaggtgcagaacataatgacgtggccttactccaacagttttaaacttatcaaagcttatcaaaaacactctaacacgtaccaaagttgtacaaatcacaaatataaaagtgtcttgttgaaaaagtggacccaagacgtcatgtagacgcggccgcgaattta

SEQ ID NO: 690380 - DNA, 501 bp, Homo sapiens
cacaaggccctggcgtatatatctgtggaatgaaggcatgcctgtctgcacgaaaagcacatggcatagtgctatgtatacagtaggagttcaattaatgtgagtttgtattgttaagattttgggctgggagtggtggctcacagccaggtgcagtggcttacaactataatctcagctacttgggagactgaggcaggagaatttcttgaacccagaagtttgaggctgcagtgagctatgattgtgttactgcactccaatctgggcaagggagcaagatgtgtctcaaaaaaaaaaaaaattccaataaatacttgaaaagttgctcaacatcatgggccgttagagaattgcaattcaaagccacaaagagataccattttgcacccactagggaggcattactcaaataccaaatgttggtgagaatgtggagaatttgaccccctgttacattgctggtggcaatgaaagtggggcatctgctgtgaaaaacaa

SEQ ID NO: 690381 - DNA, 988 bp, Homo sapiens
  misc_feature (13)..(13): n is a, c, g, or t
  misc_feature (78)..(78): n is a, c, g, or t
  misc_feature (198)..(198): n is a, c, g, or t
  misc_feature (974)..(974): n is a, c, g, or t
  misc_feature (976)..(977): n is a, c, g, or t
tttagttttatcntccttttctttgagagttcgtgaagaggaaaccaagattgggacctgatggagagtgagagcatntgaggggtagtgggatggtggggtaccagccactggaggggtcatccttgcccatcgggaccagaaacctgggagaaacttggatgaggagtggttgggctgtgcctgggcctagcacgnacatggtctgtcctgacagcactcctcggcaggcatggctggtgcctgaagacccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctgnannacccccccccc

SEQ ID NO: 690382 - DNA, 1029 bp, Homo sapiens
  misc_feature (5)..(5): n is a, c, g, or t
  misc_feature (98)..(98): n is a, c, g, or t
  misc_feature (125)..(125): n is a, c, g, or t
  misc_feature (129)..(129): n is a, c, g, or t
  misc_feature (132)..(132): n is a, c, g, or t
  misc_feature (173)..(173): n is a, c, g, or t
  misc_feature (219)..(219): n is a, c, g, or t
  misc_feature (228)..(228): n is a, c, g, or t
  misc_feature (234)..(234): n is a, c, g, or t
  misc_feature (243)..(243): n is a, c, g, or t
  misc_feature (247)..(247): n is a, c, g, or t
  misc_feature (259)..(259): n is a, c, g, or t
  misc_feature (267)..(267): n is a, c, g, or t
  misc_feature (1015)..(1015): n is a, c, g, or t
  misc_feature (1017)..(1018): n is a, c, g, or t
ttgangagtttcgtggaagagggaaagcccagggattggggaacctggatgggagaagtggagaggcatgtggagggggtgagtggggatgggtgggngttacccagcccaccggggagggggtncatnccnttgcccccatccggggacccagaaaaccctggggaggagancttgggatggagggagtgggtgtggggctgttgccctggggccctnagacaccgnaacatnggttctgtncctncaccaggcactncctgcggncagggcatggctggtgcctgaagacccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctgnannacccccccccc

SEQ ID NO: 690383 - DNA, 102 bp, Homo sapiens
aaagctgaagtcggctaggtttgcaaagctgttgggctgagcactcaggcattacaactctcagaactgcggcggctctggactgcagcctcccaagctcca

SEQ ID NO: 690384 - DNA, 157 bp, Homo sapiens
catattatagcatgggactacgcctataccttctgcataatgaattacctagaaatactttgcaaggagagccacagctaagtatccccgataaccagacgagctacctatgaacagctacaatagcacacccgtctatttcgcatacatattgcga

SEQ ID NO: 690385 - DNA, 634 bp, Homo sapiens
aagctttaagaccttcctttgtgcgtcccggtccagcactgtacgtgagcatgtcatagctgttccaagaagatcttggtcatgactggtgctggtttctcaccgataaaaacgcctgggggaccggaatttttggaacaattccaattgaaggtcactgagggtcgaataattggactgtatctaagcgggagtcaaagtggagctgggaatcgaaattaagtgcgcgggcgttggaaataaaaaggtgaatcgtccttgtgagtctccttatccatgttgagatatgaaagggaaccaaagtagtcataatctttcaggccaaagagaaaatggcagcgattcaatataactctgagaagatggataaaatctcctccgtgtgtcaaacaaggcatctccaggtcgatgataaacgacgcgcgattggccagatatgatgaaccgggaccagttctaggcgacggaaaggaaggagaacgacgtcatcataaattcctcggaccatgcacacaggctaatgaagacattccatcaagcgtgagaccggactgtaagctgtcggctggacgaaattaatacctgagtcattgcgaactagactaaggccattgatttcctaattcagtgctct

SEQ ID NO: 690386 - DNA, 305 bp, Homo sapiens
ataaaaacagccaacaggtatatgaaaaagtgctcaacatcactgatcagcagggaaatgcaaatcaaagccacaatgagataccacctcacacctgttaggttacatctgctattgtcaaaaagataagagatagcaagtgtcagcaagggtctggagaaaagggaatttttgtatactgttggtggaatgtaaatcagtacggctattgtggaaacagtgtagaggtttctcaaaaattaaactatcatacacccagcagtcctgtgctgatagataccaaggaatggatcttaaaaaaaaaa

SEQ ID NO: 690387 - DNA, 829 bp, Homo sapiens
atcaaaagatctgtagaaaatcaggaaagtgttgaaatgataaatgatctagaaagttagtacggtaacaagtcctagcagaatgatcagaaaatggagaagtactagttgagatagcgtatcgttgaaaatacaggaaataagcagagatagataagatccagtgcacagaatgcagtctgtcgtattaaacatgttagaagggtcagagggagagaagttgaagtccatcagcatgagagacgactccaaccttgagtcatcatcagttgactagtagcacagcaagaattctgatcatagtctgccataccgtagaaaacgtggtagaccgaagaaaaatcaatccatctgagagatgtaggatgctaaggctgtacggaagagaggaagccccacgaagaaggacagctcccagtcattagaaggagatctgacaagaaatgaccccagctacatagtgagaaagtgttgatgtgggagaacgcagctttcggcaaatccagttgcagtgcgcaagacgaggaactattcgagggtgatgagcgctaagaaaaaagttacaagaacagactgacaagtcaagccagaaacgttcattgcactcagtatcagaagaacgcacagatgaagatgactacataaagaaacaagatgagcaggaagaaagagatgctcgccgcaagcttccttcactaaatcgatcccgcagcagcacgactcggtctagcaaggccatctatgtagccggacctttctgaacaaacaatgagcctttatttccccaggtcagaaagttccaggaagcaaaagtaaaaaatagaggccc

SEQ ID NO: 690388 - DNA, 311 bp, Homo sapiens
ttacccgagatttccccttcaactataaactacattcctctcatagttatcttggcctctgtattagaataagcaaaaaaaaaaaaaaaaagaggaagatattccccttgggggttaaaaccccggggggacccaaaagggaaaattccttcggaaattaaaaattgggaaggggggtttaaaaaatgggggggaaaccccctggccccccaaaaaaagggttaaaattaagccaattggccttttttgtttgtggaaaaaaatcaaaaccccccggccttgtgcccctgggaggaacaaggggccccccc

SEQ ID NO: 690389 - DNA, 727 bp, Homo sapiens
cagcacgggatctgatcttatccgatccacgtccctgggaccagttctatccggtagattctctgtgaccccttcggaggcaagggaacaaggcaaagaacaaacctggacatgacagtcgcagcgtacctcatgagtgcaggcagtgctgcgcaagccgacggatgacccattgttaaggtcgtgaccccgattcgtggcaaagatgggagcgtgtgtggcatcgactggcggccagatgacatctgccaccatttctgcatgtctcgcagtctctcgctctgcctgcttgctcagaaagacgcgctggctttggccaacagaggctcagccccagggatctagagagtgtacagaacccaggctggaaggatggcgtccaagctacgggtgtaggactagtcctcactgtcagtggagccaccagaagcctagatgctgtaaccaaggtagggtttctacggttcccaccatgaggactgagggaatcctgtacaggatgtacgcagggtagatggggagctaggattgggacctgctctgaacagctggacacatgagctctggatgagtatggtagggggttctgaacgaatcaccatgtccactctcccaaatcaggcccggccccctttggcttggagagcacttcaagccccacccacccctagaactgccattacccagacctctgtctcccagccaaccaccttggaactgcctctgt

SEQ ID NO: 690390 - DNA, 197 bp, Homo sapiens
gagccgcaagctcagggtgagctggcacattaagatttcaaaacacaaaagggaaactcacacataagttagccaataaactcaagagataggaggaaaataagggagaaatctgagagcatctttgaaatcagtatgtttaagatctaagaggaaaagaaggaataacatatacacacaaaaaaacaatgaagaca

SEQ ID NO: 690391 - DNA, 353 bp, Homo sapiens
gtatccccgcacccggcgcacttctgggaagcctgacacagccggatatgatcacaccttctgggccacggggatgctgctgcttgggatgtaaggggcccagcagtgcgggggagtctggctgcccctctagccctgtgagtggggccgggaagctgaactgtctactgcaaaaatacggatcgataatcgacctcatccagaggaggccagtgtgtcactatggactgtctcacgcagggatcctcctggggaccaccacactacgtcggtggtgagaactctccaggtccggggacctccggtggccacggagaccacgtgtcagtggccaggataagtgcgcctgggtt

SEQ ID NO: 690392 - DNA, 320 bp, Homo sapiens
  misc_feature (23)..(23): n is a, c, g, or t
  misc_feature (60)..(60): n is a, c, g, or t
  misc_feature (98)..(98): n is a, c, g, or t
  misc_feature (197)..(197): n is a, c, g, or t
  misc_feature (224)..(224): n is a, c, g, or t
  misc_feature (230)..(230): n is a, c, g, or t
  misc_feature (251)..(251): n is a, c, g, or t
  misc_feature (285)..(285): n is a, c, g, or t
  misc_feature (309)..(309): n is a, c, g, or t
gctgggacggcaaccacccagcngggcagttgcgtactcaggttggcaaccagggtgttncgcaactgttgatccaacgggctggccacaagttgttnttggcaatcacatacttcacatcactggtttgataaaccacaccattccccgccagatagtcaggaacagtgacctgctctacccataacagacgattnccctggctggcggtactttgtgtaccnttcttncaccacaggtaactcgtaatnagtttttattaatttccgccggagctcccatccngcccagcccacagtgcttgcaatncgttcaattag

SEQ ID NO: 690393 - DNA, 127 bp, Homo sapiens
cctccttaggcaactggtgggtcccccgcccgggaggtcaccatattagatgccgaagttattagcggacacccgatcggcatagcgcactacagcccagaactcctgggctcaagcgatcctccca

SEQ ID NO: 690394 - DNA, 142 bp, Homo sapiens
cgctactccgccctgttcccccgtgtggcctacggacccacgcgctacaattacctaacacctcggccagaagaggagaggacgctagcagcacaagagaagcacacgccggatgcactgaaacggcttccccgagacattg

SEQ ID NO: 690395 - DNA, 373 bp, Homo sapiens
tccataaggtgtgccacagtcaagtgcgtaaagcacgcccgcgtttcgagggggctcctcctgccatacgggagaatcaccgggaatgctcagtaagttcctgacggtactcgaaaagctaaacttcattttccagtggacccccatggggaaacgctgtgcttaacgggaaagccactctgcttgggagaaagcccctccaggctctcgggctggctgaacacagctggacagcagacatcccgctagggcggcggggggaggcgaggcctggcacatgcacatccagggataacccgaagcgtgaggttgtgcagaacggtgcggggcctctcgacctggcccttcagtgggttactgttgcttatccagg

SEQ ID NO: 690396 - DNA, 865 bp, Homo sapiens
cggtaacagtattgaatggcatcaaaacattttcatttgtaatgtatttctttaacaagtggttaaaaaaagtgtccaagcagccgggcgcagtggctcacacctgtaatcccagcacttgggaggccaaggcgggtcaatcacctgaggtcaggagttcgcaaccagcctggccaatatggtgagaccccatctctactaaaaatgcaaaaagttagccaggcatggtggtgggcacctgtgatcccagctacctgggaggctgaggaaggagaatcgcttgaaccctggaggcggaggctgcattgagctgaggtcatgccattgtactccagcctgggcaacaagagcaaaactccatctcaaaaaaaaaacaaaacaaaaaaggtccaagcatggtgacatccggttttccacaatatttcggggggtatcacgtttcgggtatggtcacattcccattttgggggatcctggcttctatgatacttttgacttccttacctttttgggcacattgggttctggtaacaagatccctggccaataactggcaaaatgaccaactaatagcggcgatatctcagaaagggatttcccacatcgtaaaacttcggggcctttaaaaacggtggttgtccccccccaaacaatagaattccatgttacagttcacaacaaggtggtcctttcccaggttgtaacaacgtcggcctggccacactggtccactttttctgtcccccactagttacttatggccaaaaaccaacgtgtttaagacccgtggttgggatattacaagatatgacaagattggcgaagtggaaactctaaatttcattacacagcgagggcactaccg

SEQ ID NO: 690397 - DNA, 342 bp, Homo sapiens
tccccctcagtgagggaatacccatgtgcagagctctttgggcctggatatgggctcgggtggcaagaacagagagaaagtgctccgtaaaagtagctggaatcgggaggtgggcaagctcttccctggaggggaagagcttcaaccaagagggatttgaccaggaggttcacccccctttccacccaggaagcccctgcagacagtatgtgttttaggctttgctggccaaatggtctctgccgtgactactcagctctgccattgtggctgcagagtgaccatagaccttctgaaagtgaatgagtatgactgtgttccaataaaactttattgacagaa

SEQ ID NO: 690398 - DNA, 218 bp, Homo sapiens
  misc_feature (5)..(5): n is a, c, g, or t
  misc_feature (65)..(65): n is a, c, g, or t
  misc_feature (172)..(172): n is a, c, g, or t
  misc_feature (202)..(202): n is a, c, g, or t
gtgantttggcaataagttgataacttacatgttgggagtcttggaaccactcccagatttgctnatttgctggaagggctcacaggcctcaccatgtagtcctagtcatggctcttgtgtattactgtgaatggatacaaagcaaaatttgcaaagggtaaatgtgtatgnggcaaagtgtaaaggaaaaccaggtgcaancctccaaagttccttt

SEQ ID NO: 690399 - DNA, 101 bp, Homo sapiens
gggtgcggcgaggtatcaccgtcgatacctcaaaacgacaccttacaaccctaatattaacaaacaggaaacaatgacattttttagtttaatcaataatt

SEQ ID NO: 690400 - DNA, 120 bp, Homo sapiens
  misc_feature (71)..(71): n is a, c, g, or t
  misc_feature (120)..(120): n is a, c, g, or t
agcggagttaggggcaaaacaggaggcgtttccctacccgcatacatccccgtccccgagacaccaatccnggcgtgtgctggccgtagttgtgttggtgcctggtggcggcgtgttcgn

SEQ ID NO: 690401 - DNA, 1338 bp, Homo sapiens
catttcccagtgattactagggcctggtccctgaggaggaaatttgaatgggtccatttagcccttccatagcctaatccctgggcattgttttccacatgaggttggagggttaggaggtgtcactagattacacatcattcaaacaagaccccactctagaacatttttcagatgcttctggtgtagcacacccaaagggtgaagctatttatctgtagtaaactatatatctgtgatattaatgcaacatattaacaccctggcatccagtccatttgcatccagtcatcacattctttaacagttaactttgtccagcaggcaaccaacaacgggtttcacaacctgcattccatcaatcaacattcatctgtcacgttccttcgcatcatgtcaacctttaggtgcgtagtgatttctatcgagtatataatcaaaaccaagaagatgtccataggggtcccataccaaatggtcatccaggcaagcagcttgagcaaatggataaaggcagacatctatcgtaaggtcttcaatctacagagacacctgcagtccccaagtccaggacgccacatcaagcccaacatctccatggcaagacccaaggcagggcacagcactgaaaacaagaaaaaaaagacaaaaagacaaacaacacaacagagacaaacatggacccacaaggataaacaccagacactgacacagagaaaacaacaggatgggacaagaagaaaggcaccagaacaggaacatagcagaagcaacacacgggcacacaagaacacacaaggacaccgcaaaaggaaacaacacactaacaaatagcactgacagataaaccagagagaccacatcagaacaagacggatggacccacacagccacacatcgcacaaaccaacaacacgaacgcaacaacagacaaagatagcacacaagaagaaacaaccccaaggcaaagaaaaaacacgcacaacgaacacgacacccccacaaacaacagaagacacaggaagacagaaggcaaacacaaaacacacacgaaaagtcgaacagacaaacacagatagtcacgagaaagagaacacacaacgggacagaggacgagagtgaagcaaaaaaaaaagacacaaaaaaacaagcgagaaccaaaacacgacgaaagaagagaataacacagaaaggagaacagaagagaacagaataaagcaaaagaaaaaaacagacaaacaaacgcgacccacaacaacaaggaacgaaaagaaaaagaaaaaggagaaaaagaagagaaaagaaggaaagaagaaaaacaagaacaaaggaaaaaaa

SEQ ID NO: 690402 - DNA, 128 bp, Homo sapiens
tggctatcacggccagtcaaacatttgaacattcctcccttcaaaacatgctgaacagcggggatattaaaagcaaagacacacacacaacatctacaataaaacttgtggacagaatatcccagtaa

SEQ ID NO: 690403 - DNA, 155 bp, Homo sapiens
catcccatacattgggacagacctagtgcgataatctgaagatgctactcagatagacagtcccatcctcacacgattctttacctttcacttcactcttgcccttcattattgcagccctagcagcactccacctcctattcttgcacgaaacg

SEQ ID NO: 690404 - DNA, 844 bp, Homo sapiens
ggagccaggagcctgccatgaggtttgagaacagagtgctgttttagagctggcagcagcatctcagcccaagagaaggttatattcccagaggatgtcagtcccaaggaccagtagctgccatcagttggattctgaaaactaactggcatcaacactgggtgtagaaacatgcttgccttatgtatcagaggacatgctcagcagatccaagagatatattggcaactttttctagaaaaggcacatgggtatcattcattacattcttgagttttttgggttttttttttttttttggaaacagtctgtgctgtatggcccaggctggagtgtggtggcccaatcacagctcatggatcctcaatacaccacaggcctaagcaatcctcccacctggtagcgggggactacagctcacagcacaccgggctaaaatttttttttggtgagagggattctctatgtggcccagggggtctcaggctcggggctcaagagggtcctccggctcagttccaagggcacaggccagttgtagcttggtcctggcatatgcccaaaagaggtactatacctttacggaatggacttccataaactgggccctatgtgggggggcaagttccttaaagggcggaaatggtaaaattcctccggaaatgtttctccaggccgtaccaggacctattacaacagaacggaagggtctggggtcatctctgaagcaaaagagaaagaagagaaaggcacagcagagagcgacgaacacagacacgacaccacgaaaaaaaggggggaaacagaggagcagtcccttttgggccaggaaaagcgcggacaa

SEQ ID NO: 690405 - DNA, 621 bp, Homo sapiens
  misc_feature (21)..(21): n is a, c, g, or t
tatgatccccctatgtggtanggttataatcaagagatacaatgaaggatagtagatgactgatacagtgtacgagcgcagaggctgcgagagggggtgtcgactagcacagaacgtgaatggcaataaaggaatgagtatagtctagcgcggtttgagtggcgtaggctgtaggataactgagatgattagagcaataagccaagaaatatgaatgctgcatagatatgcagatactctatgtaatgaactgtgtgagttgtttacgtatgattcagtatgatgaggatcgttactggagtttcaagtcggtaacagatgatagcgtgtctaaggggccgcgaatgagatagtggacggagtggaggacgtgagcatagaaggggagccgcagagaaaggcgaaaagtgagagaaaggagaagggatacagtcgcagcacgaggaagccaaaggcgagtaggagcctaggcgacgaggtacagctatcgcacgggacatgagagacgacggagaccctgcatactggcgggaggtgttttatgtgcggctgtgacatacgcgctcaatgagtaacgcattaaggcctaggatggatgcgtggagcagacaggcaaccggt

SEQ ID NO: 690406 - DNA, 914 bp, Homo sapiens
tctcatacaatataaaatatatatatactataaaaataaacagcaataactattgtcgtcgctacacgctgttcaccagtcttaccctctatttagcgccgaccacaatttttgccactaccctatagcgagtcacctgtagaccgctatctagtagcctctccctctctactagtggacaccctttatctcccttgggaagccctctttcttacaggtgctattacacgcgccgtaaagctggtccttaaacgagctctgctcgctatatgctcccaaaagttctgtaatcatcattcattattggaacggtcctctttggatttcttgcccccgcaccccagtgtatttacttggcccaagaactaaggggcactatgtctccgtatctggctgagtcgctactatctgttgggccccagcccattcctttgagccagccacttctcacccagcttgttagaggcggtgctttatccgccgtcaggaaacttttggagagaatgattggggccccccctaggtgttctatgtatcgattcgggatgttcttctccagtctctggatcgtctcataaagtatctggccccactttttcccacagagaacatttccgcaacctcttagatgccctcctccattttcataaataatctgatccttcggtgtttttgtttatgcaacaacgtgcaccccaaggtcatagtttttccccccaaggtcatgcaaataaaaaaccgccacgttcaccacaacatatcggcccatgaaccgccccaatctccccgattcttcccatcagggaaacacccagcatgcttacaattaacgcccacgcccacaaattttcttcacttcatcccccaggctttttcgggcttattccaacaaatgttccctgttccacatgaca

SEQ ID NO: 690407 - DNA, 385 bp, Homo sapiens
ccgcgactatagactcgcatggtgcctagtgttccaggaatcccaggtccttcctctccccgggccgacagttagaagcaaaaatgccacccaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctg

SEQ ID NO: 690408 - DNA, 198 bp, Homo sapiens
agcttagacatcgagtatactcaggggatctgacggtgacgttcgagtacttctgtgtctaaatatatatagactacatgggcatgatctcagagtgtgaggtaaatgtaatctggaataataagtgtcttttacctagattacatctctcatttggagtttggcaatgaaactgctattgaaacttctaaaactagg

SEQ ID NO: 690409 - DNA, 100 bp, Homo sapiens
tacatgatacgactcgagttagtaccctctaataaatctgcccttctttactacaactatcttggtaaatggctttaccacctgcaaaactgaccctagg

SEQ ID NO: 690410 - DNA, 151 bp, Homo sapiens
gatgggtaggatgcggtaggtaagctggtattgagtagtatgtatgtcccagcgtccctccaaagtagtaaagttaaaatccgggatctcagtatatgagtaatccgataccagtatcgagttggtcgtactatatatcgttttatgatgt

SEQ ID NO: 690411 - DNA, 123 bp, Homo sapiens
  misc_feature (15)..(15): n is a, c, g, or t
  misc_feature (73)..(73): n is a, c, g, or t
acgctttatacttcnaacgctttatacttctcaacgcttctcatttcatttcccggtatgaagtataaagcgntgaggaagtataaagcggagaggaagtataaagcgttgagaagtataaag

SEQ ID NO: 690412 - DNA, 470 bp, Homo sapiens
tacacgcacactccacactaggtttcttgatagtgtccagatagctgtagctctaggtgcagcctgagtccgctgcaagaggattcagatgtcgctcttgacgagttggtcagtgaactcctgatagatcgagttcgtgcatacagtctcaggccagatatctgtggccaggcagctgaaggttctacacatggcttcgcagcagacctgggtgaacttgtccaggtggtcagagctagctcgtctgtgatctgtctgtcatcatggcatctcactcataagcagcttcttaggctcaggctacgatgcacgatggtatgtgcctctagtgcgcaggtataatacgcttgcagctcagatcccctccggcccgtcacctagtaagtctcagtgtgcagcttgccgatcctgttgcctcagcagcctctgcgtacatggtctatctaaagcttgatcataataatgtccag

SEQ ID NO: 690413 - DNA, 488 bp, Homo sapiens
ttaatcaagaacattatgtgaaatacacactctggtaaacatctgaattcatccatcctaaaattagactttaagaggcaaaaaaaaaaaaaaaaaatcatatagattttaacactaacaagcctaccagaataatgctgatggcaagccattaacagctttaaatgctgactgtaatttggggaaggggagaaaaagaaaatatttgttgtacctatatttaaatacatctgttagtgagacttctttaatttaagggattttaacaaaaggacatactcctgagcctcttggagtttttcaagcttcgtttttaaacctcgtgaccttttcacctaaaggaatcttcatacccctccggatctcaaattaactgtatgtgtataagtcacaaaaccctcccaatgcgaacaacgttgccgtcaaatgtcaccaaagctatctctcctttgttcaccctctctgctcatagcccatatatctgtatc

SEQ ID NO: 690414 - DNA, 1013 bp, Homo sapiens
cggcaatgctgcgacactactcggaatgaatcctgatggattacctcctgcacttaggatattagttgtcgaatgtatgtgtactggcttacctctcgtagttcgatcctatacacagtgagtcgaattcaaatgtgggctatgagtgtcttgttgataggcctcatttcgacatattcaatccgcgagaagatttccgtattatacgggttccatgggaatccactacacagtaaacaactcattgggtagtaggattgtgcgtaatgggtagtagtcgccctctcatacacataggcgaccacaaatgtccgaatgaaaaacccccggtatacgctcggttttcctagaacctatttgggggggggctcttttacctcccacatacaaccgtgttaagcagaacacataacgcgcgatgtaccttcgagtgagtttgtggtgagagtggaaatccatagagctccccatggacttatgagagacaataagaggcgtggagttctgctttattacctttaaggaagaagaaccagtgaagaagataatggaaaagaaatagcaaatgtggtcttagtaaatgtgacatagaagtagcatgtcgaaggaacaatatcaggaagagcaacagtggggatctagaggaggatttgcgtgaagagctcgtggcacgagggcggtagggcccagtcacacactggagaccagggaatatagtaaccactggcactgcaagggtaatggcaacaatggatattacaggccatgggtacgggggtcaaggcaggatatgactaacccggtaacaccaaccaccagaggggcaggcgatacaggcaccagagcgggtatggggaggcatcccgccagggtcctcaaaagcaacacacaaaaaaatccaatggaactacccaaggtgggaacaactcaaggcacaacagacagggccgccgcgcaaaagacgcacagtagcgcagcacaagtgaccgcaaacccacaaaagcgacgaacgc

SEQ ID NO: 690415 - DNA, 184 bp, Homo sapiens
tggatacttgccctgtactcccagacatcactggtggtgtgcctgctactctcagcactttgggaggccagggcaggacgatctcttgagcccaggatttcaaaaccagcctgggcgatatagtgagacccaatttctaccacaaaaacaaaaagcaaacaaagagaacggataagacactgca

SEQ ID NO: 690416 - DNA, 156 bp, Homo sapiens
ttataactggggaactggtactggaactggaacgacgacctggaactggacgaactggaacgggaactgggacgggacgacctggaactggaactgccagaactggacgacactggaactggaactggacgacccggaactggacatggacgaact

SEQ ID NO: 690417 - DNA, 514 bp, Homo sapiens
  misc_feature (201)..(201): n is a, c, g, or t
ataaaggcagatccctgatgggcccgaggctcaggcggaggcgtgtcctggggagcgcacctactcaggagctgtgtcaaccagaaccccatcgccgcagcccctggtttctcgccgcctcacgcggaagtctacaaatgcatcaagaacgcggtgaagcagaagcagatacggcgcggggtgaaaagaggtccagaaatntgtgtcaacacaagcggacgacaacagggcatcatgggtttgggccaggagacacattgcccaatttgagggtatacgtgccaatctcccaagtccattgtttgagcgcctgaaatttgggcctaatgtctatatccccttcttaaggagggaccttgggtttgcagccggaaggctacaaaggggcacaaccttgtgtgcatacagggacaagccccaatgaggagtaccagggaggctaacaatgaatgccttgaagaagttgcagcccttgcccatacccatatgagggctccggaagcacctgggaact

SEQ ID NO: 690418 - DNA, 187 bp, Homo sapiens
atagccggtccgcatcttgccccatcagaaacatgcagtcctttccttcgttagagctcagttcttagactgctggagggcttcagtgtagtaatctatatcatgtccccaattttttttttttttttttggaaatggagtctcgctctgtggcccaggctctcttcctgttgggccgcaaaatgcg

SEQ ID NO: 690419 - DNA, 139 bp, Homo sapiens
ggctgactttagagtattcccccctgtctgctaccagatcttgtcaggaatcatgcacatagaatttataattaagagcataccgctctgataccactgatccatatttatcagaggaacgacatgaataacacattgt

SEQ ID NO: 690420 - DNA, 113 bp, Homo sapiens
caaccatctgatatcttccttccatctcatctcccttcctcttctcttctttcctcctccccttctatgccttgctccctattctccttactctatgctcccctccttccctc

SEQ ID NO: 690421 - DNA, 432 bp, Homo sapiens
  misc_feature (387)..(387): n is a, c, g, or t
  misc_feature (405)..(405): n is a, c, g, or t
  misc_feature (428)..(428): n is a, c, g, or t
atttatttccttatccttcccctccttcttttgcagttttaaattgacttgaactacaaaaacaccaaccaaggttttgacaatggtttaaatctgattttactgaagactttttttcttttttctttctttttccttttttagcattgcagaaattgaagagaaacaaaagatccctttatggcatttatacttatatttacagagtggagtagtggatggaaattagtagagatggaaaatcctggtgacatttcataaatatttttaaaggctgttagcatcttttgccattcattgcaattattactttggatctgtctgatccttaatcattcaaaatgtgctgctcagaaaatgtggtattatgaggaagatagaatatgncaaaatgcagtgtttctnatggcattaaagttttttttttnaaat

SEQ ID NO: 690422 - DNA, 426 bp, Homo sapiens
gcaggggccatgctggtggctcgtgcctgtatcccagaactttggaagctgagcagccggatcacttaggtcaggagtttagaccagcctggcagcaaggtgatcctgtctctacttgagtacaatcaaaaattagcgggtccagtgactgcgcctgtcatccagctcttggcgacagtgaggcaggagaatcgcttgtccccataaggcacaggttgcagtgaggcaagattgcgcctctacattccagcctgggtggcagagcgagactccatctcaaagccaaaaagcaacctagcatcatgataaaagggtcatttcatcaagaagataaagacatttctcttttgaaatatattcttatggatattttgatccccgccgtttctttgtgttgggcacattccaattcttatcttctggctt

SEQ ID NO: 690423 - DNA, 192 bp, Homo sapiens
tggtgccgtgcgaaaaagctgccttcgacgtgcttctgagcctctgttaggccgtgcgttgctgtttccatggctgctgtggtggtgtaactgcgtatccggatcgtagtttctggaggatctggataatgcctcgggtatttacgcctctgagctggagcttgcccctgtgaggacttcgccgtattctgt

SEQ ID NO: 690424 - DNA, 266 bp, Homo sapiens
gattactgtacgacctactgtaactactcctatattacttttccacagctttatagcaacctatatgagggaggtgatgtgatgagtggcatatattgcaaataaggtaactgaggcagagagagagaaagcaatatccataagatcacacagctgaagggtgagagctataaaaattgctgggaatgaggggccatggtatctaggccatggtatctaggaccatggttacagaagctgtgataccaacccatacttccactatg

SEQ ID NO: 690425 - DNA, 199 bp, Homo sapiens
cgtctccgtgagactccacccaatgacctgaggcaattctcaggcctctactagtcaagcaagcctggcttgtgctgatggctttcctgagcagtcataaacttacagtgatctcccggggttccccttcgttgccctcgctttctgtgctcctttactgggacttctacaactacctgtgcccatgtctcacggagag

SEQ ID NO: 690426 - DNA, 132 bp, Homo sapiens
  misc_feature (105)..(105): n is a, c, g, or t
tttagagtagaatcaccacttattcccctgatcttttccaaacttacccaatcattgagcatgcttgacctgggcttctgagacagggcctgtcaccccggctgnagtgcagtggtatgatcgatgactcac

SEQ ID NO: 690427 - DNA, 391 bp, Homo sapiens
tgactaggtagtccgatagggtgaggatgggaccaccacgactcatcttcacttgtactcgttaacaggcattgaatccagctctccagaggtgagaggctattggggtaatgattaaaaaaaaaaaaatcggtagtattctactgtgatattaataaactggtgggagtctggtttcactgcccatgaaccataccagcaacatgcacatggcagagaggagctgagagagcaaaggggtgggcctggagcccccgagggtcccttgagggatctggccaacccccttctaaaaatgatgagacagcagccatagctgagatcaggactaagcttgagtgttagccagctggccgggttcagtccaggtgtagttaaagatgggtacggg

SEQ ID NO: 690428 - DNA, 664 bp, Homo sapiens
aagatggcggtcttggcacctctaattgctctcgtgtattctggtgccgctgcactttcacggatggctctgccccaagctttagtaacttgatgattggggcctggctctatgttgggctatattcatgtgcaggaaactgcccgacgctacctggccacggtcctgccacccaatgcgcaagcacggtaacccgtgtgcactttgacctggcagagcaagtggcagcatcctgcatgtattctacagtgccccattgtgcatgcaatgaagcaacccgcagatccatacactgtggaggcaaacatcataggcaacatttatcatgtctcaggtacagagtggccaacacaatttactcttgcttccgctttgggatattctgcattgggcctacatttacatacacactctgcatagtgtacctgatgacgtgcaaaccccaccctatatatgggccctgagtatctcaagtaccttcactgactaaagaccattgatgaggaactagaacgtggacaagagggtcacttggattgtggaagttcttttgccactttggtctaaatgacatgccaactacatttggccccctatctatggcgtgagctctccccttaacgtatcaacttgtacctgggctacaattttggcgaacggtgga

SEQ ID NO: 690429 - DNA, 396 bp, Homo sapiens
agtatagtaagactctatgaggcaacagatgttatgaatctcaggcagtggtcttggcagcatgagatctacatgtcagctaagcggtcgtggtatttctcggaacccatacggcgcatcacgtgcagccgatgaatgttgactgtgatatctagacatgtttcagaaggaatccaggccctctggtggtggtggccaagaagcgaacgtcgacttgattgtctcctttctgcatgacttaggctggccaaacaccgaagacactttccattttagccctaaacccagctcatgattaggtatacaaggcataacagaacaagttgtcaggacgagcatttgaccaagtacaaagcaattctggcaaagctgcagttcatccagctagagacacgc

SEQ ID NO: 690430 - DNA, 430 bp, Homo sapiens
tgctcggtccccctggcttgctcaggtctcggatttttctcgcagctcaaggcaggagagctttgattccatcctgcatacctaagagctttcatcatggctatttgctcttcagatgaacccatccagtcctagctgaagcctgcatgtttctctgacttccatgatcctctgtcttctgcttttctttacgttttcattaaatgacctcaacacattgtcttccccaactgcttggtctgtccctgtccataatataacagtttatatccacactgtttttccaatgacctcaggctagactttaaacacaaaaatatctacagtcagaggtagacccttccccaacagtctttggatacagtatatatgcgtcataggtctttccatctgaagctttgattgggagaaaatcatagcaggaatccct

SEQ ID NO: 690431 - DNA, 144 bp, Homo sapiens
  misc_feature (11)..(11): n is a, c, g, or t
  misc_feature (40)..(40): n is a, c, g, or t
  misc_feature (127)..(127): n is a, c, g, or t
gtcaaagcgtnatggagtggaagtgaaatcacatggctangcccggagggtcattaggaggggctgagagggcccctggttacggcgtcatgggctgggtttgactatatttgataggcatgtgatngggtgggggtcataacg

SEQ ID NO: 690432 - DNA, 148 bp, Homo sapiens
tacctctcgacgctgggaatcggtcctggtctatcagcgcaaagcgcacgtgatcgtcgccatactcaccaaaaccaatccccggcgatacacgcaccttcgcctcaagcagcagcttcttggcaaattccagcgaccccatcgcggc

SEQ ID NO: 690433 - DNA, 186 bp, Homo sapiens
cgagcagtgtcgggagcagcacgctgccgagctgatcccgaacatgctgtagctcctcctccttgcccttcagctcgggagcgtgctgctcccgacactgcttgaggcgctgctctagctacttctattgaacatgcatggaatggacggcggcgatgcagacattgcgccattgcgctccaggct

SEQ ID NO: 690434 - DNA, 753 bp, Homo sapiens
  misc_feature (33)..(33): n is a, c, g, or t
  misc_feature (88)..(88): n is a, c, g, or t
  misc_feature (116)..(116): n is a, c, g, or t
  misc_feature (142)..(144): n is a, c, g, or t
  misc_feature (205)..(205): n is a, c, g, or t
  misc_feature (233)..(233): n is a, c, g, or t
  misc_feature (264)..(264): n is a, c, g, or t
  misc_feature (270)..(270): n is a, c, g, or t
  misc_feature (289)..(289): n is a, c, g, or t
  misc_feature (298)..(298): n is a, c, g, or t
  misc_feature (300)..(300): n is a, c, g, or t
  misc_feature (310)..(310): n is a, c, g, or t
  misc_feature (312)..(312): n is a, c, g, or t
  misc_feature (356)..(356): n is a, c, g, or t
  misc_feature (387)..(387): n is a, c, g, or t
  misc_feature (474)..(474): n is a, c, g, or t
  misc_feature (501)..(501): n is a, c, g, or t
  misc_feature (504)..(505): n is a, c, g, or t
  misc_feature (511)..(511): n is a, c, g, or t
  misc_feature (561)..(561): n is a, c, g, or t
  misc_feature (569)..(569): n is a, c, g, or t
  misc_feature (614)..(614): n is a, c, g, or t
  misc_feature (633)..(633): n is a, c, g, or t
  misc_feature (641)..(641): n is a, c, g, or t
  misc_feature (738)..(738): n is a, c, g, or t
aaaggagtaaaagaagtgatgaaataagagtancatccatccaggaaaggagtgaacaactacagctgcatggggacaaaaatttttntgagattagttttaaaggttcatgaatnaaagttttcaaatgaaaacaggtagnnntcttttcctgtagggtttccagctcactacccaaaagacttgagtaattatattaaggcangtggaagacaccataggacttgaatggnaccttgtcctttctctgccagtaatggaatngaacanaatatggtacagggaaaanagaatttgnanggtggggcgntntggtagaagggaaagagcacgcaaagcaaaaggccacagagggntccctgagaatccagtacaactaagcgaggncttcaactgtcaagacaaactttgcaactggatcccggtgggacagtgccctgcagcgaggagtactgtatatgccaatgagagggnccagcttccaggaaccgttacaatggngtnncgagtnattttccctctcccacttgcattcgagagttagaaaacacacaaggtggncttgattntcactcaccacaatccccctgtacagaggggtctgtttctaagtntggaacctcaacacgaggntgggatgnttcacaacgtgctctctcccactgtcaagccatctttggtggtcttcccacagtgcttcccccatcctctcacactcctgtggagggaccatggganggggcaggaggaaac

SEQ ID NO: 690435 - DNA, 323 bp, Homo sapiens
  misc_feature (42)..(42): n is a, c, g, or t
  misc_feature (63)..(63): n is a, c, g, or t
acaggccctcagagtgctctgtaggagctgtagactgggaanagaggccaggcgtggtggctnactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctc

SEQ ID NO: 690436 - DNA, 152 bp, Homo sapiens
  misc_feature (139)..(139): n is a, c, g, or t
acatggtgccctacaagggatgtggtatggaaggtaagaagacatgggttccagaactccttctggcagtgagtaactcgcaatgtgggcagagaactcaagctcttaagggctcattcatcccccctaagttggaaanaacggcacgtgca

SEQ ID NO: 690437 - DNA, 307 bp, Homo sapiens
cgacgaagccttctgaatatggtgcggattcgacggagagaaaaggggtgcttccatatgcaagagcattcatgggtctccagattagccagtcaaaggagggggcaaaggggcaaacctctaaaatcaatcaccacgaaagggtgacaaatgcagcagggtgttcgctcatgaaaaataattcagtgaagaaaatccttctttgaaagtagaatacatagctaagaaaaaggagtgcaaagatgaaataaataagaataagttgataaaagtgagcaataagttactatatatccccagttatgga

SEQ ID NO: 690438 - DNA, 449 bp, Homo sapiens
gatctagaggctcccccaatgatggtctcagctcaaccaactgcactgaaaatgtttggggaaaatgaaataataatgaaaaagagcaatacaattaaaaataatacagatttaaaaacaatatagtataacaactatttacatgacatttacattgtatttggtattttaagtaatctagagattaaagtatacggggaggatgtgtatagagtataggcaaatattaggcattttatataagggacttgagcatccgcatgtattttggtatccaagggatcctggaaccaaacttccaaaggacaatcctgtgccatttgtatgttgtttgtgttcagatgttagggttttcttacattttttgtattttgaggggtgttatggtacttttttccttaaggaaagctgttatactcactaaaacataagccactgaaaagctgtca

SEQ ID NO: 690439 - DNA, 705 bp, Homo sapiens
  misc_feature (507)..(507): n is a, c, g, or t
  misc_feature (639)..(639): n is a, c, g, or t
gggtgatctagaggatcccggatgtgaaataggtaggtagtagtttctctggtcgtactcaaaactgactaggctagttcatgtccaaaagcttggtcaaatggcattattagataaccactcttacaaacatcaggtactatttatttctttatttagagacaggttctcgctttattgcctgggctctggagtgcagtggtgcaatcagcgctccctgtagctttgacctcctgggcaaaagtgatcctcccacctcagcctcccgagtagctgggaccacaggcacatgccaccacacccagccaattcttatattttctgtaaagacaggttctccctatgttgcccaggctggtctccaactcctgggctcaagtgatcctcccaccttggctttcccagagttctgtgattacaggcatgagcggcagccctgggcatggtacattttgatactctcaacaaacacataggctgagttactagttatagtatatgtttttngtttgtctggttaggtttttcttgagacagactctcactctgccttccagtctggagtgtggagtgcagtggagcgatctcagctcactgcaacctccacctccctggttcaagtgattctcctgcatcagnctcccgagtagctgggatacaggcatgcgccacacgccggctaattttggtatttcagtaaaatgg

SEQ ID NO: 690440 - DNA, 512 bp, Homo sapiens
acctcctaccccacgaggtgtacctcagattgagtcacttttagacattgatgccaatggtatactcaagtgtctctgctgtggacaatgagtcgggaaaatgagaatcaagattactatcactaaatgacaagggcgcgtttgagcaaggaaagacattagaacgtatggtccagagaagctgagaagtacaaagctgaagatgacaagtcagagggacacggtgtcatccatgaattcacttgagtcctatgccttcaacatgaaagcaactgttgaagatgagaatcttcaaggcaagattaccgatgaggacaaacagaagattctggacaagtgtaatgaaattatcaactggcttgatgagaatcagactgctgataaggaagaatttgaacatcaacagaaagagctggaaaaagtttgctaaccccatcatcaccaagctgtaccatcagtgcaggaggcatgccaggaggactgcccgtgggtaggaggtgtgtaccgagctc

SEQ ID NO: 690441 - DNA, 253 bp, Homo sapiens
tgtcataccccttcgtgagggtgcaggttgcctgagagttcatcagtacagtcttcatcttttgaaaggcgggatcgcttatgttggtcaaacgtgaggggaaaaaagcacgacctactgcacgaaggggaagatccaagcttcgaaagatatcccaacaaatatcagtgcactccagcaagaaaatgagcctccaccaccaaggaaatgaccttgagagaatcagccagggcgagcaagtacgagcgggagg

SEQ ID NO: 690442 - DNA, 1833 bp, Homo sapiens
  misc_feature (196)..(196): n is a, c, g, or t
  misc_feature (235)..(235): n is a, c, g, or t
ggcccaacacctacagactggcggattgcatgcggggctgctacccgccggtgcggccgctgtgcgtgcgtgcctggtcggcccctggcgaatgggaggaatccggcgggtgcgtgttccgttggacgagtgtgccgtccggtggtgttccggaggcctgggtgtgttgcgctgggcggacggacggcgtcgccgngaggcccggtggtgtctcgtgtgccgactctcgtcgggngagcgcccccgagcagcagcgcattgaagcgatctgtgagttgcgcgccgatcgagcgccacaggtataggggacctgcccttaagcggttcgagaggcggaaccagtaggagacggcactacgaaggtctacacgcctgtggaggcgaatcacttcgtaactccttgtatacgttacccctgccacttaagtataacaagggtgagactactacgggatcaatcacaatatcgatagtgtgacttgtaacatttggggagggacacgtaattctttgcggcagagggcaaatcgaacgcgttttcttagcaaaaggcagtatgaacttggccgacggttggcggccgcacacggcgaagggaggcacgcccgattcgccacagggtcgccatggccgtcgaaacccaggaggctgtcccaccacgcggcctagtaatatgcgtctcagatggagtcccagagcgagagactgacgaacatgagtgcgacactgcatcgagtgtaacttgtgtggtcggatttgaacccgtttgcaataccaaaacgcgcaggggctcgagtcgataccagttgagctcacttcttcagggggccccagttggcaattagtcctcacgcgtcctaaagcggcctcatttcctcgaagtgcacgggtacaaacccccagcgtttgggcgggccaatttaaggttggcacattagcggtaggcgttccgttggaggaaccacacggaggtgcggttgccagcacggccagcccacagagggatcggtgggtccacctccttttgagccgaagcggtggtcgtaaccaggccgccgccttccccttggcccagagcggtcccttggttcgcgctcttgggggagttacacttggggcagtccatttgggccccgttgtggcacccgcgcgaaagcgcgtgtgaaacccttgaagtgtaaaatccgtttccatttgcagaaggaaacttcctccgtttcgaacactttacagggcagagaaaggccgtctgtcatcccaggtgcgaattggggaccagggcaaacgttgggaccttgaaaccctgggcgtaacaatcccgtctgcacggccgcacagggtggccattggcgaagcaaagatgacaatgcatccctgtagagcggtacagggatccctgtggcaaatttgcgcaacgcccttgtgagagaatgtcggccctatcccggtaacgggaaaattcaactacgattatataccttgttgtggcacagaaagagaagccttatggggagagcatggagcccgtggttggttccaaagcgacgagttaccccctttgtcaaggagaaattccgagtgaacccgaagctccaggaaaggagaggcactagtaacccaaggcacagttcactacccgagaaggaaaagcaacacaggtcgcccggacttctgcgaagaacacagatgacgagtccacacaccgacaggctacgcgcggaaatacgcgagaacaaagtagaacaaaaaaggcagatcgcgcggacaccacagcgaccaacagaaagtagaagagagagagaaggaatagccgagaagccacaaaagaaggta

SEQ ID NO: 690443 - DNA, 213 bp, Homo sapiens
tcccccacaccacctgagtctctggaattgcagatgtgagccactgtgccaggctccttcatttgtgaaggatagctttgctaggtatagtatttttggctaacattgtactttttttttttttttggggttctccctctttgcctcggctggagtgcaagtggtacagtcagagctgactgtaacctcaagatcctggactcaggtggtgtg

SEQ ID NO: 690444 - DNA, 277 bp, Homo sapiens
cgggtattaagatccatctatctcttagcaccgcagcagttatcggtaagcgatgataaggtctgggcgaacgatctcactatctcaacttaatggtagagccggtcgtgcgtgagcggcgtgatgcgagtgctagtgtgcactttgtagcagactgcgctgcggatgaacgaacgcgtgttaggcgccgatgcgacgctcatcagacccagaaaggtgtgttgataagacagcagacggtggcatgaagtcggatctctaggaggatgagctggta

SEQ ID NO: 690445 - DNA, 724 bp, Homo sapiens
gcctcatcgctcgtctggcctgctcctggctcccgcttctcccatgtttccgtccaggatcccatgacagattctgttgtcattgtctccttacagagttagagcggtgcgtgaactgtcagcaccatctgatccggatcccagacatgccttcatgagaacccaccaggcagaacgtggggacccacaggctgacccccaaccgacatcagggccaacactcgtgcgaaggggagccatggagaagagggtccccagagtgataacggaagccaaaggagcaccactgtggatccgagcccagatgctccgagacaggtgcaccatggacagactggagcacaggcctgccatccagagatccccacatcaccacaacatgacaccggtcaaaaatctccaaaagatcttgcccagatattctgaagacaatcgcgggacacccctaatggtcagaatcaaccaagattcgggacgacagtttcggccctgacacgtgtgagctcttggccaacgtgtgcagtatcttcacacgcagcgccggacagacgtgacaaggacccgcactcaagcctgcaggatgatatgaggactgctgagacgcgaacggcgaacagctgaacgccccggtggcacacgacatatccgagacccgacaatcccggggaacacccgggactcggacctcggcacctggcatgccgcaagctgaggcgccatgtcg

SEQ ID NO: 690446 - DNA, 918 bp, Homo sapiens
cctggatgtgctctcttgaataggccttactgttgcaactatgaatgcaaacaaaacaccacaaaacagacttcactaacacagagaatctgaaactgggtgtgagagtggtgatgtacaaggacctgcgtaagccagggaatttacgataccatcaccgtttccatcatagaataagtctgattgcatgtcatcggtgaggttaatggcatctaatgatggattttttggaacatgttattgcagtgattgtcaaagttaaatctgaatttggggtaatgatttgtgtcattggagtgtctagagtgttatactgaatttaactactcttagttatcattaatgtagttctcgtcgattgaactatgtgatagatctaatacgctgtagaaaactggactaatcagttgccaataatatctaatatttccgtcatcatgcatcgaattaaataatcatctatagtctaggaatcttgtctgtcgacttcacgtacatgaatgtcgcccaatatgggtcgttccaagagaatgcacaagaaccgacaattaagatgtgcactacttctttttgaaagtaccagatatgctaggagagctggtgtgtggtaattcccgcgcaagatacctcgcgtaccccttttatgaacctgttgcaactattggtaaaaactcttttgcgcaaattgcagctcctattcggaattcctgtgaatgcacccgtggtgacaggctgacattcgctcaccgataccaccattttagcctacttgttaggttagggcgccgcttttaacatctgcccccggttgatccacggggagcaaagcggggcgctataagtcacccatggcgcttgaaccctggaaactgcgcgctaaacggcttcccggcaaacaacaacgcacgccgggggcaa

SEQ ID NO: 690447 - DNA, 1111 bp, Homo sapiens
agcttgtctctgggatcttcggctcctatacaagtatagcctgggtcttggataaactgaaagctagagcgtgaacgtggtatcaccatatgatatctccttgtggaaatttgagaccagcaagtactatagtgactatacatatagatagccccaggacacagagactattatcaaaaacatagattacagggacatactcaggctagactgtagctgtcctagatatagtatgctagctaggtagtatggtagaatattagaagctaggtatactaccaagaaataggagcagcaccccgagacgcatagcccttactaggctatacacactagggtagtagaaacaacctaaatatagtacggtagtataacaaaataggatatccactagagacacaacctaacaagccagacagagataatagcaggaaattagtataaaggaacagtacagcaaccttcacatttcaagaacacatataggctaacaaaacacccgaacaacagctaagcatataagtagaccaactatctagggttcaggacactggtagaccaacgatgctaggaagcatacagtagctaaacatagcacattaggtatcaacaggggctaggcaaacagtaccaccccgtaaaggattggcacacagcacgagtagggaaaccacgacatggtttgagggctactggacctagtaatacctaaaccaaccaaatacgtaacacaactagaacaaaagcccctttgacgaccttagactactccaagggactgtctaacaaaaaattgggtagggaatatgggacactggatccctaggtaaggaacagaaaatggaaaacttagataggtatctccagaaacccggataattgtatggacaaaccatattgcatacaaagtatcacagggatatacaaaacgggaaagattaaagattctggtcaacaaatgaacccaatgaaagactatgaaagttaaaagatatttcacatgagacaaatgtgtgcgtatacatggttccaacaaagtatgttgtcaacgacatgttctacggatggaacgaatgtaggagtaaaaacaagagtatacacacgaagaatg

SEQ ID NO: 690448 - DNA, 244 bp, Homo sapiens
gctgtaataagacacagaggagtggacacagagacacctcccagctggagacagtcaggactgactgatggagatgtgacagccagtgctccacacccaggcaagaattgtggatggcctgtgtgaacagagaagtcatcaacacacacagttcaaagtctaccctatgctatgggggggagcagtgaagaagtgggcagtggacgcagtgggccctggcctgcgagctccctgttggcctctg

SEQ ID NO: 690449 - DNA, 120 bp, Homo sapiens
cgtgacggagctgggcactggaatggcttgtacctgcttcaagcacctggctacaggcaactacctggctgctgaggagaaccccagttacaaacggtgatgcctcatgctcccaaggca

SEQ ID NO: 690450 - DNA, 97 bp, Homo sapiens
agatagcgtttccgactgtgctcgctgctcagcgccgcacccggaggatgaggctcgccgtgggagccctgctgtgtctgtgccgtcctggggctgt

SEQ ID NO: 690451 - DNA, 203 bp, Homo sapiens
agcgcgttgttagtgaggccgagtgagagataagaaaactggggaaagttaagtttagagaattagtcgaagatttggctgcaaaggaagagaaaagaatggcatggggcaacatgggagaagatgatgtgctttgacatgggcagaatgagaggctttgacatgtggcatgaagagaaaccatgtgtgcttgagactgtcac

SEQ ID NO: 690452 - DNA, 1241 bp, Homo sapiens
ccaaggccaagcgcgagaagatgacccagatcatgttgggagaccttcaacacgcccagaccatgtacgttgctatccaggctgtgctatccctgtacgcctctggcctgtaccactggcatcggtgatgcgactccaggtgacggggtcacccacactgtgcccatctacgaggggtatgccctccgcccatgccatcgctgcgtcttggacgctggcgtgagcctgggacctgactgactacctcatgaagatcctcaccgatgctgcggctacagcttcagcacacacaggaccgatgctgggtaagtcgtgcgatgacattaaggagacacgctgtgctacgtctgccctggactacgagccaggagatggcgcacggactagcgttccagactccgtaccgctggagaagaagctacgagactgactggacggcacaggttcaatcacctactagggccaatgacagacgagaaccagactgtacctgatgagcaacctcataaccagacacttcctatacctgggccatgtgaagtacctggatagagcaatcacacgacaaaaactaaccctatccacaaatacccaatacaataggaacgctgttgacaccgtaggagaagccataccacgacgagaaggactcatggctacggccataactgcaagttgcctaggctctagggacagggccaccccaacccagtagtcaaacacatgagaccatctggacaccgaagcaagagaagtggaacagcacaacaagagacaggaactacgaaccaggaagcccagaggaacaacccacaaaaacaagcaaaggcaaacgaagacaaaagaacttccaaacacgaagaccacgaccatggaataccacaaccaaacagcaacccacaagcaatgtaggagcaaacacagagacgagacatccacacgacacaatgggagcccctacaacacaggaacacgacacaccaataccccaaggcacaagactaactgaggagaacttccaaccaacaacgacaacgacacaaggcaaatagacacaaatacatacaacgagagcccaccaaagccagcagaccgagcacacaacacagcacacagagactgcgcaccacagacgaaagagaaagaaaactagacacaacacaacacggccaagtagaacacagcaccaacgcatagcacgcaaagaccacaagagagcaagagcagcctcaacaacaact

SEQ ID NO: 690453 - DNA, 327 bp, Homo sapiens
  misc_feature (299)..(299): n is a, c, g, or t
ccacctccttgacgatggaatagctatataatttaccctggggccgggcacggtggctcacacctgtcatccccagcacttgaatgggaggccgaggagggtgatcacttgaggtcaggagtttgagaccaacctggtcaacatggtgaaaccccgcctctactaaaaatacaaaaaattagccgagtgtggcagcgcatgcctgtgatcccagctactcgggaggctgaggcacaagaatcgcttgaacctgggaggtggaggttgcagtaagccaagattacatcactgcactccancctgggcaacagagcaagaccctgtgta

SEQ ID NO: 690454 - DNA, 838 bp, Homo sapiens
gacaaggtctcatgatgttgtcccagctggtcttgacctccagggctcaagcaatcctcccaccttggcctcccaaagtgctgggaatacaggcatgagtcaccatgcccagccatattatacatttttaacttacaatagtccacattcaattgatattaaaccagttcacttgtagtataagaatcttccccagcctggccaatatggtgaaaccccgcctctactaaaaatacaaaaaaaaaaaaaattacgccagggtgtgggtgggtgcggtcggcctgaaagtctcagctactggggaggctggaggcagaaagattggtttggaacctgggaaggcagaggtttgcagtggagctggagatcggggccaggcctaggcaacgagcaaaactcccatctcaaaaaaacaaaaaaaaaatctccccgggtgggggcaaggggggcacagcggcggggaatacccaccccaggcttcttggggagccgccacaggggaagggaaagatccacagagagggccaagagaagagactcccggtccccagaaagaactatacactataacactatttttctgtcccaatttcttctccacataataattggagattctgggcatatggggccgaggggtgttcttcacactcctctcgtctttcgtgtctatagaacccccacacgagacacttttgttcagcgcccgagaaaactctccctatttacacccaagtgggcacaagtgtccacaacccgtggtaagtcccccaccctcttggcggatcgccaagagaccaggctcgcagaggcgaggaggcccaaaaagtttcaaaca

SEQ ID NO: 690455 - DNA, 113 bp, Homo sapiens
ttgactgtgtctggctgcttgtaacttctcctcccttttcttccggtagccataggaattcttccttcccctccctaaaccaggagaggattcgagactgcctggctccacac

SEQ ID NO: 690456 - DNA, 442 bp, Homo sapiens
  misc_feature (29)..(29): n is a, c, g, or t
  misc_feature (154)..(154): n is a, c, g, or t
  misc_feature (156)..(156): n is a, c, g, or t
  misc_feature (160)..(160): n is a, c, g, or t
  misc_feature (170)..(170): n is a, c, g, or t
  misc_feature (181)..(181): n is a, c, g, or t
acgttggaaggcccaatgtatgcgcaagntgggttcgcatgaaagggaatgccccacgaaacttgtcagcggtgggtgtccctcttgggcacccctggcagcgataggcttcattctcattcttgtgttcacgcacctggcccttgcaaggaangncctngatcagccancagacagcgtncctctgaaggcagcggtgtgaatgatccaagcagccccagctgggaggttggccccagctccctctgaactcactgagaaaggacccagtacccaagatgcactggggaccaagacagagtaaaagcccttcaccttgttggagtgaagacattatcacaggcatgtccccaaagcctgagcacctactttatgggatgaccatgggaacactccaaatggcagctctttgtccaataaaggctcagagagctagactgga

SEQ ID NO: 690457 - DNA, 109 bp, Homo sapiens
  misc_feature (8)..(8): n is a, c, g, or t
gatgcttnagctctggaaaagagggggcaagagtaaaggaggactttgtcttgcattttgtatattagctcagccacagtagcctagagcactcatcagagtcctaagg

SEQ ID NO: 690458 - DNA, 208 bp, Homo sapiens
gtacggctgttttttttagccagggtcatactctgtcacccaggctgcagtgcagtggtgcaatcatgactcactgcagccttgacctcccaggctctagctattctcactccactgcctctgtaatcttttttcttttcttttctttttttctttctttctctttctttcttctttctttcctttctttctttcttttctttctttt

SEQ ID NO: 690459 - DNA, 236 bp, Homo sapiens
tttacaaagcaaacccctgagggcatcagataaagaattccaggctagcctcctggaggatgagagaacatgtggaacagagatgagtcatcccaggggaggccttcccagaccaaccatcctagaatggggggctacaaccttttttttaaaggaccaaccggaaatactttaggcctgggggccatatgatcatctccattccaaaaactcaattttgatgttgtagggcaaaa

SEQ ID NO: 690460 - DNA, 426 bp, Homo sapiens
atggcaggtgaaaaaattaataaagacttccaggtagaaattcccgagtttttgtcagcgtttgagaattcccttggggctgtggatgagatgctgaagaccataatgtctgtttttaaaaatgagttgttgcagaagttgggtccccttgaccaagcaaaagtggatttggtttttgcatacccattaaattcaatgttttgggtttttttggcaacccaaggggtttatcctaaggaacatcccgtaaaacaggaattggaaagaatcagggtttttatgaccagagtcaaggaaattccagccaaaaaaaaggctggcaagctgggcaaaggggcagcttcaagatttgtaaaaaatgccctttgggaaccaaaatcgaaaaatgcatcaaaagttgcccataaaggaaaaagttaaagttta

SEQ ID NO: 690461 - DNA, 265 bp, Homo sapiens
acaactcgagctcgtacccctaattggttcttcgatgacgaagccaaggcagtaaagagatttcaccttaagtgccaacttccaacaactggtaggaactatttggattactgtgctggaaagattacaggactgtgtcccccttctccccattccaagaaaaagagagctgtagtccattagagccgcttctcagaggagggataggcaggacagaagtggaagtggttaacatttttaaaagcgtcatcgaagaaccaattag

SEQ ID NO: 690462 - DNA, 138 bp, Homo sapiens
tgtcatcatatcaccattaaccttccctcgtacacttatcatcttcacaagttctaattctactgactatcctagtaaatcgctgtctgcattgatccaagcctacgttttcacacttctagtaagcctctaccagaa

SEQ ID NO: 690463 - DNA, 260 bp, Homo sapiens
aatcagctcagccctcattagtgtaagaatatcaggcgatcactcgccatcggacagtggaacaccgatgactttcatgtgcacgggcggtacgcacctctgatccggtgcaccctgcggaatgattaacgatctgatcatcaacatggtcccagcctgacctgctcatcaccaccacaaatttctacgatcagcgcactgatacgttcaatgtgctcaacgatattgtcaaaatcaacaccccgctcaaagcgatgtgc

SEQ ID NO: 690464 - DNA, 846 bp, Homo sapiens
caacctcaaatggatcaagatgaatggaagtaacttagctgtctgccaaatttccaacatttcttaaagaaagacaatgtaattgaaatagtcaacaatgtaacatttaacagtggtcagcatttattaaaaattatagatatgtgagaaggcaggaaatgtgacctgtaattgagaggaaagttatttaatagaaacaggcacagaagtgacagagattatgaaattttagacaaatactttaatatatctattattaatattataaatttgaccaaggatttagaagaaaacattaacataattaggagagacattcaagatgtaaaaagagccaaatgggaccatttgagctgaaaaatacaacatctgaaatgaaaaattaactggatggttttagccatagattacactgcagaagaaaatattaactgacctcggcggcatagcaatggcaactatccaaactgaagtacagaccaccaacttgaacacacaattcaggtatgataatttcaccctgggggtctatagcaagtacatgtgacctgtgagaaacctagagtacagacactgacacgaaggcacatagtaggcagccaacaatatatattgaacgccaataataggcacaacacttttcaacattgcataaaagctcaaaggcccagatcctagaagcacagggactctccagcaggtaaccaagccacactaggaacatcatacttgaatgtatttacactcagcacaagatccaacggctaccgcacgcactcgacatgtccatccccaaacacgcgcaaaccagctcccccacaaaacaaaatgcgccgccaatcaccg

SEQ ID NO: 690465 - DNA, 353 bp, Homo sapiens
tagaggatccccaccccgggtctttctccaacaaaattacttctggtgcacagtagaattattggggtctgtgtgatgggagtcctgacagcacgtatctctgcaggggggagtcgagacaacacgggtggtggtcgggggtgagtgcgattccattgatgattggtatggagcacaagatgggccctggctcctcagtccgggaggtgggtggggctgtgacagctgtcagggtctggccagtgctccacccttctcaacgatacgtggttgcagtaggatgggagtgtggaacgattggcttatataccgggaaaaagatggatcaaggggtacggagctcgaatacgaaa

SEQ ID NO: 690466 - DNA, 399 bp, Homo sapiens
  misc_feature (34)..(34): n is a, c, g, or t
  misc_feature (104)..(104): n is a, c, g, or t
  misc_feature (117)..(118): n is a, c, g, or t
  misc_feature (120)..(120): n is a, c, g, or t
  misc_feature (124)..(129): n is a, c, g, or t
  misc_feature (139)..(139): n is a, c, g, or t
  misc_feature (142)..(142): n is a, c, g, or t
  misc_feature (146)..(147): n is a, c, g, or t
  misc_feature (152)..(152): n is a, c, g, or t
  misc_feature (155)..(155): n is a, c, g, or t
  misc_feature (159)..(160): n is a, c, g, or t
  misc_feature (170)..(170): n is a, c, g, or t
  misc_feature (182)..(182): n is a, c, g, or t
  misc_feature (185)..(185): n is a, c, g, or t
  misc_feature (190)..(190): n is a, c, g, or t
  misc_feature (208)..(208): n is a, c, g, or t
  misc_feature (212)..(213): n is a, c, g, or t
  misc_feature (258)..(258): n is a, c, g, or t
  misc_feature (262)..(262): n is a, c, g, or t
  misc_feature (264)..(264): n is a, c, g, or t
  misc_feature (354)..(354): n is a, c, g, or t
  misc_feature (358)..(358): n is a, c, g, or t
  misc_feature (379)..(379): n is a, c, g, or t
  misc_feature (386)..(386): n is a, c, g, or t
acctcatgagaccctttccatttgggaccaagtntggggatgctcacatttcaaatatttatctactgcctctgtgttacaaccactaatgtgttctaactgangagtttctcattnngnggannnnnnttgggggggnggntggnngcttnttnttgnngtttattgtnaattcatagagngtnttttntagcatacttgggtgggnattnngactactagggtccttttttcttttcatgtaaatgcttccttaanattnanaccggcaagggaatacagccaatttatagtttaccaattttatatacggttattcattctttttttcctgagatattaagcacatttgtnagtngtctgttttcatgcaaaagtntattttnccattcttcacat

SEQ ID NO: 690467 - DNA, 131 bp, Homo sapiens
agcacgcaggatcgcgttctcgttacacgctatcctattattccgtggcctgaatgagaagggggaagcggtcagcacgcgcgtctgattcgctcggttaacgtgaaatcagcgtctacagtgaatacgat

SEQ ID NO: 690468 - DNA, 83 bp, Homo sapiens
  misc_feature (35)..(35): n is a, c, g, or t
caccttttccccccttttttgggccttggattttncgggagggttttttccttttttaaccaaaaaaagggaattggccctta

SEQ ID NO: 690469 - DNA, 1001 bp, Homo sapiens
  misc_feature (254)..(254): n is a, c, g, or t
  misc_feature (267)..(267): n is a, c, g, or t
  misc_feature (536)..(536): n is a, c, g, or t
caaactggagagcatgtgcagcttgaaggtgcaagccactttatgattccaattggttgtagttatgcaggagtgaaggcccagtgtttccagatttttttttccctgaagaaattccagaaatctgaatttttgtgaaattcttgatattaaaatgtttaagtttttttgagtgaatactcatggccagtgtagatgtattagtggccaggagaggacataggctcagttgcagtttcccttattatagtagnttgactcccaagntaacccatgctctgcaaattataagatagctaaattatactactgacctgatttctgagagcagggcatgtgggggcagaagtgttactagctccctttcctgggctcagggaaaatagtaggggatggtggatgctgtaaccaggcaaagttgggtaatgtatactttctattctgccgtcttttgttgtagagtattttgctctgagccatccagggccttcataataccttcagttgttgttctttaacctgctaggctctgagangacctgtattttcaccatctctagaattcttacgtacttcttccatcgatcaggaaacaagtacaacaaatccatgctaagtatcacagatagaaccattggtattatctattgggaagtttgtgcttattaacaagtaaatgctgaattgatagacttctaaacattgcagtaaagtacagtaaaaataattaaaccacgtaggatgacaattcgctgtgatataattagaatttgctacattctaccaaaaacaacgcaatttctggatctgtgttgtttccctcagtggtccaagggagagagggcatagaccttgtatccacattaacagagattcttcactgatcgtcccttacatcacagtgctattatcatctctggcggacctaatactgtgtatgctgaagatgctccctggtctgatccagcaatatacactattggcacgcatgtctcggaatc

SEQ ID NO: 690470 - DNA, 211 bp, Homo sapiens
  misc_feature (1)..(1): n is a, c, g, or t
  misc_feature (188)..(188): n is a, c, g, or t
  misc_feature (200)..(200): n is a, c, g, or t
ntggcatgccgcttttgaggccctggcccccctttacccttcacccccaacagggacaaatgttcctggcaggacctttcctcaaagcccccttcactttcctgccccatccttcccaggctcccgggctccataatgtaatttgttcagcatggagacctttttttaccgcccctgttttaataaanctgggtgtttcncttcggcatca

SEQ ID NO: 690471 - DNA, 124 bp, Homo sapiens
tctcaggagagagaactgccagggttcaattaaagaaagaggctaattaataatgggcaatataggggagatgggtggggaaaagaggaaaaagctccgttaaaccttaagaataccacaaccc

SEQ ID NO: 690472 - DNA, 366 bp, Homo sapiens
  misc_feature (40)..(40): n is a, c, g, or t
  misc_feature (280)..(280): n is a, c, g, or t
  misc_feature (360)..(360): n is a, c, g, or t
aaggcaactccaagaagaaataaggtcctggcatagcatncaaattcctgagagttacctggttgggtaagacacaaaacatacctagaactgtcatcgataagatagcacagcagcctgttccccagacagaaaagcaacttcaggttttcccaggtttactgggttactggaggatattcattcctcatttggcacaaactttccacctattatacaccctaataaaaaatggttaaaaaaaaaaaaaggccagggtacagtggctcacacctgttantcccaggcactttggggaggccaaggcaggtgggttcacctgaggttcagggagtttcaaggaccagcctggggccaacntgggtg

SEQ ID NO: 690473 - DNA, 479 bp, Homo sapiens
aagacaaagcagggctggagtgccaccatctcgacccgctgatgcgaacatttgtcgggatcaagcacattggtaccctaaccactaaacgggttgggcaaagaccgaaggatcacatccacgacggggaccaattggatcgctatcaggaggccgccaacaaccgtaaagggcgatgctgaaataccacttacggcagcctgaatacatgtgatacttactgccaaatctgcggaaataatatgtaagacccagtggccgaaagctattaatgatacccgacccaaaaaaaagatggcctggagttatggtcagtaggaacgtgggaaggacttgtcgcccttgaactgtcccgtgctataacgcaattccccggtggtctagcgggcttgagggaacacacagacacgctggttcctaaattgatgaaagtcttaagaactggaggagcctttccagcttcaagaaagagccccatg

SEQ ID NO: 690474 - DNA, 153 bp, Homo sapiens
cctacgtggtattctacgagtccatgatcaacaccgtgaactatgcccgggacacgtggctggcgcccgatggcctcatcttcccagaccgggccacgctggtatgtgaccggccatctgaggacccggcagtacacaagactacaatgatcc

SEQ ID NO: 690475 - DNA, 929 bp, Homo sapiens
  misc_feature (3)..(3): n is a, c, g, or t
  misc_feature (20)..(20): n is a, c, g, or t
  misc_feature (30)..(30): n is a, c, g, or t
  misc_feature (94)..(94): n is a, c, g, or t
  misc_feature (118)..(118): n is a, c, g, or t
  misc_feature (246)..(246): n is a, c, g, or t
  misc_feature (267)..(267): n is a, c, g, or t
  misc_feature (280)..(280): n is a, c, g, or t
  misc_feature (292)..(292): n is a, c, g, or t
  misc_feature (294)..(294): n is a, c, g, or t
  misc_feature (310)..(310): n is a, c, g, or t
  misc_feature (312)..(312): n is a, c, g, or t
  misc_feature (315)..(315): n is a, c, g, or t
  misc_feature (322)..(322): n is a, c, g, or t
  misc_feature (332)..(332): n is a, c, g, or t
  misc_feature (344)..(345): n is a, c, g, or t
  misc_feature (357)..(357): n is a, c, g, or t
  misc_feature (360)..(360): n is a, c, g, or t
  misc_feature (371)..(371): n is a, c, g, or t
  misc_feature (374)..(375): n is a, c, g, or t
  misc_feature (381)..(382): n is a, c, g, or t
  misc_feature (384)..(384): n is a, c, g, or t
  misc_feature (388)..(389): n is a, c, g, or t
  misc_feature (393)..(393): n is a, c, g, or t
  misc_feature (405)..(405): n is a, c, g, or t
  misc_feature (407)..(407): n is a, c, g, or t
  misc_feature (410)..(410): n is a, c, g, or t
  misc_feature (438)..(438): n is a, c, g, or t
  misc_feature (453)..(454): n is a, c, g, or t
  misc_feature (463)..(463): n is a, c, g, or t
  misc_feature (467)..(468): n is a, c, g, or t
  misc_feature (471)..(473): n is a, c, g, or t
  misc_feature (476)..(476): n is a, c, g, or t
  misc_feature (481)..(481): n is a, c, g, or t
  misc_feature (487)..(487): n is a, c, g, or t
  misc_feature (490)..(494): n is a, c, g, or t
  misc_feature (497)..(498): n is a, c, g, or t
  misc_feature (502)..(502): n is a, c, g, or t
  misc_feature (510)..(510): n is a, c, g, or t
  misc_feature (513)..(514): n is a, c, g, or t
  misc_feature (517)..(517): n is a, c, g, or t
  misc_feature (520)..(521): n is a, c, g, or t
  misc_feature (524)..(524): n is a, c, g, or t
  misc_feature (526)..(526): n is a, c, g, or t
  misc_feature (543)..(543): n is a, c, g, or t
  misc_feature (553)..(553): n is a, c, g, or t
  misc_feature (578)..(578): n is a, c, g, or t
  misc_feature (584)..(584): n is a, c, g, or t
  misc_feature (600)..(600): n is a, c, g, or t
  misc_feature (604)..(604): n is a, c, g, or t
  misc_feature (609)..(609): n is a, c, g, or t
  misc_feature (683)..(683): n is a, c, g, or t
  misc_feature (850)..(850): n is a, c, g, or t
  misc_feature (857)..(857): n is a, c, g, or t
  misc_feature (896)..(896): n is a, c, g, or t
ccntcttacgcttctttttnttttaattantaatattaacaaatcattattgatataggcttttcaatttgctcaagattaggaattgtaagtngaatgaagcagcacttccagttgncaaatggatccaaaggtaatccaatgtcttttaaattaagcttgtgacaattaaaccaatacactgtagcaatgagaaaactattgacaaagtataaccagggaatattcatctcaatatatgctggnatctgaactttaagtaaaacnctgattacctgangtagtacaaatngnaaccaggtactgccanancanacaatgngcttggctangcctttttcccnngttctcacagtntanctggggtgggntgnnaaaggnnantttnngttngtttcattcatntnggnggttatcctgatagcctgtaccaaagtngtaacttcttcccannaggttatgngagnnacnnntanaatgntcaccntgnnnnntgnnagcnagttactntgnntgntgnnatngnaaggtcagttacgaganttagctttcngtgccttcatgttttggtagatggntgggtntcccaaaacataagcnaggnctganatccaaattaaaattactgtaaagaaataaaataatttttgacacttaaatgaaagcttggttgttttagaganattcaggcaataatctatacaagctgtcaggaaaactggataatgcaaaaagccataagtaaaggaaataatttgagtaaataggcagatgtggtatttagtgaacctaatgcttaaaagtacaaaatccctgaaatacaatataatggaaatgtttaccaaaagtnaaagatnaacgaatgctagtgaaatgcaaaaatattccataaaatnttgacaggtgttttttcttctcattcctagtgt

SEQ ID NO: 690476 - DNA, 263 bp, Homo sapiens
attcttatcttaggctatgaggccactggcacaggaacttacgaaacataggccacaacctaatagaaataacgattgtgggacaggaaccagcaaccaacacatagacaaccgctgtctttaggtgctcgctttgcgaaatactactcacgctactaggtgctcaagacgcattatttactaaactccctgagtcaaagcaacgggtggacatgacagttattgctgaagacactgcaggaccaacttctgtaaagagactg

SEQ ID NO: 690477 - DNA, 1222 bp, Homo sapiens
  misc_feature (82)..(82): n is a, c, g, or t
  misc_feature (93)..(93): n is a, c, g, or t
  misc_feature (398)..(398): n is a, c, g, or t
  misc_feature (460)..(460): n is a, c, g, or t
ccacgcgcacgccccgcacacctcacgcacacactgctcactcccctcagcgccacgccccacgccaccttaccctgcctcncctaacctccnacccgcacctctctgcacacgcactctcacacctacctaccctacacgcactcctctcacctacacaccacactgcacacctgcgcactgcacttcacgcctgcacgcctgcgccaacgcacacacttctcccctgcctcctctctacacctcccctgccacaccctgcacgcgcagcgcaccccctccctgccccacgcgcctacgcacaccgcacacgcgcacgcactaacacgcgcacgcgcactgctctgcacccacacggccacgcctgcacacgcgccccgcccacacgcaaccacgcngcctctctctcacgcactctgcgcactcctcccgcctggcccgctaccctactgcgcactgncctctcccgcacgcagcgggcgcgccgcacctactctactaccacacgctctggccctgcactctctacacctccgcacacacgcagcactccgctcctgccctgcctggggcgacaactggccgctcaactgacactggctgggaacaaccctcctacttcccaactgcactactctgcaactgcactttacgccagcgcctgcactcacacaaccacttggccgctacctgctgcagcgcttggcgcctgaaacaagatcccacgggcccgctacaactacccaacttgcactggcacacactctctctctcttacactattaccaagaccatgaaccctacttggctgctaattgtggccaaactcacttcccttgcgacacttttccccggtttggcttatgctcacttctggaacgactaggggcctgccacgtgagcctgtgggaaacacagctgggttgtcaaacccaggcaggagcaaacctccctctcacttgcctcctccaccgctggcccctccctctccctccccccgcagcgccccggcctccccctcccggcgagcctccctgccacccatactgcgccccctgggccctacatggcgccctaacaccgccacggcggccgccccccctccctcccccccccctgccctcttctccccccacgcgtcgcgcccctttcccccgccgtcccccccgcccctgctccccccttgctctccccccccggtccgcgcccacccccgaccctg

SEQ ID NO: 690478 - DNA, 291 bp, Homo sapiens
gggccagagtgtcgctctgttcccagactggaagtcaatggcacgattctcggtcggctaactgccaacctcccgctcccgggttcaagcgattctcctgcctcagcctcctgagtagctgggaatacaggtgtgcaccaccacgcctgggctaatttctttgtgtttttagtggagacagggtttcaccatgttggtcaggctggtctcgtgatacgcccatctcggcttcccaaggtgctttgattacagacgtgaaccatagctcctgcccccttctgtcgtcttctc

SEQ ID NO: 690479 - DNA, 191 bp, Homo sapiens
attcgcggccgcgtcgactaaaaacaaacaaacaacagaaaaaacactcactgagcgctgggtgcagtggcatgcacctgtaatcctagctacttgggaggctgaggcaggagaattgcttggaccgaggagttggagaccagcctggggaacataatgagatcccatctaaaaaacaaaaaaagtcgacg

SEQ ID NO: 690480 - DNA, 309 bp, Homo sapiens
  misc_feature (10)..(10): n is a, c, g, or t
  misc_feature (49)..(49): n is a, c, g, or t
  misc_feature (61)..(62): n is a, c, g, or t
  misc_feature (66)..(66): n is a, c, g, or t
  misc_feature (80)..(80): n is a, c, g, or t
  misc_feature (102)..(105): n is a, c, g, or t
  misc_feature (121)..(121): n is a, c, g, or t
  misc_feature (210)..(210): n is a, c, g, or t
  misc_feature (218)..(218): n is a, c, g, or t
  misc_feature (259)..(259): n is a, c, g, or t
agaatgcagnaattgctgtccgtgtatcaacattccagtttctaaaaanagccagccagcnntttnccttttaagattcnccagaaggctgcaaggccagannnncaaatatcgggtgccntcctttggaaatatttgacctctcttctgtgaagagaatggtacttaacagactactactagtgctttgtcagtaccgaagtctgaatncccagtcnaatggcatacattatccttaaggttttaatcccacctgganaattgtgatagaattctcacaaaataacccaggcattacatgtgacaact

SEQ ID NO: 690481 - DNA, 643 bp, Homo sapiens
  misc_feature (49)..(49): n is a, c, g, or t
  misc_feature (71)..(73): n is a, c, g, or t
  misc_feature (78)..(78): n is a, c, g, or t
  misc_feature (135)..(135): n is a, c, g, or t
  misc_feature (199)..(199): n is a, c, g, or t
  misc_feature (201)..(202): n is a, c, g, or t
  misc_feature (219)..(219): n is a, c, g, or t
  misc_feature (250)..(250): n is a, c, g, or t
  misc_feature (265)..(265): n is a, c, g, or t
  misc_feature (267)..(267): n is a, c, g, or t
  misc_feature (286)..(286): n is a, c, g, or t
  misc_feature (310)..(310): n is a, c, g, or t
  misc_feature (324)..(324): n is a, c, g, or t
  misc_feature (332)..(332): n is a, c, g, or t
  misc_feature (341)..(341): n is a, c, g, or t
  misc_feature (362)..(362): n is a, c, g, or t
  misc_feature (368)..(368): n is a, c, g, or t
  misc_feature (370)..(370): n is a, c, g, or t
  misc_feature (437)..(437): n is a, c, g, or t
  misc_feature (451)..(451): n is a, c, g, or t
  misc_feature (465)..(465): n is a, c, g, or t
  misc_feature (505)..(505): n is a, c, g, or t
  misc_feature (568)..(568): n is a, c, g, or t
  misc_feature (640)..(640): n is a, c, g, or t
gcctgcccccagcagaaacagcaggtctcagcggctacatgtgctttanagcttggctgggggacaaaagnnngaganagagagaaaccggcctcatgactcagctggtcaggagataaggggccagatgctgancccaaatccccggcagcacccctagcaaataggtctgtatcaaagattctgtacagctggtttncnnggtgaagggcacctatnggggcttaaataaatggacacggggcaaggnatgtagcgagaacananggtgactgtccggccaccngcctgcccctctcgcgcccctgcntgctgacccccggncccacctncccactgtngcccgcgggactccccaggtnggatangngggaagctctccagcaagtttcggccccacctctctctgagcagatgagacaggaagacgggcactngggggctgggtggngcttagcgcaggtnctcctcatcgccctggatggtcttcttgatgcgcacagcnatgtgtggtgagccactggtccagccgggagatggagtcgtattccttcaccgactcggtgtngctgtccacattctgctcctcgtgggcctctagcaattttttcatcaacttgcattcccgggaatcagaganagc

SEQ ID NO: 690482 - DNA, 87 bp, Homo sapiens
atgacctcccaccctaggagggagggaaggaccccgtcctagggtataacctggcaataaaccgtgcctctccctgtgaaaaaaaaa

SEQ ID NO: 690483 - DNA, 158 bp, Homo sapiens
tcatcgaacctttaaaaaaaaaaaaaaaagaaagaaaaatgcaattttctttcaaaataaagagactttttccctagtttcaggaattcccccaaatcacttcctcatgggcttagtttaaagccaggagactgataaaagggctcaggttttgatga

SEQ ID NO: 690484 - DNA, 399 bp, Homo sapiens
cttcccacaacctcaaactcctgggctcatgtgatcctcccacctcagcctcccaagtagctgggactacaggggtgcagcaccatacctggcaatttctatccttctttcttctttcttccttttttcttccttcttccattttcttcctcctccttcctcctctttcttcctccttcctccctccttcctcctcctcctttcctcctccctcctccccctttttttaaacagattgaaatcttttattaaattttttttttatttccatgggtttttgggaaaccggtggtatttgattacataagttctttagtggtaatttgtgagatattagtgcacccataacccgagcagtatacactgaacccaatttatagccattttacctcaccccca

SEQ ID NO: 690485 - DNA, 391 bp, Homo sapiens
  misc_feature (34)..(34): n is a, c, g, or t
ttttggttttaaaatttaacccatagggatggtnctagtaaaaaatggttatagattacccgtagagctatttactgttccaaagcccacatgataggcatattttgtatttcgtggtgccctcggtttggttcatattgggccttttacatcccctttttagcaaaaaaaaaagacccctttggattctcttttgcataaaacctgggcattgggaactatgtggctggatccctacgggtagccaaatactttttgccccccaaggttaatgaaactgttaaaaacctctgggtatttggggccatgaactttttttagcctattagggtttaagccaaaataattttttccgtatgttttctttagggccttccataaatgttttaac

SEQ ID NO: 690486 - DNA, 297 bp, Homo sapiens
gtaataaagagtcagggaggctggatgcagtggctcacacctgtaatctcagcactttaggaggctgaggcgggtagatcacctgaggtcaggagttcaagaccagcctggacagcatggtggaaccctctctctacaaaaataaacaaattagctgggcatgatgaccggtgcctgtaatcccggctatcctcgaagctgaagagggagaatcatttgaacctgggaagtttcaattaacccaaattggaacattggaattcaagcttggcaacaacggcaggactccatctcaca

SEQ ID NO: 690487 - DNA, 1496 bp, Homo sapiens
caaggaggagcagaagcatcgtactgggtcacgtacccaagctacgacaagtgacacatggcacaatagctgatcactagcgaagatacatgaacactgcacatagatgaagacatgacaacaacaagtaataaaacagtccgacaggaacaaaggaagcgatccagaacaacatccaccatgaacaatacagagcgacaatacccgtggaatcacgcacacacggcagctacaaagcgaagcacgacacctcacaccatcacagaccaccgaacctggaaagaacacatccacacagaacaccaccaccacacacaaaacacaacaacggaagataagagatgtacagaaggagaggagaacgagcgaggccatcgccacaagacgccgcgagcataccggatgagaatagaagaagagacgaaaatttagaaacgactcagacgacacaacgagagatatacacactagaccgtaagtcaagaatagagaagaagaccaccgaccgacgaagtagagagcgtacagggcacggtaggcgatgatgtcgtgggcgaagcggaaccgacaacgctggcgaaggaagagtgaggagaacagagcagtgtaagtgtgatgaagcgacgagcgaggaggcgagagggagggagggaacaaaacggcacgcggacaaacgagagggcggaggaacgacgcaccaaagagagccgggacagaagataagaatggaaggacacggacgcggcattgaaaggctgtaagcgatagagagcgtaagcagcacgcgacacgataggacaaaggcaagaaagtgcaaggagaaagcaagagataagacgagaggagcagagcagaaggcagcgaggcagcgaagaatgctaggacggagggtgagagaagcagaagcagcgacacacagacacagcaaggagcagcgaggacgtacacagatggcagcggaacaagcgacgcagacaacagacgagagagagacagtagaaagcgaacgcaacgaaagagaaagaagaagcagagacgaacgttcgaacgaactacatcaggactcgccacagaaacatagaaatctgtgcatagacaaagcacacaaaagatgagcacataaaataacgaagagtgacgcagacatgacacaaataaatcgaaccgcagaacaagacagtaaaatagacatccacaataacactacgcagccgaagactagcagaaatcagacgaaagacaatcgagagacgatgacaaaacactgaagagtaagaagagacgacgtgcatgatcactagaagagacacgagaagctccagacgaacaacgacgaaggagcacaagaagaaacgaaacacggattgcaacagacatcaactagtcaaagacagacggagcacagaccacgagcgatgcaagtcaagaaagtgatcaggacgaaggagagcaccagcagccgacgacagaacacagcatcactcagatcgtgagca

SEQ ID NO: 690488 - DNA, 906 bp, Homo sapiens
agcgagttgggtgctgcttgcagtgctgcgccaccgtggatgacaggtgcggttggcgggcagcgtggtgagggggtgcgtggggactcgacgtggcggccgcggggccccgtgtacaagggtctcggagagctgcagtccttcgcagcggccgagccactctccaggaggtccggggcgactggcgtcccacccacgtgtacaaggagccgcggaggactgctaagcaagcgactcacagagaagaaacgagcgcgcatggtgagtcgtgaatgccaggaatacgttaccctagtcctatgacgtgttcggttgaatgatgcacgaagtgccgaggaacgacgcgtagctgtcatgcgcaggtctgagcagtgtgtgtgagagcacgagagagcacaaaacgtgacggaaggggacatgactctttccatcgcaagcgatggtagcaagcggcaggacatgagggaagtctataagcaacggtgtgtcaactcatttttgtgtgacgtgctggctttacgtgcgtagtccatagggtcaaatagtttttactgtgactaagatcctgaggataaaaccggaatcttcctcagtgcacgtattggactgtgcgtcgtaggctcccttaacgagcgtcttaagaacttagacgcgtcacagttttccttcgtgagatgcccttcatcttcaaatcgtataaccaggagaagcccaggaccttatgggcattattcgcttgtttctccgttttgctagcattacataggggagtgccctcattcgttcgacaagtggcgctacccttcattgctgttatcgcccctaggacacaaggtaatggctggaggacctccagtgtgccgcgatgccatgagccccaagaaacgacagataagggaagacgta

SEQ ID NO: 690489 - DNA, 239 bp, Homo sapiens
gttgaccagagaatgagcgctagtgaaaactgtcattcatcttgaaagtaatatcattccctccagacagcttccgttgaccccagttacatctaaggcatagaataacggtggtttcactagttataaactaccagagtagaatgtagtgtctccgatggtggttgacagccacacgcatataaccattgattacaatctaagtggtctattaggcaactggctactgccaacatctg

SEQ ID NO: 690490 - DNA, 869 bp, Homo sapiens
gggatcatggtcctgatgaagcatctgaagcgggtggcagctcccaactattggatgctgaatctgtcgaccgtggtgtcggctcctcgtgcatccaccggtccccgctggtggaggacagtgtctccccctcatcgttgtacctgagtgcccagagcttaggtgctgccctgacgggatatgctgtaggagaatatttcgcagtgctgcggtctcgataaagatcgagtggccaggtcctgacattgctgtacacctaccctgctgggtccatgggatgtcatcaggcatagagcaagacgggggacaaatgtccgtcttgctctatgcatgaccaagggtcgcttgagctgtacagtcgtagttacagcgcttgagggaggccaaacttaccgggttgtgcaagatgtgatgaaaacggactcttatgtgcgggacacaaacacggagatcccctcgatactggtggactgcaatgatgccctgcgacgcgagtccgggtaggcccgaatcccgctcatctacggtgaatgagtagccattcatgagttgcttttggagatcttggcaagaattactgctttcactcaagtacgcacgactggttaacctgtgtgtggtgacctgggggctgctaccctaggaaagaattggtgttgatcaccaagcggagcagaggcccctggatcttagacgtgcacacgtgagaggatgcccaatggcaacagctttggcactcgaggtttccgacatttgtgtctattgggccgcggtaaaccctgggatttctcttccccgaggaaagggggtccggcgtgcccttgtggggggaaacaaacacttggcgggcccccagcacggggtgaacg

SEQ ID NO: 690491 - DNA, 944 bp, Homo sapiens
  misc_feature (705)..(705): n is a, c, g, or t
  misc_feature (709)..(709): n is a, c, g, or t
  misc_feature (717)..(717): n is a, c, g, or t
  misc_feature (723)..(723): n is a, c, g, or t
  misc_feature (742)..(742): n is a, c, g, or t
agtaatgctaaagttctcgaaggcccatagtttctatcagttaactcttaagaagaagtcatcttctgtgtttttaatatatccatccaagttcagttcccatgactaaaagtcccttttgcaataaagttggatgaattttataacagtcagctccatcgtcttcttcaattgaaattaagttatttatcacctgtcggtgtgtggcttgattaggtcaatgaaaataggcaggctttttctgctgcaagcaaaatacatttcccacctgagagttaaatgttatgcaaaattataagaccctggtgtcctatgcgcataatttctattcttgagatttctctcttgtcacctcagtgacaagattgttactaataaaactaaaaggaacagaaaaactcaatgaaaagttgactggaaccttgtggtcatgtgcttggtgctttagattaaaggtggactggatcaaatcagaaaaaccttaagctcaactatgattattgaggaattcagcatttatgtccaagaagagttaagtatgagtcacataacattttccccaccactagcaataggccctgcaatcagtcagaacaatgtaggtgatcgtcttctggcatttgatacttgctggatttttcttctaggtattgctgcaggtttgatacttcttaccttcttgattgtcattaccttatacgtganatcnaaacacanagaacngtaagttcaaaggcgaatncttgattgaccaacatgcacaagtggtttcggcttcttgtctgaaactaaacacagaagcacaagttatgtgaaataaatactgcaatgtgataactaaatgaagtatctcgtgctatacaaaaggaagccctttctgtaggacttaagagatatcaaacacttagcttattttattgaatgatgtttattcagatagtata

SEQ ID NO: 690492 - DNA, 239 bp, Homo sapiens
agcttaaggcaggtgtactcaggtagagactgttgttgtctccccttactttctcctacaagaatggagtctctctctgtgataagctgcctggaatcagggaaggggtgacatgagcacccctgtgggccaccaccactgggcactgcgctgtggtcagacctgcaaggcagcacaacactagggtctttgcccaaggtcctgccactagccagctgccatggctacgtgcttacagt

SEQ ID NO: 690493 - DNA, 85 bp, Homo sapiens
gagcggagcatgactagcatcggagcagctctgcgactggtggcggcggtgcgtcgtgtgcacgcttgcgccatctgtcaggagc

SEQ ID NO: 690494 - DNA, 425 bp, Homo sapiens
ggtttatgaaaaggtgctcaatatcattgattatcagagaaatgcagaatcaaaactacaataagatagcatctcaccccagttaaaatggctgttatccataagacaggcaataacaaatgctggcaaggatttggataaaacactgttggtgagaatgtaaattagtgcagtcactatggaggacagttttggagattcctcaagaaactaaaaatagagctactatatgatccagcagtcccactgttgggtatttacccaaaagaaaggaaatcagtatatcaaagagatctgcactcccatgtttatcgcagcactattctcagtagccaagatttggaagcagcctaagtgtccatcaccagataatgaaaaaaatccgcccatacacgcaatggagtgcttaaaaagccataaaaaaa

SEQ ID NO: 690495 - DNA, 1551 bp, Homo sapiens
ctgatgttgtttctgggtgccgggttccgggcttgtggttccgtgggtattgtctgtccattgttctggtccgtgtgagtcttcttgcctgtgggctgtgtctggggtgttctgccttgtcatggttttggtcaggtcttctagtgcgtggtactactgtattgttgtcgatctagtctatttgttggctctgtggtgtgttgtcctcgcttgtattgtatttctctttgtgttgttcaatgtgtgtgaaagatgttctgttggatcccctctttgactgtgcgcggattgatggtgtctcgtctgtagatggttggctgatgattgcttgttggggatctggtgatgtcccggggtccatttttgggatgttctgggttcctttgcctggtgagttggcgtttgtgttcctttcccatcttgtatttccttgggcttggtcctgtgtggtggtaccgcatgtgtattatgtaattgtctgcctctttggccgtggggtatgtaccaggttcctgaattgtcccggtatgaagagtggtttgctcttttgacgcggggttcgatcgtgtgccctatgggttatattatgcctttgcgttgtggttgtggttgtgtattattctatgatctccctgtgtttttcgcatgtctttgatgctgtgtcgcggtgtgcttgtcgatggtcctgttggttggtatgggttgtgtttgggatgtgttcgatggtcctttctagtctggttggggggtgtatccgttgatcttatatggtgttttggtggtccctggatttcgtatggttatatacgtgacctggaaacgacatgtgtggagctcctgtgtctgtactcactatgatcggaataactgtgataagtatattgatgtgtctgtgcttggcaaactttgagtcgctggatactccacagatgtctaagtgtatattgtaccaatgggattcttattattagagcatatggatggggtcgattaggattgatataatgttatttatggttgccttaatatgactctatttctgcttcgatttgtagagagagacctaatgtgtttatgagaatgtggctgtcgtgtgcttggtttgaatgtgtgcactatgcttgatgctgtatggagttgcctgagtactgttgattatgttttatacctgtggttgactatgaagctgatgtttatagactactgtgtggttgtttaagatgatggatctgtaactactttaaatcctatatgttagtgatggtgctagccttgtgacatgaatcgataaatgtgactgatttgatttgacaatactgattgcttgaaaagcatgtatgaacatgtatgaactggattggttggcttatgtgttgctgagcaatgagaagctcaggtgcaccttgcgaatgtaattaagctgactaaatgaataatgacttaattacctcataggtttggcatgtacagatgcttatagagggtgcagaacgaaccagctcgaaaacgagtagcagtgtaatgaaggcttcttttaacactatgagcaat

SEQ ID NO: 690496 - DNA, 297 bp, Homo sapiens
ttgaggacccccgtaatatgtacaaaaggattatacaattcattataaggtagaatcagtgggagccctgagcttgttttccctgcaactagacagtcccatgtgggggtgatgggagacagtgaccgatcatcaggcattagattctcataaggagtgcgcaacctagatccctcacacatgcagttcacaatagggttcttgctcctatgagaatctaatgccactgctgatctgacaggaggttgagctcaggtggtaatgtatgtgagcgatggggagcagctgtcaatacag

SEQ ID NO: 690497 - DNA, 910 bp, Homo sapiens
ctgcggtgtggttatgctcctgttgaatttttcctcgaagggacgaggagccgagtctgccaagaccctgactcctaagttggtctcctggaatattgtgatggaaccattttttaaaagagaagtcttcgatacctacttgtcccaattagcatcagttatgataaaatatggaagagagtctttatgcatatgagatcctcggagttcctaagccgaaggagtccaccactggattgtgaaagctagacggattctctctgagaacttggaagcatccatgtgtacttcggagaccctgtatcactgcgttctctagctgcagggcggctcaatcggaacacgtataacttggtgccaagatgcatccctcagaagcagcctgaggacgtgcaagcctttgtcactgaggtcgcctataagatgcagcttctgcagattgaaaacctggctctgagcccatggctcctggtggtcaccattctacttcaaaaccagctatccatggactttgacgccctggtggagaagactctgtggctgaagggcgtaacccaggtgttcggcgggttctgctttggctgataacaaacttcctgaggaagtggtccagtccagcatcctcctgcactctaacctggcagctgtgtcaaagaccaggggttctgaaaatgactcctggaagctcacagtggtcacgggcttgtgccgaaatatcgcctcctcatgtgttctgactacggaaccagtgctccacatttgcccgcctcctagcgcctggtttgcgatgaaccggtccggaagaggggttcagggatcttccccgaggttagagggatcacttctccaggaaacaccaggagggggagggccgcgggtagcggcgaaggggagaacccacagagagggg

SEQ ID NO: 690498 - DNA, 1017 bp, Homo sapiens
acccttgcattggcgtcaatatcaggctaggcatggtgcacactatgtctctaggaagatgatcatatggctcggagtcacggatcgaccagacgatcctaaggaggacataagcctatcgttctgcactccttggtattccttcggagtaaatggcttcactacctactgccttgctccagtggtagaagagggcctttattgcagttgggcaaggctgtgttggctgactgcagaaggatgggtgtgggatcattagcctagtagggctcgaaggctccgaatgggttgatgagtcggctgataccagggattgggtgggtcgccaattgcgaaatccaagaacagacttagggcatatgtgcggtcaccggaatcctgtaccaatatagtggggtcccacttggaaggttcgaacgtttagtagaagtgcggcttcaccattgacagtgactggttgtaagggcttaaaaatgcaagaggagctggattgcttggacgagaatcaatcgccggacatctggtgagtttggcgcttgtgtcatcggcaaatctaagatcacagctagtgcgggcgaagtacgtgggatttcggatgcctgagtgtggggctgctgccttgcaattcagaccgtggccgactatgaaggaagtaaggctataggccactcgtggccggggtttgcctgcgtcggactcctgaggggcagtgtcaggctttggtggcagactgtagggatacacgtttgagactgcgttctggttatgaagctgtaaagctggaccattgaggcgttgagggggcggagctggtgcatggctgattcggatcctgggtagtccatgtagtgtgggagcccgagccgggtagtcaacctttgagaaccctgttggcgggagtagagacaaacaagtgcggtggggcccccaaccaaggatcattgttgggtggccgagggcagattagcccactcacgctacgggaaatctaatcggccactaaaagggcaaaaattg

SEQ ID NO: 690499 - DNA, 582 bp, Homo sapiens
tgtgggctgacactaccgactaagggtgctctggatcacatacatgtcaggacgctcacaatgctgctaataaaggactatggccgatgatacgacaagacctccccatgttcccgcaatgtacatatctcattcgtgaatccctatccacctatgtcattttcttactacagtcggaattctaaggtctatttgggtacagccattagctctctttccccgttctccagtaccgtttcctggcctcgggtagccaccattggttcactacttccatgagatcagtttcgtcagatacgagtgagaacataggatatttgctctgtgcctggcttattattgctaaatataatgtcctccggttccatctatgttgccgtctgcaagaggatttcattatgttgtatggctgaataatattccattgtgtatatataccacttttaaaaaatccattcatctgttgctggacacttagctagatttcttgtataggctattgttaatagggctgcagcaaacattggagcacaaatacctcttcggaatacgattttcttcttcgggattatactcggaacc

SEQ ID NO: 690500 - DNA, 334 bp, Homo sapiens
aagttcaaacaaatgcaaaagcccatagcccccaccccccatcaggcccttgctgggctgggcctgaaatgcaggtaaaactgtttccagtcccgggcctgaaatcaaccctcatcaccgatgggtcccctcccatcaaccttttcaacacagcctttgggttgttggggatggggcccaagggtcagcccctgggcaaaagggtggccagtgggcccacccctggggaggggatatccccccagtttgttcaggccccccaagctcctggaaacaaccccgtggggcctgttctgcgctaactcctgattaaaacaatggaagtttttgggca

SEQ ID NO: 690501 - DNA, 564 bp, Homo sapiens
  misc_feature (431)..(431): n is a, c, g, or t
  misc_feature (477)..(477): n is a, c, g, or t
  misc_feature (513)..(513): n is a, c, g, or t
cgactctttaggatcccctgcctgctgtcgctatttgccctcccccagatcctgagcctccatgagccttcattcccgatgacagcttcctggtaccttggaccaggcacgccccttcccctttgagggtcccgggctcttcaaggtcagatggtgagcagggtccagtgggatttaaggtgtatgtcttgaagcaccggacatttctctggctcccaggctctcctgggccctgcggcctgctctaggtgacatgttcccagctcctgggtcttggtgtagacatggtcctgagggaatgagcagtgtatcttgtagactgaatgttcacttcccagctctggcatctcctctccactccttctttccacactccacctccagggccaacaataggccccttcagctctggactcttgcgtagggcttgngggtggggtatggcctgagctggcagcaggcaggatgacgagccgngcagcctctgcccagccctggaagagctctctctgngagtggctagctgctgggagctagaccacatccttccctctggcccccgtg

SEQ ID NO: 690502 - DNA, 299 bp, Homo sapiens
  misc_feature (144)..(144): n is a, c, g, or t
atccgcttatcgacggtttctcccacatcgacctggttgtcacggaaagtgtactgagttttacccgaaagctaatatctgttgcctaccatgacagcatcatgaaccctgactataatgtggaatttttccgacagtttatanctggttatgaactgctttaggataaacagagctgcccgaaacccatgttaatacgaatgtgcctggcagcttgactgttcctcttatttgaaagctggaaccagctggcgtatctttggaccaagtaacataactatcaacacagggctgtgacc

SEQ ID NO: 690503 - DNA, 205 bp, Homo sapiens
gggggggggggaaaaataaaaaaaaaaccccccttccccgcccggggggttttttccccttttttttttggggttttttcccccgggggggggttttttttccccggggggggggggggatttttggggtttttttttttttggggggttttttttggtgggggggggggggtggggggccccttttttttttttttttgggcca

SEQ ID NO: 690504 - DNA, 415 bp, Homo sapiens
cgcaaagccactgtatctgatggcatgatggacaaaatctatttggttcctgcactggtcaaatacattagagaaatgtgcttactggattaatttattgtgtggtttaaactgggcactttaaattaacactaagctatgaaacccaagagaaggggtagattcttctctttcaacaagataacagaaacaacaactggcagttatcacaccgttttaaaccatatgagaagagggccagcgtgcgagtggctcaacgcctgtagatcccagacactttggcgaagctgaacgcgaggtggatcacattgaggtcagggagttcgacgaccaagcctggcccaacatggcaataatcccaccgtctactaaagaatacaaaacattagcgtgcatgtggtggcagagcgcctga

SEQ ID NO: 690505 - DNA, 262 bp, Homo sapiens
  misc_feature (29)..(29): n is a, c, g, or t
  misc_feature (31)..(31): n is a, c, g, or t
  misc_feature (37)..(37): n is a, c, g, or t
  misc_feature (63)..(63): n is a, c, g, or t
  misc_feature (108)..(108): n is a, c, g, or t
  misc_feature (144)..(144): n is a, c, g, or t
  misc_feature (251)..(251): n is a, c, g, or t
tgacattagcatcgggcagacccgccagnanacgggngtcgccaggttcccgtctgctttcgnaggcggatcgagcgggtgacttttgtgcattcgttttaatttttngaaatctctcttttttcctccctcagctcgctgccnggcatgtcctgatctggcggccgctcctaccaccctgggcagccgagcagagtcgtccccagctgtctccctccctgcctccctgactttgcaacaccgcgttccgnggagaccggcc

SEQ ID NO: 690506 - DNA, 351 bp, Homo sapiens
ccaccaagaaaaaaccctgtagatataatgtgttccaatatgtgatatgtgggtaagccatatgcctttgaattcagtcaacccaggctttaatgtctggctttgtgaatatataagctttatattgtgctgcctacttaacttctttaagtccaccatttggtatttacaaactcgtgtgtcacatatttgttctcaatcgctgaacccatatcatatagtgaaaaatgcatataaagaatgaccataaaacacagatgtatatgtcacgagaatacacatgtggtgtaatcttgagatattattatgcgtggtctgagatctgagcaaagagtacacagatatgcagcg

SEQ ID NO: 690507 - DNA, 768 bp, Homo sapiens
tatctattatgatatgtttatttaaagttcaaaaactggccgaactaaaatctacttgtttgggaacacccctgaatgtgatgaaagtatacagaaaagcaaaaaagtttatttaaataaaagtcaagatgggggttacctcttagggtgggggctataagttgagaaaggacggcacaagatagagaaggttcttacgtggtcaggtgtcccatttctggattggggtggatacaaggtgtgtttataactcatctctttaaacaactacaaagtggtttgggcccattttctctataatttatatttaaaataaaagtgttaaaaagaacagaatacacatccagggtatataggtggctaaaggggcatcccatatcgtgcaacttaccactctcaaagtgggtttcaggaaaaaaactactcattatttcatataacaaaattagcaaagaggaacgaaaaacacgaagaggaaacaacagaagaggcatactccaatgtagaatatttcaatctccttttatggccagaataatacgacaattttggtgcgctgcaagaggcagtaagtaacctacaggaagctatgaaaaggtgtcggttgttgggaaaacgccacaggcctgagattcatctagtctccttcgtgtagcccagaggagggcagcaagaagggggtggtgtctccaacccccaagcttctgaggaaaaaacgggggcccttctcatttcacccctccctttttcccttgccccaaggaattg

SEQ ID NO: 690508 - DNA, 469 bp, Homo sapiens
ggacggacatacactacgtagattataggaacccccagacgtagccgagcccgacacccgtaaagggtctgtgctgaggtggattagtcaaagaggaaagcctcttgcagtaagagagagaggaaggcccctgtctcctgcccgcccctaggaaatgaatgtctcggtataaaacccgattgtacatttgttcaattctgagatgggggaaaaaccgccctatggtgggaggcgagacaagtttgcagcaatgctagctatgtaatactataatccactagagatgtcagggtaggagagaaacctaaatctggctaatgtgcatatccaatcatagtaccttcccttgaacttcattatgacatagattctattgctcacatctacgtagctgaccttctaccttattatcaccctggcctcctaactacattcgtttttgctaaaatactacaaatacataatcagt

SEQ ID NO: 690509 - DNA, 545 bp, Homo sapiens
  misc_feature (56)..(56): n is a, c, g, or t
  misc_feature (178)..(178): n is a, c, g, or t
  misc_feature (185)..(185): n is a, c, g, or t
tccgtatctgtcccaacacaatacagttctgtcttcttttaaaacgttgctgctanctctccattttggaagccagggcatgactgctggtgggtggtgacaggcacacaggcggcaagccatctttggccaaaggaggtggaggaccagtccctgcacattctcaatccacagacanccacagncagcctttacttttggctcccactagagggtagtggggcaagaacaggtggtcccacatggctgggcaattcagcacttctggcgttcccacctggactaactctattaccttctccaattaaaaggaaagtctcactttgggcgggaaaccactattacataagggatggacactacacatttagaatgtggacacttggttagggcagtggaactaataaagatagcagccagttttcttccttgccttctcctgaaggtaatcctccctcttactgactgaagctctggttccagctctgctcatgggcaatgcctggctttacagttataaaggctgtctatggacagctgctgac

SEQ ID NO: 690510 - DNA, 116 bp, Homo sapiens
agtagtcaccgaaagttatgtttctttgcttacttcatttttttctctaatctagactggaacaaaagtataaacattatttatttcaggtagcatttttttcgtgtagttttttt

SEQ ID NO: 690511 - DNA, 522 bp, Homo sapiens
ttcaattttacacctgtcttgaagcttttgagggcagactgccaagatcctggagaaatagtagatggcaagtatgtgggtttttgtatttacacacgaattggaggaaaaccaaatgaatttgatagccaagtggagacaagtctcagcaagtctgtaagcagtaggtatgttaagtgggggtcatgaagtatttcagtttggtgaatagatgaccggtttatacttcctcacccggaattcgtttggtaagtgtagaaatggaactcaaggtgaagaacttcaatgaagcgcgggtaacgggcgggagtacctatgactctctgagggtagccaaatgcctcgtcgtctaataagtagcgcgcatgattgggtgaccgagattcccatggtccctacctactatccagtgaaaccacagccaagggaacgggctgggaggaatcagcgcggacagaagacccggtggaagctagaatctagtcgggaacggtgaagagacatgagaggtgtagaaatgga

SEQ ID NO: 690512 - DNA, 952 bp, Homo sapiens
  misc_feature (684)..(684): n is a, c, g, or t
gggaccttccacatagtttatgcagtggtgcgggaccagctggtcccgctactctgggcctgaagcccacttgctctggagctcttccgaaactcaaggcgaatgcgctcacttatcgggagttgctcggtctgacggcagactgcacggacgtgcaccaggagggcacacttggctccccctatattggagctacggggagaagctgaagccagagctcatgggcctgatccgccagcagcggcttgctccgtcctctgtgtaggggatcgactcttctcgcaagatcacgcaggccgacggcgaccaggataagctagtcggttcatgctgcactgtccaccctaaccacaacgctgctgctagtcacggagacaatggtacgagaaggtgctgccaggccacgcccttaccctgggagagtactgcgcctgagcaaactgccctcgtcggccgtacaagtgagcggcacttctctgactaggctaagtgactcgctcctccatagtcacgggtagaagggcatccgggaagcagaacaaggaccttctatgagttggccattcatcaatcagctatgaccgtggggaggaggaagcgtacctctaacttcattgccccactcacaagcgggtagttcatacctgtggacagactgggctctacgtgcacattagtctgggncagtgcccatgagggcagcagagcagacacggttgtgacctggagcagcgtgtctgatcacaatggagatccaagctgcgatctgctggagtctggagaacgtgcccatcctccgagtcggcgcaccccctgtgcccccaccctctccaccaacttcaacttctgctatgactgcagcatcgctggacttgacagtgtggctggccatgggctacagctgcggccactgcagcagtccatgaagttacgtcgcgggggaggagtgaca

SEQ ID NO: 690513 - DNA, 611 bp, Homo sapiens
gggggtaggaagtggtcccgggagatcttggatggaaaagtcaggaggatagacagcgagacttgcagaataacatagagaaattaggaaccaccacaaattgcatgtcaagttgatctattccccctcttgttatctatgtgggcatttttcctttgacttgagatgattggtgctcgttgacgcccgtacgattagcttgaagggagctgcaaaagaacgcaaaattaagcacccccccccagaggggaagaccggagggggcagagcgagggtgcacaatacgagcagaaaatcgtcggaaaaagaacgacgcgcggggagaaccacacagaggtccggagcacgccgcggcacagatttcacgcagccgcgtggagggggcactagagggatcttacaaaaggccgcccagcgggagcggaacctgggggcgagagcagtattaaggcgcggggagggaaaccccacgacagggggcgaggaggaatggagggcacacaaggagaccacccagtggtgagcaaaaggggcacccaaaggtgcgaagagggggaaaacagggcacaaggggggcaggaaaaggggggaaacaagagggaagcaggagt

SEQ ID NO: 690514 - DNA, 117 bp, Homo sapiens
  misc_feature (5)..(5): n is a, c, g, or t
  misc_feature (73)..(73): n is a, c, g, or t
  misc_feature (95)..(95): n is a, c, g, or t
ggggngggggtccccgggccctttttccccccccccttttttttttgttgaatggggcccccacgggggggantgctttttaaaattgcccccangggtttttaaaaaaaattttta

SEQ ID NO: 690515 - DNA, 465 bp, Homo sapiens
  misc_feature (6)..(6): n is a, c, g, or t
  misc_feature (15)..(15): n is a, c, g, or t
  misc_feature (31)..(31): n is a, c, g, or t
  misc_feature (40)..(40): n is a, c, g, or t
  misc_feature (101)..(101): n is a, c, g, or t
  misc_feature (124)..(124): n is a, c, g, or t
  misc_feature (166)..(166): n is a, c, g, or t
  misc_feature (188)..(188): n is a, c, g, or t
  misc_feature (294)..(294): n is a, c, g, or t
  misc_feature (434)..(434): n is a, c, g, or t
aacccncgaggcccngcattttaatgtcctngttttcaantttatggcccccctaaaataccccctaggtgatggatattaaggtataggtatattatccncctgaatatcctcacctggcccngttagccctcagaatcctaagccttcaaaataatttaccatngcaacctaaccctaacccctcngttatcatgataaaaaataatttgtccttaaaaattcaagaacagtacaaagcaaagcagaacaaacccagaaacaaaatttcagcatagaaaacaacaagaaaantccatttggaacccaaagggggcagggaatggtgtctcacgcctgtaatcccagcactttgggaggctgaagtgggaagatcgcttgagcctgggaggtttgagactgtggtgaaccatgatcgtggcactgcactccancctgggccactgagcaagaccctgtctctga

SEQ ID NO: 690516 - DNA, 466 bp, Homo sapiens
gagttgattagaggatccgggtaggactcacaagcgggttaatcacgtcctcgggggctaatacacatccctttctccccacactctgtgggtcagaagtcactgctgggcgccctgctacctttccttctcctacaccacaggaggaggaggcacagcagtcccaaaatgacagtttggagcacagcgacagccaatgcaaccctgagggcagtgtccagacttaggtgccatgattctgagtgcccttggctttctgtgaccctgaggccggctatgggggttgtgcggctggccctccagggggtgggtggttgtgacagccggggtgatggtgagttggcgccccttgatggactgcaattggtgcctccctgatctcggggtgtccagctcgactcggcagaaatacacggaggggtcctccttcggcgggttggagatcctgaggaagccgctctccgga

SEQ ID NO: 690517 - DNA, 368 bp, Homo sapiens
  misc_feature (6)..(6): n is a, c, g, or t
  misc_feature (54)..(54): n is a, c, g, or t
  misc_feature (84)..(84): n is a, c, g, or t
ggaganttgtgggaagtgggttggagggaggttaggttggtagtgggaggtttngggagaaatggagagaggttagtggagggntggttttagttgcggttctttggtgggtgcctggtttggtaattgctagagtagggaggggggagggaaggggattattttaattagagtgggttagtttagattggtagctgctgaaacttttgttgagttaggagtgggtaaaaggtaggtggggtggggagtggggccccggggtggggcctgggcctttgcgtgcaaaccccagcctccctcttcttcctcaggctttggagcccctgagtttgagttcaataaaaactttatgtggtaaaaaaaaaaaa

SEQ ID NO: 690518 - DNA, 190 bp, Homo sapiens
gttgcgaatgagtgtgagggtatataccatagacgctagtttaagagtacagcggcaagtactattgaccctgctatggtggcttcgacatgggctttaggtgagtcataagtggagtccgccaagaggtcgtctcttactatcaaagctatagtgtaagctctgtcatacggggcatctctagagtcga

SEQ ID NO: 690519 - DNA, 160 bp, Homo sapiens
tgagaaatcataagcaccctgaaagcagcatatctaaatcagtaggaaccgcagttagacactttatgcaatagacctcaattctgcggatattggagttaaaaggatcgcactggtataccagaattgataggtcgactttatggggacttataggtaa

SEQ ID NO: 690520 - DNA, 306 bp, Homo sapiens
ttaaagttatcattttacttattgtatcagtaactggcccaacccaagattcagaaacaagacaataactgtaactacacaagggccatcgttgtgagagaaaacaaaacaatccacgaaactgagccgttgggtagaactctaagactgaatgccatacatcaaaccatgaagaacaaaaaccagccaagaaagctgcagaaggacaaaaagagcagacggcaacgctcatgagcacaagtccgggcgcacagttctgcacctggctggggagcacgacaacatctcattggcaggctgcctgct

SEQ ID NO: 690521 - DNA, 141 bp, Homo sapiens
agtcacttgtgagcagcttccactcaatcaatgcccatttctgcaagcacatggccaggttccagcaatccaatcaaactggcaagcaatatgttccagcagccatcttattttcagcacagtgcatgcacattgcattct

SEQ ID NO: 690522 - DNA, 853 bp, Homo sapiens
  misc_feature (136)..(136): n is a, c, g, or t
  misc_feature (269)..(270): n is a, c, g, or t
  misc_feature (327)..(328): n is a, c, g, or t
  misc_feature (337)..(338): n is a, c, g, or t
  misc_feature (481)..(481): n is a, c, g, or t
  misc_feature (491)..(491): n is a, c, g, or t
aggctgcgagcgtcccgccctcagagagcagcctcccgagacagagcctcagcctgcctggaagatgcctgagatctgtgctgcagccgctctgggggccctgtttgcttgtgccttgcttgcttcagtgcctccnatggacagtgctgtgtgctgtgtgcctggatgatgcagccatgtgtcatggaccctcaccacgtgaaatgcaacccctgctggatgtgcatcctgggccctgcaatgccccgaccctctctggcctgatgacnntcccatgttccctgtgtgaactgtgcgggacgagcatgccctcttgaccctgagaanncccccggannagtacgtcatggtgcccacttcctgctggtgacctgattcgtgccgcctgcaacatgcatgcagtagctggcagcaggcggcgcaggtgcagaagcgcgagtgacgtctcagctgggcgaaagacttgcggccctgctgcctngagtggcggnccctgagccccgtcagctgatggtgccaagccgggcccgcgcgagggcaagcgctcctactccatggagcacttccgctggggcaagccggtgggcaagaagcggcgcccagtgaaggtgtatcctaacggcgccgatgacgagtcgggcgagggcttccccctggagttccagagggagctgactggcagcgatccgggagggaaatgccccgagggcctgtgataagggccggggccagccgactgagcaagctgctgtgcggcaaaaagagaggccccagatggcatcgtggggccgccagaaaacagggcggacccacgacccctccgcgcaagcccagcccgggcggcgcgcccccc

SEQ ID NO: 690523 - DNA, 1219 bp, Homo sapiens
taaaatggggtaaaaagggcttaatttggcaggggagcaggaatttaatcaaaaaggccaaatcccaggtcatctcattcttgagctctctttacagactctccctcctttctttcttcattcttttctttctctccctctgtgctgcagcatgggcgcaagaaccagcagcaggggctgaaaaagccgtggggcagcaaaagacggtatacagccccaccagcaggttaccctgggcaaggcttgtgccaatataccctgtgggcaaattgagggtcttctcaagggtttttccccatttcagcttcactgtgaataaccttgtgttggagccgggatcgagtcgaccggcctttcgaatccccaagagcgtgtttcccaagaactcttcttgggagtgctcctgtggggcagtggggagaggagttttgccccctatagggacagcccagacgaggtctagagagggcagacgtataggcgacattcggggaaggacatatctgagggggggggggaaaaaaatgttctcaagcgtgcttttgaccagaacctcttcgagtgggggggggtgtagaacacccctattttggcagaactgttgtccaaaaggcccaaaatattctccaagacacagggggatggtgtattcccccaaacttgtggaacacaaaacgaggctgttcttgggaataaattgtggggccgggggcaaaaaccagatctcttgggaagaaagatggacgcgcgaaaaaattcccttcttaaagagaaatctttaccaaacttatccccaagaaagaaggagttttcaccaaccctgtggacaacctccgtcgtgttgatttgtgcccctctgacgaaagtgttaggaccaataaattgggaggaccatatcttctcgcgcgagatagttttttggcccccaagtaatttaacacactgtgtgggaacagagtgtattactatctggccccgacaatgtgctatatagcgcgccgtttaaaaactcttctggggtctgtccaatttgggcccgaaagacacaaatcggttgtggttcccccccacaaaatactcgttggtccccgagaaagaaggtccaacctaagggggggctcacttcccattgagagaggaagacttcttgttccaggccccgtgtggcccgtgggagccccaaaaaaaagttgtcccccctcaattgacgggcggcccc

SEQ ID NO: 690524 - DNA, 971 bp, Homo sapiens
cgctcgggcagctgccaccgccacgagagcccgggacgcgggaaagaccgaaaggaagaggaagaggcaccggtggccatggggctggatggcggcgctgctgagctggatgtgcgcggcgctgggcacagctgctgcgggatccgcgtggatggcgtgaactgcactgctgctgctggacttgcctgccccttcctgtgccttctgcctgtgcgccactgtgcagctgcctgcgcggccatgtgcctttggaacgcgcttgcttgcgggcgtccggcgcggcggctgggctcctcctgcccggcactgtatctcggacctttgcgcattgcattgcgcactgatcctagcggctgcttgcgtggactgctgctcagggttccggctgtgtggggatgcttgtgttgcttgtgtgccgcggtggggttgctcttggagaccggaagggtggcccagggtgcccgtccagggttgggctggtgaagccttcacgtgtgcgcgctgatctaaggccccggggactttcattgttgcttgcgttgggcgccggcagcttggcttgccagcggaagaatctcctggcgctggtgggggccccctaacttgccctgttggtacctttcgcttgctgaggggttgagggcaaaatgctctgggtggcctgcgctcgtttggtcgcactccgtgtcgcgctcagagacccgtggaagttccgcgataggccgccccctgggggctttatatcccccccgttagccttttggaaattcgtggtttggccctttcagtttatacgctccgcctttttcccccttttttgggccaaagcggtggaaaccgtgggctcttttacccagaatccgagggggacatttttcccccaaaggagggggaccctattcggcattaggtacgccccgtgacgagttcttttggtttggcagttcccttttggcatgtgggctcgcccg

SEQ ID NO: 690525 - DNA, 407 bp, Homo sapiens
ggtgttcccgacgatcactgcatcatagcctgggcatagacgtcgagactatgtctcaaaaaaaaaaactgtgtttggcctacccttaggacagtgtcacaaaccattctgcactagctaattaaagggctatgggggtaggatgaggttaatcaaagggtggacacccatttagccaaggctgagaaatctttggcagttgcttcccttcaaaagggctcaggggccaggcagccacactttggtcacccattgaccaaggaatctccagctgcagaccccagcagcagggccccatttccctcacctgaggttcaaaatgcccccattcacccgctgcctgtgttccctgggctcccgatgcagcccctccacgaggaccacggaggctgctataatggcgtaat

SEQ ID NO: 690526 - DNA, 370 bp, Homo sapiens
cagttcccattaaacagtaactcctcaccctcctctctgtcagtccctggcatctaccattccactttctgtttctaggagtttgactactcttgatgtcatataagtgaaaccacatggtatttgtccctttgtcatggcttatgtcacttaaaataatgtcctcaagattcagccgtgttgtagcaggtatcagaatttccttccttttaaggctgagtattccattgtatgtatacatcacactttgcttatccgttcttctgctgacacttgggctgctctcaccttttggctattgtgactaatgctgctatgaacatgggtatgcaaatattgcttgagagcctggttccatcccccaccctcc

SEQ ID NO: 690527 - DNA, 180 bp, Homo sapiens
  misc_feature (27)..(27): n is a, c, g, or t
agtaggggatcttgcattagggtcagntcctctagtgacgttggcatgatctttgatcatgtacagtatatggagtgagtgttacattaattaataggtttttacaatatatgcctgattttttattttttcttttagagaaacggagatgtcttggctctggtcgacccaatgctggaa

SEQ ID NO: 690528 - DNA, 140 bp, Homo sapiens
gagccttacctggtgacgtgctctatgccagtttgctgatgtctcatcagatactcgataaggctggtgatggtggtgcatgctgtgtcttggtgccagtgactatgaatatggagtagatccagtgctgatcctgagct

SEQ ID NO: 690529 - DNA, 840 bp, Homo sapiens
cctaggtcgggcctgggtgttaatcggccgatggcggcggcgcggtggtcatggctcgggtggcgtgggggctgctgtggttgctgctgggcagcgcctggggctgcagtacgagaagtacagtcttccggggcttcccgcccgaggacctgatgccgctggccgcggtcgtacgggcacgctctggtagcagtacgaggtgagatgatgctgtgcgcgatgatgcgcgctgctacctgtgactgtcggtgctgcggctgcacctggctcctgcgctgacagcgagggtcttctgccatcgctcaatctgcaggctggcccctgctgccctgttgtgccacggcctcgatcccgatggcgtgtctgggcagacgagtgggcctgtgatcttgcgggtcttcggccgcgtcctggaagcgagcgcggcctgcgctgcggctgcgtgcaagcgtgacgcttgcctctgccttccaggtgccctaccctgctcggggccatctgctgagtgacttccatgagccgtcctgccctaccagtagccttgcattactgctgctgttcaccggctaaccgagcttggagaagtgcgtgtgggcgtgggagactacatgttacctcccagaggaacccgaggcactaagcttgacctgccatgttatctcaacctactatcagggggatgctggaacgtcgccgaggattccctcacggacctagatgcccacgcctatgaggcgttgtccccgggctgtgaggctctacaacagcgggattcccggagccggtgcttggcggcttggcgagtccggatttgcggtgctgcgtggagggcctggggct

SEQ ID NO: 690530 - DNA, 275 bp, Homo sapiens
tttttagggaaccaccccccaaatgaatttttttttgggccgtccgggagttaaattaatagggggtttaaaaaaaaccttttgcctggtttagaaggcccactgaaacccgtagcccctgggggggtaaagggagcattttttttttggccaaaccttttatttggttctggatatttttatccgccttaaagaaatggattataactagacatttgctggtttcccccaagttttgttttatttggttcctttttaattaaccccttggggga

SEQ ID NO: 690531 - DNA, 866 bp, Homo sapiens
aacctggttatgatcacgtgttgggcgcgctgggctctgtgagctagagtgcttatgatctcagcccgctccttctcactacctgagtgtgtgccaggtgctctgatgacgatcgtatggacatggcgtgaggccccgtgagtcctgagaaatatcttatgggttgtggactacatggcactggatctgatatcagtgtgacaggtggatactgatgatcatgtgcagcagtgaatctgtaagaacggtcaagtttaggggctggtgcaaaggatgagttgcacattgtgtgaaagcagaggcaatgaattacgaaggcagtccaattaaagtaaccaactggcaatttgaaaatgtcgtgtacagccaaggtttcccttggggggttttgaaataacacaccagtggtcttagggttgaagtgtgtttcaggaccagtgcatattagtgacagcaccttaggtaggctgtggaggaagatgcagagtcagaagatgagaggaggaggatgtgaaactcttaagtatatctggaaagcggtctgccctgaggtgttagcaaggttccacagaaaaaagtaaaacttgctgtgctggaggatgttgacgatgattgatgacgaaggatgatgatgaagattgcttgactttgatgtttggatgatgaggaagtgaagaaaaagcggcagtgaaagatttattaagagatatccagcaaaatgcaaagtctatcagtggaaagagataacatttaacagggacaaggcatacttctagaaggaatttaaacaaagagattgtggaatatagaatgtggattaaaaggtttcaatgagctcaatgtgagtcggcaagcatatttaggag

SEQ ID NO: 690532 - DNA, 1155 bp, Homo sapiens
gtggctgcagagagactaccggccaccgccgccgccgccgacgcgagctgtccctgcggcgcgtctgccttggcggagccgaccgcagtgcgctcaggcgtccgggctggccctgctgcgcttcctggctgctggctgccaactgaccatgccctggcggatcagctggcgcaaggcatggctggctgggaggcacactatttgcgctggcctgccttgcaccccctgcaggctccgtgctctactcacctctttcatgctgccaccaacgcggcggcacgccgctgctcgctacgcccggctcctcgccctggacactgtgatggggtctgccttgctcaacacccttggcggccctgcccatcatccactgcaccctggcctgcaggcccctgcgctgcgccccggctgccctggctgggctacactgcgctgtcgggctgctggccggcctggcgctgctcctcaacgccccctccaacaagctgcactcggcaacacgggacataaggcactgcgccaggccatgatgcccaacactactgactactcgcagcgccccgcgaaacaggaaaaccaaagaacaacagccgacaaaccagcacccccacaccaaaacaaacatacaaactacaaccaccaaccatactacacacaatacaacaattcaaacccacttcacccacacatcgtcacccaccccaaaacaacacataacccacacacacataacaccacaaccaacaacaacatatcccaacccatcaaaaacagtgcgaccctacagagacacacgcacaaagcaacaacccaacagaaaagcagtcagaaacacacacaaccaaggaacaaacagaactacacgcacaagcgcgccacccacccagaacccaagatagcaacccgggcatgacccccacaccaacaccacaaccgaacacataacaccacacaccaacacagccaaagaaccaacaatactaaccaataacacacattttaacccatacttcaaacacaaaacaacaacacaacaaaaaaaaaaagacacactgaccaaccacaaaaaacaaacagcacaacaaaaaaccacaacaacaaacacaaaacaaaaaaacctacaacaactacaaacaaaaacaaacaacaacaaaa

SEQ ID NO: 690533 - DNA, 352 bp, Homo sapiens
ccagattcatttgaattgtaattcccaacgtaggagatggggcctggtgggaaatgattggatcatgggggcagtttttcatgcttttcatgggggcagtttttcatgctttacaaccatcccccttggagctatcgtcctgaaagtgagttttcacatgatcgggttatttaaaaggttggggcaccctttttgcttttttggtccggctcctgccatggaaaacaccggctcccgctttgctgtcccccatgattgtgtgtttcctaaggcctcccccagaagcagaagttgttatgcttcctgtacagcctgcagaaccatgagccaattaaacctgttttaaaatcca

SEQ ID NO: 690534 - DNA, 201 bp, Homo sapiens
gagtagtggtagcccggagcccaccaccccaggagaccaaagccgcatacatctcacgtgggggacaacaaagggggcagggggggcacgaaggctcatcatgcaaaataaaacaaaataacaaaagtattaaggcgaagattaaaacaatttagcattacataatttacacaaaagcaatgctatcacctcccctgtgtg

SEQ ID NO: 690535 - DNA, 150 bp, Homo sapiens
tctcgtacctcggttcatccgctcttgattcgagttccgtttttacagtccttatcatcgattccgcttttccgcgcccctctgccgcattcgccgcgtcgactgcggccggccccgctccccggtttatccccactgcaggcggttgcg

SEQ ID NO: 690536 - DNA, 935 bp, Homo sapiens
attttgaagtaccagactgagatagtgtatgccaagacctcccctcatcagaagctcatcatgtggaaggctgccaaagacagggtgcatatcgtggcgtgtgactggtgacggtgtgaatgactctccagactttgaagaaagcagacatggggtcgctatggggattgctggctcagatgtgtccaagccaatctgcatgacgatgattctgcgtggatgacaacttgcctcaaattgtgactggagctagaggaaggtcgtctgatctttgataacttgaagaaatccactttgatctatacctttaaccagtaacagtcccggatatcactcaccgtgccatgatatttattatgcaaacattccaattaacactggggacctgtcgacaaatcctctgcatgacttgggcacgtgacatgtttcctgccattctccctggcttatgaggcagtgctgatgcatgatgacatcatgacagagacagcccagaaatcccaaatacagactaaaacttgtgaaattgagtcggctgatcagccatggctatggtgcagattggtacctgatccaggccctgggaggcttctttacttacttttgtgattctggtgagaacggtttctccctattaactgtcgggctccgagtggactgggatgacgccgatcaacgatgtggcaaaaggtacgagcagctggggacgtatgacccgcgacagccgtggagttcactgcaacagctctcagaagatcggggggcatggccactggaaccgaaaacgggaatccggccccgcggagcaaaaggatcgaattggctgaaacaccggctctcccagccaaggggcagaccaacccgggggcccccccgctaacgcccgcctgggaaacccccttacaccccatgtccccccccgggtgctgagagcg

SEQ ID NO: 690537 - DNA, 840 bp, Homo sapiens
cgtcccttgtacgtcccctgcggtacccgcggttttatccccaatggcgtccccccctggccggccctagtcttgcgaggcgccgcaacttgtttgcaccccaatcagtacctttgccggccctgcaaattctcctggttctccctcttcgcccggccgggttccccccttttgagcgcccctcctcttgcccccctcccgggtaaagtcgccaacctccacaaaagtgtggtcccagcgctaacgttttctctgccccttgggggcaaaacaatatttcgcgaaatttttcccccccgggaatcccccccccccattcctttcttttaaggacttacccccggtcccctgcctttccccagaacatttgtccgcctccaccgcccacacaccaagtttgctgcgggtaatccccccgacatatttattcccccaatttttttggcgcccaaaacagggtggcatgaacagtcttctctgaaacccctaacagactttggctgggccacaaaaacgtcctccgactattcgggcgccataaataaggcgtcaatctatgtggggataataataaagctccagatagtcgggcaaccaactatgtgatcgcacgctttatctccccatttcttggggtcgccgccgcaaacccgctcggcgccccccgggataacacccgtctgggagggaaaatttctgtttctctgcgcccaaaggataaagtcagcgcgacatgcccccgatggcttagagcaccaacacctattttcccctttttgggggaaatccaaaaaaaattttttaacccccaaccaaaaaaaaaacttttcccggccccca

SEQ ID NO: 690538 - DNA, 595 bp, Homo sapiens
agcggggcgttggccttccgcggtcctgtgcgagtgcgcccttctcgggtcccctaggtcgcggggcgagcgggcctggacaggggcttgtgcattatttggagatgtgtgtgtgtgaacgtcataagcctttgcgtccttagagtattgccgatagttgacctacgcaagagacaaggtcatggtgattcagcctaatatctcagaggatgcagcattcaaggttctatcttggaacgcagagactgtgccctcgaccagagtgctagaacctgctgagcaacctgatcttccacttcaaccttcattccaggaactgttttcgtatcaggatgatagctggcctcatacaatgaagtcagggacagcgcgatgaaaatttggtgccgtgactcggatcggcggacctcccttaaggagatcaagagtccccgtgtacgtcctggacgttaggtccagtgcagaagagatccagctagcagacctaaggtcctcaggagcaacaagcccgaagaaacgatctcaccgagttatcgaaatccgaaatagcttcatctagtctggcaaacacatgtggcaaggattagttctcacc

SEQ ID NO: 690539 - DNA, 766 bp, Homo sapiens
aacgatcaagtgatagaattcaggaacgatccgagatgagctgagaaaatgcttctggtagatgaatgatatatgcagtgctgctactttttgtacaggaaaacaggtgagttctgacaaaatgctatgtgccagtcatgtcgtaatatccggacagataagctagggcttcagtctcttcggtaacagaacatcgcatgtgcaagccacttgtgctacacaaccgaactggtcgagtactgaatggacttgacctgggcgtcctttatgacatacacaacgtgcatgaaataggatatctaaccaaggactgtgtgataaaatagatctaggcttgttactagcaaaattagtatgtatctcggtttattaaacagtatctgggagtggcttgggcgagaatacttaaacttatattgttgccaattattgtttacccgagtataatgtttgctatttagacaatgtgcttggtattaaaggaaattctccttgggaaaaaagtatcctcttttaattttacttcccataagcgtaacatgcctggacatagctcttgtgcaacctttaaataacattcgttttgagtgtattacgagcccagacaaataatgttttaaagttatccccttgctactttactgatacctttatcattcctgagacagtttgctactttacaaaatgtagcattccattgtgtatttatgtctctcccttggccaaaaaagatttctaatactggttgtaccagacagagaaaggt

SEQ ID NO: 690540 - DNA, 275 bp, Homo sapiens
gtcgacattaaaggcgtgcaccaccacgccaggccccatgtttaatgtttagtaaacatttaataaacatttaataaacattgtgaaggtctgaagagatggattagcagttaagagcattgacttttcttgcagaggtcctgagttcaattcccaggaatcacatggtgcctttggaatccgatgcacacttttggtgtgtgttggaagacagctgcagtgtacacatatacatacacacacatacactctgacacacatacacatatacatac

SEQ ID NO: 690541 - DNA, 339 bp, Homo sapiens
  misc_feature (221)..(221): n is a, c, g, or t
  misc_feature (244)..(244): n is a, c, g, or t
tgaccagaacagcaaccttctcatcgagtagttccgcaatgagtttggggagatccagggtgacaagagcgagatgatctggaacttccactgctgggtggagtcgtggatgaccaggccggacctgcagccggggtacgagggctggcagggcctggacccaacgccccaggagaagagcgaagggacgtactgctgtggcccagttccagttcgtgccntcaaggagggcgacctgagcacnaagtacgatgcgccctttgtcttgcggaggtcaatgaccgacgtcgctagtgctggatctctatgcagcacgatggatctgtgcacaatatatat

SEQ ID NO: 690542 - DNA, 385 bp, Homo sapiens
cggttcctagaggatccccttcgacggtgtctgtgagaataaacatttagaaatgtaaaatattaaaatggagtatctgaataataatgaggtactcaggatgaagcatgtatgtcataattttctaagtatacgaatagcatatttttttttcttttggagacagagttgctcggttgcctaggatggagtggagtggcgcgatcatggctcactacaacctctgcctccggggtacaagcgattctccggcctcagcctcccaagtagctgggactgcaggcacgtgctatcacacccggttaatttttggtattttagtagagatggggttttaccatgtgggccaggatggtctcgattccctgacctcgtgattcgtctc

SEQ ID NO: 690543 - DNA, 315 bp, Homo sapiens
ccccgaggaacaaaaactggagctcaatcttggacggtacagacgctcgcagacaacctggccggcggcaccatgaggcaggcggtacgcgcagcgctgctggccgcgctgctgctcctggtacagctgtgccctgggagcagccagaggagccccgaggcggccggggtccaggacccgagtttgtcttgtagccccctggtatgctatcagttgtgttggggtccgtgtgctcctcttttttctgttgtagtgcttctcgtgtcgcgcggggcccgtccgattgggactcggtacggcaggcgagcggccgca

SEQ ID NO: 690544 - DNA, 327 bp, Homo sapiens
ggctcggcccgggtgatagcacaataaggaagggtccccaggtggtagagagcccaagtgagaacaataatgaacaattatgtatgaacaatgttagagacagctaatcccaaacaacctgcgggcacaatgacctcattccacacgtagcacccttcagcaggaccctataaaactttcctccagcccttgcctctttgcaggtagccccttctctgctgagctgcccactgcaacatattttcacaatttctctaatagatctgcccttctttacctacaactatcttggtaaatggctttaccacctgcaaaactgaccctagg

SEQ ID NO: 690545 - DNA, 437 bp, Homo sapiens
catggttttttaaagcttcccaagtgattctactgtatagctatgattgagacccactcttctcattgactgttacccaccatatgtgcttctgtagtactgtaatcctgtcaataataatgtagagaaatactagtgagctaacaagtaaaaagcaaagcataattctgctacctctttaaaaaatatatacatactttgaaaaagatggaacggaagttaccttcacagcagttatctcttgtttttagtagtagtgcaggtgactttgttctttatactttttctgttttaacctttccaaaataaacatacattgcttttataattgaaaatctttagcttaaaaatttgacttttcacctagtcaattatgtaggtatttgtttgcatgtacataatcatatcctaacgtacagtctgtcatagcattttgt

SEQ ID NO: 690546 - DNA, 275 bp, Homo sapiens
gtgcagaatcacactcaacaaaaggataaaaaaaaaaggagaaaaattagattaactgaaacccgggaatacagttttggaattccataaaggttaattttcctacaaactctttttggaaagcttaatatatatacacccccttagagaaacctttaaaattaaggggataagtatctccaacctcatcacatggaatggatcacggctctgaccttaatatttccaccgggtataagccagcagggattcgctttaaacagggctcgagtcct

SEQ ID NO: 690547 - DNA, 327 bp, Homo sapiens
cagctgttgcagcagctcggcctggcttttcagcaggtcggcgtcatccggcgcgcgcggcggttgcccgctgatgcggtgggtatcgtcgaggcccagcggccagggcgacagcaccagcagccggtggctcaggcggcaggcctccatcggatcgtgggtgatcagcagcacggtgttttgcgccagcagttcggcggccaggctctggatctcggcgcgggtaatggcgtccagcgcggaaaagggttcgtccatcagcacgatcggctggtgttcgtagagcgtgcgggcgatggcggcgcgctggcgcatgccgccggacag

SEQ ID NO: 690548 - DNA, 264 bp, Homo sapiens
  misc_feature (177)..(177): n is a, c, g, or t
agcgacattgtgcaggaagagtgagatggtacaggcagctgaggagaagtaagagaaacgatagtaagaaggccactcggcaaggtctgcattctccctcgatgctctcaacccatcttcgtgcttctctgccagcctcctggtccaacctccgcatctttgctgagtcactcatgnctccgtaagtgatctcccaagcccacttgggcccctcctaaccactgtccacttagtagccagagcaatctttagttcggtcaggga

SEQ ID NO: 690549 - DNA, 178 bp, Homo sapiens
tgtatcccggggagagaaacaagtaacaaagtgagacacgagagaaaaagaatccacagtttctacaaaaagccccaccctcgggaagacatggtggacacatgatctctgtgcccctagagtcaagccgtggatcagtaggaggtacctgtggcctggggaagcccctgtgcaggtt

SEQ ID NO: 690550 - DNA, 116 bp, Homo sapiens
cacttcatatgatgagacctggactatcggggatgaccaggcacagacctgctgcaggtggcagcccatgaatttggccacgtgctggggctgcagcacacaacagcagccaaggc

SEQ ID NO: 690551 - DNA, 330 bp, Homo sapiens
ggctggttatggctcccttgacagccacacagactgtggtgatcaccgcattgagcccactgccctgtagaatctggctctgcagcttgctcgagaatgctgggcagcctggtgcagaacaacgaacgggtgtttgaccgacaagcagtggcacctactgggcgctacttccgatgaccagaaggacggctagcgcataaacgagggctacatgcgccgcgttggctaccgccagcagcagtctcagacggcctactgagctctccactccgtttcccgcctgggccattcaacgcctccgcggaggcgttgaatggccgaggtctcttc

SEQ ID NO: 690552 - DNA, 160 bp, Homo sapiens
tgtggcgccggcgcgctgcggcgcatcttcgataggatggtcgagatggtgatggctctcgctcatcggcaagtctccagcgcgcgctttgacgcctcaaggacgtctaatatacgggcgttgcgcggtatggcgacgccgaacggcgctctccgcgtac

SEQ ID NO: 690553 - DNA, 148 bp, Homo sapiens
gggggttttttttttttccccccccctttttcccccgccccccggggggggccccttttgggggggggcggggggccccggttgggcccccctggggggggtaggacccccccccaaatttttttttaatttaattttgggtttccca

SEQ ID NO: 690554 - DNA, 360 bp, Homo sapiens
gtatggtagatccgtgctcctacaatatagtctcaagcgcagtatgtctgtatagggatcaggaccactcatggattacagaactccaattccaactaatggagtaacagttcaaaggtcagtcagatgggctcggctcacaactgatacacagtcttttgaagtggcaaaacccggtctctccagtctataatacgcaatcgcagtactcaggagcgatcatattccaagaatgaccggtgcataggatgattaacccatgtactcttcatcatgcattaactgtgtgaggtcacccagcttgtcacccttgatctcacattgttaacacgactatcagatcgcaacctgtctgtcgcg

SEQ ID NO: 690555 - DNA, 165 bp, Homo sapiens
atattaggaatctccaataggaagtcagcagctaatctaggctacaatatacaccaggaagatgtgcttcggcacgtgacactacgctatatgacaggaacaagtggcaccaatagagtagacaccagcttaacaactgataaacgagataacggtaagtgacta

SEQ ID NO: 690556 - DNA, 1042 bp, Homo sapiens
gcttgatggtcgaggccgatctccggggcgtgctggtcggtcatcgtggctaaacaggtactgcatgggccggaaggtggtggtcgtaggctgtgacggcatcaacatttgtgggaatttctacagaaagcaagtaagaagtacctaggcttgtcgctccgacaagcggatgaacaactaacccttcccgaggtggccctaccctactatccgggcgccccgaggccgtcatcttctggcgtgatcctgttggcgaggtatgctgcgcccattaatagagcaagcgaggacaggacggtctggaacgtgctcaaggtgttggacggatcccaacaccctacgacaatgaaaaagcggaatggtggttcctgtctgccctcgaaggtcgtgcgtctgatagcctagcaagaaagtttgtctatctgggcgcgcctggctcacgaggttggctggaagtaccaggcagggacagaccagcccgggaggagaagaggaacgaggaaagggcacgatccactaccggaagaagaagcagctcatgaggctacggaagaccggccgagaagaacgaggagcaagagaattgacaagaataacacagaggtcctcaagacccagggactcctggtgtgagcccagtaaagacctgtgtaagttcctattgatagctgatgtgatggtggtgaatgactggtgtgccttcttgtgcgccaggaccacaacaagccaaagaagctgtcagtgggtggaagaaggggcttccaacgctgaattgaaggccaagctaacaaccaatggcaacaccagatgaggggatgtccctcaattgaatgcgttcctgagtcgacctcacaagtcggcaatgaggacatggacaggacggtgggacaacttaaaaatagcggccgctcgcacgacgcgcggaggagggcaaaactcatagaaatgagggagaacagcatgcacacgggcacccacgaggaactacgagcaaacactagtgtagagaccacaagcgtggggagggatgaatacacacacc

SEQ ID NO: 690557 - DNA, 172 bp, Homo sapiens
actattggaaatagtggtatctatcaacttttacgagctgaccgtcactgaattcagatgcagcgaggagtcataggaccctcacaacctcctggaactggtagtcactatcatccttatcctgagactagcactggtcacactagctttctcacaatacccttttagcact

SEQ ID NO: 690558 - DNA, 218 bp, Homo sapiens
gcaacacaagaacacctctgattactcctgccatcatgacccttgcccataatatgattttatctccacactagcagagaccaaccgaacccccttcggaccttgccgcagggggtccgcactagtctcaggcttcaacatcgaatacgccgcagcccttcgccctattcttcatagccgaatacacacacattattatataacacctcaccactaca

SEQ ID NO: 690559 - DNA, 480 bp, Homo sapiens
  misc_feature (40)..(40): n is a, c, g, or t
cagaatgggagaaaatatttgtaaactatacatctgatanatagttaatacctcaaaaacatcaggaactccaacaactcaatggcaagaaagcaagtaacttggttgaaaaatgggtgaaagacctgacatttttcaaagaaaacatgcaaatggccaacaggtctatgaaaaaatgctcagcatcactcatcatcagagaaatgcaaattaaaaccacagtaagatagtatcccactcctggtagtatggctgttttcaaaagacagaagatcagtgttggtaaggatgtggagaaaggaaaacccttatacactgttagtggaaatatgaactatttatagccattatggaaaacactatggaggttcctcaaaaaaaattaaaaatagaaccaccatataatccagcaatcccattactgagtaaagaaaatgagatgtttgcaataaacatacatgtgcatgtgtctttatagta

SEQ ID NO: 690560 - DNA, 988 bp, Homo sapiens
ctcgcgttggacgcatagccctggccgacgccggcatgagcgccgcgctcttcagcctggacggcccggcgcgccggcgcgccctggctgtcggacgcctgcgcccttctactaaagccgggccgggcgggcaatgcctggttcctacggggtccgagccagagggcccgtaggcgagcccagggcgtcctgtccgaccccgcccatgtacggacagacgagagctgcctagtcgtatttcaactgcctatagtcgcactccatggtcgtccgtgcccaccctggagctgtgccactgacgatgctcttcgacaacctcgttcatagcgaggcaattcgacaacggcggtgctgtgccgctgggagtccccgtggagacttcgttcccctggctggcccctggggcgcccctttgaggccctggcgctcctgtgctgcttcccccggcctttgctcataggctgtcagagcctcggatcgtgggtgcagacgggcggatcgcgcgccgggctccgctttgtttggcccgcggccgccaggttggggcctggcgttgtcggacgaccatgcaccccggtgggattgacggctcttgggctgtgctccgcccttcgtaaggaagtacacccccttccggaagggggggcccccacagtggcttttaacggggccgttacgtcacatgggttttcctttgttcccaaaatgtttgggtcccccttataaggttgaggtcagccaattaattaaatgccttagcgcaagttagaagcccagtcgcagattattaaacaagcaccggtctagttggacctctggagaaagcatgtgcgctaaggactttggggagaatcctatgggttaaaacggaagacccattaaacattcgctggtgggttggtgaaccattaattttgtgaacaaaagtataaccctaccagaagagctttaaacaagggtcctcaacagagtaaaattataaacaact

SEQ ID NO: 690561 - DNA, 202 bp, Homo sapiens
tgaaagatacgggtcctagaagcggcagagatctaagcaggagcaagttggtgcatgcatttggtggtacagtgtaaatatgtgtaactgatcacactgcgggcacgcctcatttgcgtgaaagtctgcaccagacttactaattgtagtagagttaccccccaacccacgaaaaaaatgctactcgggaagaaaattttca

SEQ ID NO: 690562 - DNA, 1149 bp, Homo sapiens
  misc_feature (59)..(59): n is a, c, g, or t
  misc_feature (128)..(128): n is a, c, g, or t
  misc_feature (262)..(262): n is a, c, g, or t
ctgtaaccatgaacatgttacagttaagaggcctcttaactgtaaccatgaacattgtnacagttaagaggccctcttggttctccacaatgatactgagcatgctcatggtgtgatgtttttttttnttaaataaaattccaaatgttaaaaaaaaaaaaaaaaaaaaaaaaaaaaaaaaaaaaaaaaaggggggggcgcgctccaataataatttaccacccggaaagggggcccagaccttttgacgcgtttcccacanttttttttttgttcacaagggtgccccctaatagggggagctcgatataaataacgacaaaggaaaggggcccgcgcgttaaccaagcctcgtcgtcgcagcgggacaacaactcgccacctgtcggacatctttggggaaggagaaccccctaactctcgggggggcgcgccacatagctgggcaccaaacctcaccacgagaagatttaagcggcccagggcggaacatattacacactttcacgggtgttcatacggggtgttcaccccaaaaaggggcattgtgcccaggcggcgcctggaacaaacttttgcgcaccacagcgggacattatgtcttaatcagcaacaattatttatttcccacgggagcttatctgtgtaaataaccgactgaccaactgtgatcacccacccaccactctgatgacgacgcacacacagcccatgtccgccacgcagtcgcgcacggtgaccgtcacgacattgaagcacacccacacagcattagtgactgcgagcgggagaagcaggaaaagaaataacgcccaaagcaaatcgacgtaaacaggaacgcgagcagagacagaagagcgagacaaaagacagaacgaaaaagaggaggagcgacaaaaaagagaccagaaaaagagagacaaaagagagagtaataacaaaccaaaagagagaagacaggagagagaccaagcacggacgcaacaggacaacggagggaacgagacgacagaagcggtagcacagacgcgagccacgaagcgagacaacacagaatcacagaacacagacaacaaaacatcacacgccagaagagacggaagaagatagagaatagttcgagaatcgaccgacaaacgcagagcgaaa

SEQ ID NO: 690563 - DNA, 556 bp, Homo sapiens
aatgaagaaattgatgaaatgatcaagggagctccggggtcaaattactttacttgtgtccctcacaatgtttggggagaaacttaggggagcggaccctaagaaaaccatctcaaacgcattcaaaagtgtttgaccctgaaggcaaaggggtgctgaaggctgaatacgttcgggaaaatgctgaccacgcaggcggagaggtttttcaaagaggagggttgacaagatgttcgccgccttcccccctgacgtgactgcaactttggactacaagaacctggtgcacatcatcacccacggagaaaaaaaggactaggagggggctcgctgctgcgccctgggctcgttctttgcagagtggtccctgccctcatcttctttcccccgagtaccgcctctgtccctaccttgtttgttagcaatgtgggtgccccctttatccacctccattttctttgcaagctggggtggcttatgggtacttggtgcccgcacatctccaggttgaaatcccatccagaggccattgtttccaattaacaggaggtcgtgt

SEQ ID NO: 690564 - DNA, 284 bp, Homo sapiens
atagctggcgacaggaagtcgaggctatcattgagccacaattgtgccacggcactccagcctgggtgacagagggagacccctgtttccagggatgacaaaaaaaaaaaaaggaaaggaaaacaaagggggaaatttttgggggcgttttgggggaaaaatttggaaccaatggggggggggccccgggaaatttttttgggataaaaaaaaaaaagaattttttacaaattaaagttgtcaaaaaggaggggggaaaaaagcaaattgcgaaacacgtttaa

SEQ ID NO: 690565 - DNA, 237 bp, Homo sapiens
tgctaaaaggtaatcacagatgtacccagtagagagatgtggctaggctaagacgtaatagagactgcattgctgcgtgcttgatgcttgtacccttttgatcgtggtgatttagagggtgaactcactggaacggggatgcttgcatgtgtcatctcactaagagctaatagaacggctacgaccaaaccctatacagccatttaggtaacagccatttaggtcacagccattcag

SEQ ID NO: 690566 - DNA, 117 bp, Homo sapiens
atcaacctattgtaataaaccctcaaagaacctgttgaaattattccagactagtaatactaaaccagtatatactactccttattcaaatagtctagtacataataggattactca

SEQ ID NO: 690567 - DNA, 100 bp, Homo sapiens
agttctgcttggtgactctgaggatccgcgttgttccagtcggcgtggctgtgggcggtgtggagggcgcgccgggtatccacggtgggcgcgtcggcgg

SEQ ID NO: 690568 - DNA, 771 bp, Homo sapiens
  misc_feature (68)..(68): n is a, c, g, or t
  misc_feature (761)..(761): n is a, c, g, or t
gaccctcggtttgcccgaccctctagcacctgattgtgggtaaagctgactgaaagggattccgaggncctcggtgactggcctggttaagatcacgaatctgatgggattaagggcctgtaccaaggctttaacgtgtctgtcagggtattatcatctaccgaccgcctacttcggtatctatgaccccgccaagggaatgcttccggatcccaagcacactcacatcgtcatcagtctggatgatcgccccgactgtcactgctgttgccgggttgacttcctatcccatgtgaccctgttcgcccccgcactgatgatcccgtcacgggcgcccaaggaacctgacatcatgtacacccggcaccgcttgactgctggcggaagattgcctcgtgatgaaggaggccaagcttttttcagggtgcactggtcccatgttctcagaggcactgggtggtgcttttgtgcttgtcttgtatgatgaaatccagaagtacaccactaagttatttcctaggatttttccccccgtgaaccacggcactgttgtattatataacactatcttgagcacttcttgacaagaactcctggctgtcacgtttctcacgtggcaactatttactggttgaaaatgggaagccataatattcatctgacccgttttctcttaaagccctttccctgatgatgatgatgggactccattgtattttttatttcagtcactcctgataaataaccaatttggagaaatnaaaatatcta

SEQ ID NO: 690569 - DNA, 305 bp, Homo sapiens
atgtcgcgtgcatgtcatgaggctactcagaaggacacgcaaattaaaacttaggaataatttctggaattttccatttaatatttttgactatggtggttaactgaaaactttggaaaagcaaaaccaacagataagggggatggggactaactttatttccctaagcttttcagtaaagtataccactgtgaaatgcgagatcagagaatttgtgctgggcaaaatggggtactttaaaattaaggaacaaacttaagttcataatttaaggctcctgttttgaaagggtccccttaaactaa

SEQ ID NO: 690570 - DNA, 660 bp, Homo sapiens
tctcttggtctggcccagcgagtaccattaagagaaaaccgagaaatgtcacataccagggacagccatgactccgcacgcgtgaatgccgctccccgtggccctgtggacccatgaccttggcctggccgatgtggtgccatgatcctagtcacccgtttggatcgaggcggtcagtgtgtacctcttcaccgaggcacctcctaatctcgtgacctcattattcaggtgtttgaccggcgatcgtcaccggttcaagcgtaaaacaccggtgtcacactgcatgccatcaacgccccgagacgctgcagtcaggcctcgagtggctgcggtggatgtcttccctctcagtcgctgctctgaagatcgctgccctgcctctgggagcaggttgtcagatccggtagtcttgacgcgaggagagttgtagtaagggtcgactggagggttctggggaaaacacccgggtggtgcacgtcccttctggagcccatctctaagcatgaatcccctcaggctccaggagggtgaaggactgggaaaccgcagtcggtagtcctgtgagacacgtgtgttcgagacaagcgagagtacgaggggggctggtaagtggtgggtcagtggtgttccttctttactggaggctcctccctcgggggg

SEQ ID NO: 690571 - DNA, 439 bp, Homo sapiens
tacgaatcgagcgcttacctgcagctctctctgatgtgttaaatgtacaaagccaggaaattcagttaccgttcccatagcaactgcagctgcttcctggacctggtagattaagttatgaaaattaatcccacttgcagcctctctcttttcttcattattagtctagctaatggtttatctatgttattaattttttcaaaaaaccatatcatggaatttgtgagtttttgaaggttttttggtttgtatcttcttcagttcctctctgatcttggttatttcttgtcttctactagctttggggtttgcttgttcttggttctctagttcttttagatgttaggttgttaacttgagatctttctagctttttgatgtgggtatttaatgctataaatttccctcttatcactgctttagttgcatacccaagagt

SEQ ID NO: 690572 - DNA, 166 bp, Homo sapiens
gccggaccgggttccttgtctggattttctgatcacacacttacggtctaattcagcatttattgtctctcctctgtgtttcctggaaatgggcagctgtgtccaggactttattctttctttctttctttctttttggttttttgttttctggagacagggtctc

SEQ ID NO: 690573 - DNA, 465 bp, Homo sapiens
  misc_feature (163)..(163): n is a, c, g, or t
  misc_feature (168)..(168): n is a, c, g, or t
  misc_feature (254)..(254): n is a, c, g, or t
  misc_feature (373)..(373): n is a, c, g, or t
  misc_feature (429)..(429): n is a, c, g, or t
  misc_feature (456)..(456): n is a, c, g, or t
  misc_feature (462)..(462): n is a, c, g, or t
tctgccccattcctctgattcccaagtggctgctagctggacccagctggtgtcctgggcatgaaagcagggccaaccgtccccaagcaggtgctgccctcctggcccagctgagcatcctggccaacatcagcgttcaagttgccctatattcgcctttctnttttnttcagaagcctttgcggacctgacctgggccagcttcccgcgattccccttccgcttcctatcaacgtccaggacccaactgcccncccaggccagcccttgccacttggggcccggtcttcacacgtgggagtctgaccggggctcctccctgaacagtcctgggtctgacgctctcaattatcacccacggacccacacgacnccggctctggcggggatgggccggggctgctcggggtcccgccaggcgagccccanctggaggcaggcgccaggcggggaacnctcggncgc

SEQ ID NO: 690574 - DNA, 300 bp, Homo sapiens
taggatggggttccatcatgatctcctgacctcgtgatctgccctcctcagcctcccaaagtgctgggattacaggcgtgacgaccgcgcccagctgagaatgtcttttataattacccatatgtttactattactagttctattaactcttttgtgtagaattgcatttctatctcacatcatgttttcttagctcaaagagcttctctctttttttttttttttttagacagagtcttgctctctttcgccaggctagagtgcagtagcgtgatctcggctcacggcaacctccgcct

SEQ ID NO: 690575 - DNA, 137 bp, Homo sapiens
  misc_feature (137)..(137): n is a, c, g, or t
ggtgaaccttctcgggaggtttttttttagaagtttttacccgctaacacaaagcggccagaaaaaagggccttatacccccctttttattgtgaaagggcaaaaatagggtttataaactgcgagtcttttttggn

SEQ ID NO: 690576 - DNA, 274 bp, Homo sapiens
  misc_feature (259)..(259): n is a, c, g, or t
ccagctccttgggagcctgaggcaggagaatcacttgaatccagaaggcggaggttgtggtgagccgagatcgcaccattgcactccagcctgggcaacaagagcgaaactctgtctcaaaaagaaaaaaaaggaaatagttttataattttacattctcaccagaagtttatggagagttccaattcctccacattaatgctaacagttggtgtgttcggttttgtgaatttttagccattctcaggggacgtgtagnccattcttacaaggt

SEQ ID NO: 690577 - DNA, 340 bp, Homo sapiens
gttttttgagatggagtttggctgttgtctcccaggctggagtgcagtggcgtgatcttggctcactgcaacctctgccttctgggttcaagcgcttctcctgcctcagcctcccaagtagctgggattacaggcgcctgccaccacgcctggctaattttttgtatttttagtagagacggggtttcaccatgttggccaggctggtctcgaactcatgacctcaggtgatccacctgccttggcctataaaagtgctgggattacaggagtgagtcactgcacccagaccacatttctcattttacctgtaaaacatcagctcttaaccttaaaaaaa

SEQ ID NO: 690578 - DNA, 198 bp, Homo sapiens
taaagggccggggaaggttttaaaaaaggggggctttgggttccacccatgggcacccatttccgttttttgttccgggggggggggggacccggggggccccgggggggggcccaggggggaaaccccccggtattgagcccaaaggtccaaagggttgggggggccaagtggggttttaggtttttttttaaacca

SEQ ID NO: 690579 - DNA, 147 bp, Homo sapiens
cggtgactcttgatggatcccagctcagtctgatggtatctaggggtgaacataaattgctaaattatacaaacagcttgatgacaaggatgaagaaattaaccagcaaagtcaactggtagagaaactgaagacgcaaatgttggg

SEQ ID NO: 690580 - DNA, 960 bp, Homo sapiens
  misc_feature (5)..(5): n is a, c, g, or t
  misc_feature (960)..(960): n is a, c, g, or t
cagcnctgggcgcatctctgtttattaaatttatctcatgattaagacatttataaggactattgaagtgttcagtagaatttgaaaattattatttaaaaatatctcaatagtctcaaaggttttgcataccattgaaaaaagcaacatactcttaaagaaatatagacatatgcaaatctgttatctacatatctataacatacatagacagctgttaacctgctttcagactataaaattttgttatctaatttaaatgcatttttttatagtcttaaaatattaaaagagagtagaaacctgttgcgtgatttactgccaagtttgggaaaagttactatttatacacaaaatatatatacaaattcaataacatgcctaggtaggtacaaacctttctaccggataactcgaaaagcttaaagaacaagtggactggccaaaaactcccatacagaaatatacgaattccgttcccgaaaactcaatgcgtgtgtgcattaataacaaacattgcggtggaagatatcataacattcgatgccaggcaaaaaataacaaagacgatctgacaaatagcgacttctctaagcgcggcgcgaatagttggtcagcgctacgcactgtggatttcctcccgtccggggaagcagaccaccttggcggtcgcaatcgtggcacgaaaaatagacgagagagtgacaggcacgagtatctgacacaccgagagcaagacaacacaagtaatggataggcctgtatgctcagtgcacgcaaagtaagagtaacctatataatgctccgcggctcgagcgaaaaagatgaagagtatggtgaccagccggagaggaggcctggaggatgcgcgcacgatcaaggcgcgcaagtttaggcacgaagcgactggttgatgacgttagctgggtatgcggccagcatgagccaacggaggacacn

SEQ ID NO: 690581 - DNA, 905 bp, Homo sapiens
  misc_feature (5)..(5): n is a, c, g, or t
  misc_feature (439)..(439): n is a, c, g, or t
  misc_feature (443)..(443): n is a, c, g, or t
  misc_feature (445)..(445): n is a, c, g, or t
  misc_feature (459)..(460): n is a, c, g, or t
  misc_feature (464)..(464): n is a, c, g, or t
  misc_feature (468)..(468): n is a, c, g, or t
cagcnctgggcgcatctctgtttattaaatttatctcatgattaagacatttataaggactattgaagtgttcagtagaatttgaaaattattatttaaaaatatctcaatagtctcaaaggttttgcataccattgaaaaaagcaacatactcttaaagaaatatagacatatgcaaatctgttatctacatatctataacatacatagacagctgttaacctgctttcagactataaaattttgttatctaatttaaatgcatttttttatagtcttaaaatattaaaagagagtagaaacctgttgcgtgatttactgccaagtttgggaaaagttactatttatacacaaaatatatatacaaatttaataacatgtttaggtagttattaaactctataacgtataagcagaaagtttaagaacaagtgaatgncacnantcactcatgattannaaantcanccttaaaaataattacaatcgtaataatagaacatcgtcgctaaatattttaactttggccccaagaaaactaaatttgtcgaagtatctatcttatttctcccccgggggggaaagtgttggagctttgccttgtggacccccttagtttagaaacgctgacggggtccgggacctattggacaaaacacaacagttgatataaccacgcggtgaatacattcttcagggcactctcaataagaaaacgctgaggggtttgctgcacgaaaggaggtgagtcctttttatagcgtcaataactcacgtacactgtataggcacgggtcacccaaccttacgttgcctgtccgtagcccacgcgtattagcagccaagtaacaaactacgaacggcataatacgttcgcggataccacccgttacgccccgtcccac

SEQ ID NO: 690582 - DNA, 904 bp, Homo sapiens
  misc_feature (5)..(5): n is a, c, g, or t
cagcnctgggcgcatctctgtttattaaatttatctcatgattaagacatttataaggactattgaagtgttcagtagaatttgaaaattattatttaaaaatatctcaatagtctcaaaggttttgcataccattgaaaaaagcaacatactcttaaagaaatatagacatatgcaaatctgttatctacatatctataacatacatagacagctgttaacctgctttcagactataaaattttgttatctaatttaaatgcatttttttatagtcttaaaatattaaaagagagtagaaacctgttgcgtgatttactgccaagtttgggaaaagttactatttatacacaaaatatatatacaaatcctataacctgttgagggagaggtgacactctgtaaccagtaagcaaaaagtcgaaaaacaagggagttgttaataatgcaccgtatatgctaaatcttgcccttaccccgatcgtgaaggggttactcagaagaccagcgtgagccagtactatgatacgtcatgcgagcgaaacaatgttgcgcgagtgttgacatcaactattccatagtggcagcacactgaatagccccgtacccgcgtatacattaggcggggcgggtgaccgcgcccgcgcccaaccgtgacaggctaccttggaccaatcttgaggggattgtgctcgtgagctgctaagacgctgctaagaaaggagcgaacctcatgatcgcgtcatatggggacgcaatttgatgagacagtagtcagcaagctgtgatgaaaggaccgtgcaggcagtcgatggtttacttgtgacggatattcgggcacgcatatcggaacgatctgctggagccttgtatcctctaaaatacgcgatcaatgggttcacag

SEQ ID NO: 690583 - DNA, 214 bp, Homo sapiens
atacatcctttctttttttgtggcaaactttcacaagcaggacttccagggtaccagcattttgttcattttctgagtttggtgatggcttatcatttttgtggaagaaaccaaaaatgtacgctgccaatgagctgacaagctatgagattcttgctctcctttcattttctctacttttgataacatatcatcaactttaaatgttttcatg

SEQ ID NO: 690584 - DNA, 895 bp, Homo sapiens
  misc_feature (5)..(5): n is a, c, g, or t
cagcnctgggcgcatctctgtttattaaatttatctcatgattaagacatttataaggactattgaagtgttcagtagaatttgaaaattattatttaaaaatatctcaatagtctcaaaggttttgcataccattgaaaaaagcaacatactcttaaagaaatatagacatatgcaaatctgttatctacatatctataacatacatagacagctgttaacctgctttcagactataaaattttgttatctaatttaaatgcatttttttatagtcttaaaatattaaaagagagtagaaacctgttgcgtgatttactgccaagtttgggaaaagttactatttatacacaaaatatatatacaaatttaataacatgtttaggtagttattaaactctataacgtataagcagaaagtttaagaacaagtgaatgtgagaaatcacccatgattcataaaatttagcgtccaaaaataatgtgacgttatacttattcacaacgtttttcaaatctttaacccgtgtcaccataaacttaattatcatgaatatctggatcttcatggttatcactgggcgcaatgtgtttggcgttgcacctgtgtcagctatccccgtatatggggacgacgcccgcccttccgtgatcgagaaacaccaagtgtgagcccagagagaatttaatagacacaatcataatataatatcagagaggctaaataattgatggggtgatgctggaccgcctaatcgtttccatgtagatcgtaatgtgtacatattataattactcccaataacatatactaggagaaggattaagaacggcgcgataattgagtcagctctggtactcttacgcggttaagctgcatttgccacagagcgcg

SEQ ID NO: 690585 - DNA, 868 bp, Homo sapiens
  misc_feature (5)..(5): n is a, c, g, or t
  misc_feature (439)..(439): n is a, c, g, or t
  misc_feature (443)..(443): n is a, c, g, or t
  misc_feature (445)..(445): n is a, c, g, or t
  misc_feature (459)..(460): n is a, c, g, or t
  misc_feature (464)..(464): n is a, c, g, or t
  misc_feature (468)..(468): n is a, c, g, or t
cagcnctgggcgcatctctgtttattaaatttatctcatgattaagacatttataaggactattgaagtgttcagtagaatttgaaaattattatttaaaaatatctcaatagtctcaaaggttttgcataccattgaaaaaagcaacatactcttaaagaaatatagacatatgcaaatctgttatctacatatctataacatacatagacagctgttaacctgctttcagactataaaattttgttatctaatttaaatgcatttttttatagtcttaaaatattaaaagagagtagaaacctgttgcgtgatttactgccaagtttgggaaaagttactatttatacacaaaatatatatacaaatttaataacatgtttaggtagttattaaactctataacgtataagcagaaagtttaagaacaagtgaatgncacnantcactcatgattannaaantcanccttaaaaataattcccagggcaatcatacaaaattgcaatgaaatattatagactttgcaacaagaaaatagaactaacgaaaaagaatgactattaatctcttaccaatggtgggaaggtgttgggcttatttccggggatctctttttctggaacactagagaggccgggggccttatgtgccaaataattgcttgatcttcacccgtagatattacccgggggaatagtgaaaacagttttggggttacgagacggtgcgtaaagattctttaccaaacgagattatcacgaagctacgaaattccgcaagttttcatacaaaacacaaagtataagtggaatgtcagcagggggccgagaaggagatgcggatacggagggatagcaggtaggcg

SEQ ID NO: 690586 - DNA, 1206 bp, Homo sapiens
gactgacaggttcccagtgtttgtgctaagcagggactccaggtggcagagcaactacaggtcaccctcagggcaatttctctgcatgaattcaggttccaactcaagccgttgcacacatcgaacacacgcttcgtgcaacatcttggcattggcagcacagccagctcatttctatcgtccaacagcagcacaggtggcaccgtagcagtggcttcaattgtccacctcagtgcacatcgcaccacctgcattttatgcccacaggttccactctgcatttccacacacagcaggccgcatctcttacccacagggtgccactattcacttggtcacgcaacacatttctttggcgcttgctcttcgcccgcacaagccacctagcagtcatggcatcgcgcccttagctagcttacgcaacatgtggcaagcctttaccttccactctggcccgtggccatggcacgattggccaggttataggataggccattcactatagggctcggcattccaacagtctttccctgggcattgggcaaccactaggcaaggcaaaaagatctatttttccccttgggccactctcttgcggctactagaggtttagcgcgattgggacaaagcgttctaccgaacaatggatccgccgatttctacactcaggcgcacccagggtcggccatacgtggcgaaggccaacatcgatggcaacacttgggggccatcacgattcccccacattgccagatccacagaccaacgccgcaaggaagcacccttacgggaggtgactccacactctctccaaagggaacacacggggggttgttcggacccatcatacccacaagccaagccaacaatgtgggggcgatcacacgagagcacaacctagacacccttgtacaaacggcaaccggcggcaggaacaattccacaccgcgtctaccacactttgtttcccccaccataggcaacaacctgagaacagcctttgggcgactacaacgccgcattcaccaccccatttggagactgcatttaccatcactttagcatcacacattctgctatcaacaaccatcgggctataggggggagccctgcaccacacatgaggaccacccccactgttggcggcacctgtgattttttcacgatacctcatacagtttggggggcactgcgctatttcgcatg

SEQ ID NO: 690587 - DNA, 881 bp, Homo sapiens
  misc_feature (5)..(5): n is a, c, g, or t
cagcnctgggcgcatctctgtttattaaatttatctcatgattaagacatttataaggactattgaagtgttcagtagaatttgaaaattattatttaaaaatatctcaatagtctcaaaggttttgcataccattgaaaaaagcaacatactcttaaagaaatatagacatatgcaaatctgttatctacatatctataacatacatagacagctgttaacctgctttcagactataaaattttgttatctaatttaaatgcatttttttatagtcttaaaatattaaaagagagtagaaacctgttgcgtgatttactgccaagtttgggaaaagttactatttatacacaaaatatatatacaaatttaataacatgtttaggtagttattaaactctataacgtataagcagaaagtttaagaacaagtgaatggaaaaaatctcctctaatcataaaatctatccttaaaacgattcttcgtgttaataattgaaaatgggtgtcaattttcaaacgtgggatcagaaaaatcaaattgtgaagaatgttattttcattcttgccaatggcggaaagtgtatgtgttccccacaagatatcattttttgagtgtttgaaggtgccggccctctgtggcgagaaaccttctggattgccactccgctgtatgtgcgtatgggagctgttaaaaggcttctgagcaaaaagcgagagcgggtaagggccattagtgcggaggtaagagctggggcggtagacttaagtgttaatgtggaagatagcgaatctgccagccgtagcatcgcgtatagcgcggggttgtatgtgttgaatgtgtccaaattcgggggacgcgcgatagtccgagatgactg

SEQ ID NO: 690588 - DNA, 642 bp, Homo sapiens
  misc_feature (93)..(93): n is a, c, g, or t
  misc_feature (104)..(105): n is a, c, g, or t
  misc_feature (136)..(136): n is a, c, g, or t
  misc_feature (194)..(194): n is a, c, g, or t
  misc_feature (197)..(198): n is a, c, g, or t
  misc_feature (294)..(294): n is a, c, g, or t
gccgggggagtcttagtctactggggggcgcggcggccggacttttttttgaaaggggctgacagcctgggatggactggcctcccatgtgtnctccgctctgnncgttctggctctctctgcacaggcgccggtncgggctggtgttgcatcctgtctttctgcccgccgccgtttctggttggggtgggcgnccnncccgggcgggctcttttatgacactcctccctttcgtctttttttgggtgctttttttcttttcctcgttggtccgtcccacctcctgccccctgntccgtactgtgggcttcttcgccccgttccctcctccgtctcggtcttctttccgcgctcttgttggctgttttcgcccctgtcgctctttcccctcgttgtggttcctgcttctttcctgtttttttctctctctcgttttttttttctttttccctccctctgcgtttttttttcgttgtttggtttttcgttgtgttcttctctcgtggcgttctttgctctcgttttctcccctcgcctgtccttctccttcctcccctccctcttttttccttctctctcccctcccctctgcccctcccttgctccccttgttctgtctcttgcgtctccacaccaaaaaaa

SEQ ID NO: 690589 - DNA, 1519 bp, Homo sapiens
tggtaaagctcggccataaaccttctagcgtgtgccaagtggttcacctgtggccacacttcgcaccaggtttgtccggtgtatagccagcaaacagagttcgtggccatcagcagaaccaggccagggaagggtgcacgtgggggtggttctgccttgcgtgcgtggatacgtgattaactttcttgggctctcagtgtctacactcataccaagtgactcttgtctcccctcataaattcccagaactcttggagtgcgtgggcgcctgtggtggcagacaacaacagcccagataggcggttatgagggcgtgaaacgcacaggggcgtgtgagtgagtgtctccccaacacaattcataggcggtgtctaagagggtgtttgtgccttctcggtgtgagaactcccattaacgagtggcgcgtgggcacatccttgtggcctccagaaagccacaggaggggattccacttgtggagaagcaccggttacaccgggtgtccagatataacgccgtggtgtgtgggccaaatgtggtgggtaggggatcatatacagcatttgcaggatatagcccaggggttcccaattacctgtgtgaacccaggctgtgggtcccagagcctacaggggaacacgagtgactagagcgggtagcgcgagccttgtagagggggccgaaagacaggcggggagccaccaagggacaacccacaactctagaggaggggctcctaaataccctggagaccaggtggggctctctgggcgaccaacagcccaagggggagaatcccccaataaggctcgagcagggggtatcaactaccccagaagaaatccccagaaggaaccaaacgccgtggcccgagagtttgccacaggaaggagagaaaggggccaaccacctacgagagcaacacaaccccgtggtggtatacagtgggcacccaacagaaagatcggcacagaagagtcacatagaaatcaggcagggggcaggcgccgatccctagaagaggatatcccccttggaagtggggggccccaacagactataaggcggtaccacacaggattccttgggggatcccaccaaggtgggggccccaaatagtaggagccaggagtaatcgaagaagcaccagggcaccgaggagcagtagcactataacaccaaccagcacccgggccaggggaacccacggggcacgcgggggactccggggaagagaaccacaacaccatgtggggcggggccccatattgggccacacacccccacacgacaaataagagccctaggaacaacagtaaattcacggcaatcaacgtataatcaacccagcacataactgcgcaaggcgaacaatgcgtcagcggcgacagctttcacgtaaccgccgtcgcacgtagtcaatgactgatcaggtcgcagcgcagtcgctcgcaggcagatgcggcgcatcgagacgtcgacggagtgaatgcgagtgcaacacagcagatgcgcgagc

SEQ ID NO: 690590 - DNA, 156 bp, Homo sapiens
cggcttcctcttggtgatattcgccattgaaatagctgcggccatctggggatattcccacaaggatgaggtgattaaggaagtccagcatgcactgggactcctgcacagccccgcagcagcccaggaagcccaccagcatcatgagggcgccgg

SEQ ID NO: 690591 - DNA, 252 bp, Homo sapiens
aaacaagtcctttcttttttttttgggggggggggggggcattggtcacatatgcccagtaattgaaagacgtcatcactgaaagacagaatgccctctgggcatacaaataagaagtttgtcacagcacccaggattttgggtatcttttgtagcccacaaaaagaactccagtgcttttcagggctggatatttcttaattactaatgccccacagaaattatacaatcaaactagatctgacccgaata

SEQ ID NO: 690592 - DNA, 486 bp, Homo sapiens
  misc_feature (15)..(15): n is a, c, g, or t
  misc_feature (87)..(87): n is a, c, g, or t
  misc_feature (156)..(156): n is a, c, g, or t
  misc_feature (158)..(158): n is a, c, g, or t
  misc_feature (200)..(200): n is a, c, g, or t
  misc_feature (204)..(204): n is a, c, g, or t
  misc_feature (223)..(223): n is a, c, g, or t
  misc_feature (296)..(296): n is a, c, g, or t
  misc_feature (338)..(338): n is a, c, g, or t
  misc_feature (431)..(431): n is a, c, g, or t
agatcagcccctcgncatctagcgactctggggaaggcacctcgttggatgccggtaccaggagcaccaaggctggagggcccgggntgcagcagggctggggaggcgggccggcgatccgggctaggtaccgttctgcagttcctcacccgcctncnccgccatgccagcctggatggggccagccctatttcaaggtnagangctggaagctggatcccancagcgggcagccaagtctggacacgagaggttcccccaagcggcaccacttccaagcggcacggcgcagccangtgagagcacggagcaaggaaggaagggggaatgccccccantccacgttgaagacgccgaacaaaacccagaccggccaaggtccaaagctttcccaagctttatttatttgccaaattttgggcggcttcgcngcaacgggcaccctccgagtccccgccgcgtctgcaccatcccgcgatggcgttt

SEQ ID NO: 690593 - DNA, 207 bp, Homo sapiens
  misc_feature (162)..(162): n is a, c, g, or t
  misc_feature (183)..(183): n is a, c, g, or t
  misc_feature (190)..(190): n is a, c, g, or t
atactcgctgtatccttgaactcctgagctcaggtgatcctccatgcctcagcctcccaagtagctaggaccataggcatgtgcacaatgcctggctaattttgaatttttttttttcataaacagggtcttgctatgtttggccatgctggtttcaaactnctggcctcaagctatattttnccccttnagcctaccaaaggtgtt

SEQ ID NO: 690594 - DNA, 825 bp, Homo sapiens
gtgagctgtcggcgacctccggttcagactatgggactcagactcgggtcagcctggacgctccctggacagtatgaactagtgcacacgctggttgctcatcagagacaacgtggtgagaccatccctgaggaggatctggaggtccaatgagcacaacagaggatgctgctcatgttttagctggaactggaggtaacagatgcaccatgctctcttacagagaagtggacgtatgtggtagccaccatgccaaggcctccggaccacagtggatgttctagggttgacttggaggagaatggatctctgggcctgttgaataaacctatgcaagctcccacaaagatgaactcatctgagagggactgacgccaagagcttcaggaaatccgacaagtatttctcctttcactgtattcttattcaaagatgccgacaactgggctcggagatccatagactcctcaaaccaggagacatggagagcgaaagatcacgcgcatttaatcgccagcgtaatcgacctgggcatatctgacggcaagccagtcacatggaaatgttgggggatcctggacaggattacttaaaagcttccagaagaatagttgagtggaaccaggaggtgaaaacggctgaagacaacttgacggaaaattattatcaaaagaaggtgttaagagaagttcgactggatgaattgagaaaaggtatggaaaatggtagaatggcaatgacttgaaaatagaataaaaacgggtttaaattaaaggtgaaatgagaatacacacaaaggttagaaaatataaaaaagggagagtg

SEQ ID NO: 690595 - DNA, 652 bp, Homo sapiens
ctcgctgtctgccagtacatggacctcatctcggccagtgctgacctggcggggaagcggctgatgcaggtcagtcatcggcacctggatttcctgccgccggggctgctcctgtccgccatacctggtagcagcacagctgatggcggcccctgcggagaccccgcttgccaacctcgtcccgagccatcaagccctccgtataccttcaggcataaaatatctttcatattatatcagaatttgtacctcggaaacctttatcgcttggggtggtctctctcactctgccccctcctcacgcagctcttgcgcagtcgcatcgagacgctggctggctggggctgcccatgccatcccagctccaagcttcccactccgggactctgtgtctgggtggggacgacctgacctgggcatgttcctgtctcttcatcgtgtgagcttttctggcccggtcgtgaagctcaagtgaggagggggaggctgggttaacatcgaatttgaatgaattcggttgtgatcgtagtaacattcctaaatttcccttttggagagaaaagcaaaaaaatcgccccactggtaaaacatgggtctggtccagcccctgttcagccctccagtcatagctcgaatgagggtgggtcctgga

SEQ ID NO: 690596 - DNA, 575 bp, Homo sapiens
gatttgggtggaagcgatagctgagtggcggcggcttgctgattgtgttcataggggacggagctaggggaagacgttgtgctctcccggaacagactatctcattccttctcttttcgatttacccgttggccgcgaagagttcagggcgggcggcctgcgggcaaggccaatgggcgccgcgcgggcatgcgcagcgcagcgcggtgccagcgctggccagtttgaaccatgtgttctccaacgtcattggaatcttccccgacactactcgagctctactcttactctccaagtgttaacctttcgtggactttgcgccgatctccaggggcgttggcgaacacgttcctgtggcccttccctttccttagaaggcgtccgggcaggaagtggacatcccgatttatttcgcgaggacagcggcttaactatttcaggccaaccaaacttggggcgtcgtgggacattcctcccaactcttcaaaggaacctatttagcaacgttttaagcacggggcgcaaacaaccgcagcctcaaggggcttccacaattactgggaggaccacacgca

SEQ ID NO: 690597 - DNA, 1399 bp, Homo sapiens
  misc_feature (1)..(1): n is a, c, g, or t
  misc_feature (212)..(212): n is a, c, g, or t
ntcgctgatgtggctgagttgcttctgtacacgttccttgtggtgttatcggatgctgctgttggacttgaggtcagcgggtggtgttgcggtttcccccgtgcgttccgctgcgtttttacgcgcggtttgaatccggagattggaggctcctcgcccgtttggacttttccgccgcgctccaagattgtgccgaattccccttccccccnagagaaggtcttccccggagaattcagaagaattaaactcgcagaaggagtacgccagtcccatgaactgagggtcttgaaacagctgggtggagaatcgagagcaccgagaaagaagtggcttcagaaggccatagtagagacaaccacttcagtaaaatggcagaagagtactgaccccccaaatggaagcttattaagagaaccgagaggcaccaaatggctgccaaactggaacgtttgcgagagaaggataagcaccattgaagaagtgcggaaggaccaagaatccaaagagcctgctgacgagactgaagctgactaattcgttctgagaactgactttctccccatccccttcctaaatatccaaagactgtactggccaggtgtccatattaattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctaacttcagtacaccttggtgtactgggttaatggctagtactgtattggctctgtgaaaacatatttgtgaaaagagtatgtagtggcttcttttgaactgttagatgctgaaatatctgttcacttttcaatcccaattctgtcccaatcttaccagatgctactggacttgaatggttaataaaactgcacagtgctgttggtggcagtgacttctttgagttaggttaataaatcaaggcatagagccctcctggttgatacttggttccagatgggggcctttgggggctggtagaaaatacccaagcacaaattgaccgcacgttctctggccccggttcttgccccaagggtggtttgcatggtctcccttccacaaatgactggtttgttggatgcctcaggcaaggtcagtgtacttctttcagatgtgtattggcaaccaccatttttgatcgtggccctttaaaggcgattaaacccaagcgtgttctagagaacccgtggacaaactcagatctacagcgggtgctgccaagacaggtgggaggccatcttctgacaaagttacggaaccgatttaaatttgtgggtgtcaccaagact

SEQ ID NO: 690598 - DNA, 207 bp, Homo sapiens
  misc_feature (42)..(42): n is a, c, g, or t
  misc_feature (58)..(58): n is a, c, g, or t
  misc_feature (114)..(114): n is a, c, g, or t
  misc_feature (122)..(122): n is a, c, g, or t
  misc_feature (160)..(160): n is a, c, g, or t
catgagtcatgtgccagagtacacatcagtgacatcccatcnatggacagaggaccanagaagcaaggagctgctaaattcataagactgcgatagaagtagaaagtaacctcntaatatcntgaagctggggcattgacactaaagattaaatgagtgncaatatgatcggaatacactgtaaataatacaaaattacgtaacaac

SEQ ID NO: 690599 - DNA, 345 bp, Homo sapiens
tgaaaaatttattttatactcttagaagctaagaactttgccacacatgaaccaaatttagaattaaggttcttccctagtgtatcgacggggcgcggggggtttataaacaagattttatacacaagaggtagcagaggaaaattccagtctgcttgttccaagctcagaaggtaactgcacacacctcgatgttagcagggaaggtggggcaggacagggtaagtctgatgatacggcactctagttcctaaaactgactgtagttgtcagtgaccgtgtgaggactccaggagaagtcgtggtgagatgcccgctgggatgcttgttttctttcccaggatg

SEQ ID NO: 690600 - DNA, 896 bp, Homo sapiens
  misc_feature (9)..(9): n is a, c, g, or t
  misc_feature (54)..(54): n is a, c, g, or t
gaggagccntgagagtcggagacaggatccaagccctgtgacgagctgagctgnctaagtctgagactacttctcccatcccctcctaaccaaggctgtatggccgtgtcattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctaacttcagtacaccttggtgtactgggttaatggctagtactgtattggctctgtgaaaacatatttgtgaaaagagtatgtagtggcttcttttgaactgttagatgctgaaatatctgttcacttttcaatcccaattctgtcccaatcttaccagatgctactggacttgaatggttaataaaactgcacagtgctgttggtggcagtgacttctttgagttaggttaataaatcaaggcatagagccctcctggttgatacttggttccagatgggggcctttgggggctggtagaaaatacccaagcacaaattgaccgcacgttctctggccccggttcttgccccaagggtggtttgcatggtctcccttccacaaatgactggtttgttggatgcctcaggcaaggtcagtgtacttctttcagatgtgtattggcaaccaccatttttgatcgtggccctttaaaggcgattaaacccaagcgtgttctagagaacccgtggacaaactcagatctacagcgggtgctgccaagacaggtgggaggccatcttctgacaaagttacggaaccgatttaaatttgtgggtgtcaccaagact

SEQ ID NO: 690601 - DNA, 1025 bp, Homo sapiens
  misc_feature (11)..(11): n is a, c, g, or t
gcacaacacanactcacccacaaaacccaaacaaaaaaacacaacccacacccacaaatcccccccaaactggaacgtttgcgagagaaggataagcaccattgaagaagtgcggaaggaccaagaatccaaagagcctgctgacgagactgaagctgactaattcgttctgagaactgactttctccccatccccttcctaaatatccaaagactgtactggccaggtgtccatattaattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctaacttcagtacaccttggtgtactgggttaatggctagtactgtattggctctgtgaaaacatatttgtgaaaagagtatgtagtggcttcttttgaactgttagatgctgaaatatctgttcacttttcaatcccaattctgtcccaatcttaccagatgctactggacttgaatggttaataaaactgcacagtgctgttggtggcagtgacttctttgagttaggttaataaatcaaggcatagagccctcctggttgatacttggttccagatgggggcctttgggggctggtagaaaatacccaagcacaaattgaccgcacgttctctggccccggttcttgccccaagggtggtttgcatggtctcccttccacaaatgactggtttgttggatgcctcaggcaaggtcagtgtacttctttcagatgtgtattggcaaccaccatttttgatcgtggccctttaaaggcgattaaacccaagcgtgttctagagaacccgtggacaaactcagatctacagcgggtgctgccaagacaggtgggaggccatcttctgacaaagttacggaaccgatttaaatttgtgggtgtcaccaagact

SEQ ID NO: 690602 - DNA, 505 bp, Homo sapiens
gagagtgtggtcaggcggctcggactgagcaggacccatcccaatcttaccagatgctactggacttgaatggttaataaaactgcacagtgctgttggtggcagtgacttctttgagttaggttaataaatcaaggcatagagccctcctggttgatacttggttccagatgggggcctttgggggctggtagaaaatacccaagcacaaattgaccgcacgttctctggccccggttcttgccccaagggtggtttgcatggtctcccttccacaaatgactggtttgttggatgcctcaggcaaggtcagtgtacttctttcagatgtgtattggcaaccaccatttttgatcgtggccctttaaaggcgattaaacccaagcgtgttctagagaacccgtggacaaactcagatctacagcgggtgctgccaagacaggtgggaggccatcttctgacaaagttacggaaccgatttaaatttgtgggtgtcaccaagact

SEQ ID NO: 690603 - DNA, 393 bp, Homo sapiens
  misc_feature (225)..(225): n is a, c, g, or t
  misc_feature (328)..(328): n is a, c, g, or t
  misc_feature (350)..(350): n is a, c, g, or t
  misc_feature (393)..(393): n is a, c, g, or t
gcagagtgagattctgtttcaaaagaaaacaaaacaacaacgaaagttactgggtctgtcgccaccatctgaaacagtggtccatgtgcttgacaattcctgataggatctatggaagcttctttgctcttcagaaaataagaagaaatgaaatgggattctcaaacattaagtcacagcagattttttggttctccagcaggctatattatggcccaacttggnaaactgtacttatttatctttctttttaatttttctcagcttctgttctgctctaactcaggcacattttaaaactgatgggtggccaggcacggtggctcangccctgtaaatcccaacacttnggggaggctaaagttgggaaggattcacgaggtcaggagttcn

SEQ ID NO: 690604 - DNA, 349 bp, Homo sapiens
aagtgctatcgagcttatgaaccacagttgtgccagtggctttcctctacaggcattcccctttttttccttgccctgccgtaaattgtgtctgggcacttattcgtttctcatatctactagtgggcatctgctaggcctttaatccctgtcgacactcacccctgtgtgaatttttctccccgaaacaatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaa

SEQ ID NO: 690605 - DNA, 292 bp, Homo sapiens
tgatctagcagatcctataggctgttggagttgaatgccatgatcttggtcactgcaacctctgcctcccaggttcaagcgattctcctgactcagcctcccgattagctgggactacaggcacccaccaccacgcccagctaatttttgtatctttagatagagacagggtttcaccatagttggtcaggctggtctcgaactcctgatctcaggtgatccacccacctcggccttccaaagtgctgggattacaggcatgagccactgtgcccggctgttgcaactccaa

SEQ ID NO: 690606 - DNA, 551 bp, Homo sapiens
aatgccatgccagcgtatagaacccttaatgtttccacttctggaagttacgtcaaccttcattactcatggtttgtacttaaggtttagatctaagctacgacaacagcataccatattttcatcatcattactcttttaaaaatttgccttcattccagtttcagggagttggggcaaggcctgtgatattggtgtcttgaaaatatctcagtggtctgtcagatatgaggttgatccaattttaataatagttttttctacttcctgatctttaatgggttgaaattatctgggcttgtactggtagtgtagtcataataatttttgaatggtaggtgctcaagagagaaaacagacacaaagtgttctgtatgggttctatattattccccgggaatgatgtgtttaacaagttttcttttaaactatcaactacataagttttgtgcagggggggtgtcttagcatgtgcgttacaactataagtagtacacatacatgtcttctatattcatttagaaagatcatatcttaaattttttttcatt

SEQ ID NO: 690607 - DNA, 405 bp, Homo sapiens
tatcactgtttaacagatgagcaaagtaaactgaggtgcagagaggggcaatagctggtggcccagctgataggctgagattttcacatgtcagtcagagccagggaccaacatctatccactattctctgctgtcctctctcagagcgccccttctttggaaatgtgcatagcacctttctacaagagactcttagtgtgttctgagaaagccgtagctcctcacctgcctcagaagggcacggtgcttgcttcttcagaaaatttacagacaagtttcacacacttaaaactttcagcttggcttgagagttaaaacataaccactccaaactgtaatacaaagaagtctgctcaaaagagtagcatttgaccagcctggacaacagagcaagactccgtctc

SEQ ID NO: 690608 - DNA, 291 bp, Homo sapiens
tgaaaacagcttttctgagggaatatgcaacttggagaggtaactgataactgatactgggtcccgaggaggtccaagagcaaagtatgcggatgaatggataatcttttcagagaccttgagagtgaagaaaaggctgagaattcaagctgaaaagctggctgcattatagaggtgaaacatgatgagaccatgactcgaatggtcgctcgttacgatgtgaccgacctgaccaagatagagatgaggtcggccctgagcacacaatgcgaacagggatcgtaaagggac

SEQ ID NO: 690609 - DNA, 171 bp, Homo sapiens
agaacccccgagaacgtgaaaaacaactaagagcatcaagaagccctatagatttagctaaacatccatgtaatgcctcaatgggatcagctttttttgaaatcagttggtagttggaaaaactatatactattttatttgacgtaaacctgaataaaattttagtgaaga

SEQ ID NO: 690610 - DNA, 354 bp, Homo sapiens
gctcatcactgtatatgccttagccatggtgtagataaagtattttaggcagatgtacacagatagtctctattatcttatggatatgccatgatcaagctgatgtgaacatttcgagatacagtttgtgaacggaactgctcttgcaatccaagtttccaactaaatttcagagtgtttccaactaaaaatgttgagtgtttacttgtctttttttactttacagcagtagctgtgttttctttggcctctcttttgagtttttccttctcttctctttctcatttcaagttgcttcttaacagacaaaagttcagctttgagattggatagttcaatctccaaagatgctct

SEQ ID NO: 690611 - DNA, 129 bp, Homo sapiens
tctcccacctgtgtgctccaaaggaactacctattcagtgcccagtatgtacagccctcttgtatagcatcccgactcacctcgctcttcgtcagaagatgacaccaacctcgtgttacagcacacagg

SEQ ID NO: 690612 - DNA, 430 bp, Homo sapiens
  misc_feature (21)..(21): n is a, c, g, or t
atgggtgctccatcccccggnaaaagaaagaaatcccattttctgaggagaatttcaagctggctgtagagatttggcataagtaacaaggagctgaatgttaatcaccaagacaatggggaaaatgtctccagggcatgtcagagatctttgggggaggcccttccattaacagattcagagggctattgaagggaaaacgggggtttagtgggcttggggccaaagggtccctggtggcttggggttggtttggtccccccctggcattcccccaaggccaacttccaagccggaactggaaagggggttccaaccattaggaaggcttcggggcccgtaagcctttcaaggaaggggtgccaatgccatcaaaggccctttgggcaaggctttccaacaattgggtggtttggaagccctgcagaag

SEQ ID NO: 690613 - DNA, 161 bp, Homo sapiens
tccttccatctctggtcacagacacccactgaaatggtacagagcctaatcagcacatcatacatggattaacctatctgcccatggacgatacccagatgccccaggggcctacagtactagtataccacaggtaaagtatctttgagagcctagagtgg

SEQ ID NO: 690614 - DNA, 939 bp, Homo sapiens
cttacatcatctggtggacagctgcctgccagctgctctccaggcctcttcggcctctatttccaccagcacctggcagcctcttagcaggaaggcactaggctctagtgtctgattcctgcccaccaggattgggactgttccctgtgtgtgtgccttggtgcccctagatgacataagggttggtgtggggactccctaccatctctctcacttcagtgcctagatcataaaccccttgaagcaatctcccctgggccatgatccccaagtgtgtgtgtgtggagggggcacgttttacagaaatatcccagagactgggggatgagcaggggagacctggatagtgagaggggcctgggagagagtggaaacctcaagatcagaggtggctaggagagctaggggtgggactctggcccagcatccatatagccccggcatctgtcagtatccccaggagggagagacagtagtctccatgcctgtctccccagcacacttggggaagctgaggtaagagggttagcctagactagtaacaagactatgtaaaacaagaagaaaaagggggccgggggaagcttgaaagggaagagagggaagaggttgtcaccatcctccaaagctgtgaggatgactgctgtgttttgaggtcttggtgactaagggtccctccaactccaagtatttttgctatgacttagtgtgttacgtgtgtatttatgagatatgtgtgacttctacatatgttaaatgtgttttggataaaagggggtcttggaaaaaaaaaaaaagatctctaaaaaatgaaaaaaaagaaagggggggcataatcacggggcaacgcttttaaagggtaagagaaaaagggggcaaggggaaaagtttacattgggtgaccaaacggaattgggggtgtgtaaaaagtatgcctat

SEQ ID NO: 690615 - DNA, 124 bp, Homo sapiens
ccggcgataccgcatgtgggtctcagttgagttcaactcatcatgcctgggcatttacttgatgagaaaactaatcagcccaattgggggattcacagaggcttggttagtgagcaggagccag

SEQ ID NO: 690616 - DNA, 411 bp, Homo sapiens
tccgtgagactcatcgtgccatctatgggatatacggaggagctggcaggcagcgtgcatgcgctggctttgcacacgtataccctgaaagaatgggaaggcttacaggatacggtgccagcttcaccgccgatgtcgcggcgcgggcaccatggcctgacagtcgcgatctgattcacaaaaggcataaatatcggcatttgacgcggtaacactggaactttccttgccagatgcggtattagtagatgcgaatttcaagaaacggcctgcgggccgtttttgtttttcttctgacggactgacggcacgaggtttatgcctctgaatgaccgcatttttcgaaggatcgagtcccgtgtgagtttccctcccgcgcaacagagaccgtcctcgactcaatgcgtatgc

SEQ ID NO: 690617 - DNA, 216 bp, Homo sapiens
gttggcagcccaggtgacgcatcaaggattgtaggtattaaaatatgtgttcacgggatgcacctatagtgtgtaccccgtaagcatgaaaccagtgttttatgttttcttttattagttcttattccggagcctcaaacaagcattataccttctggtgattaatgatttcctcctcctataattattcctagtagcactccacactgcatctta

SEQ ID NO: 690618 - DNA, 101 bp, Homo sapiens
aggacacttaatgcgccacgattggagaatacttatgcttcatagtattggagcacatgttactagcttcatttaggagcttgtggagttgatgactttct

SEQ ID NO: 690619 - DNA, 170 bp, Homo sapiens
ttggggctcagtcagtggatgggaaacagacaacttaatagtgggtcgtccaaacaggggggggggggggtaggccctgacgaagaaaaataaagcagagtaaggggacagagagtaagggggtggaagttattcctttctgatgaagcatctttaggacaatgaactga

SEQ ID NO: 690620 - DNA, 642 bp, Homo sapiens
  misc_feature (341)..(341): n is a, c, g, or t
aggaggcttgggtgggaggattgcctgagaccaggaggttgaggctgcagtgagccgtgatttcaccaccactccagcctgggtgagaaagcaagaccctatatcaatgaaaaaaaaaaaaaaaagaccacgctttgtgcagccagaagccagaggtatacccagggaacagttagggcctcccaggtgtggcttggtttctacagcacacctttccagtgaattcgtgctgtgctgcgtgcctctcagtgttgttggtgtgcgccactcgtgtgctgtgtgtgtgtgacacaaacccacaagggcgctgtggtcacacacagcgcttctcctctcaaggnccccccagaacaggggcgagtgtgtctcaggagaagagaacatttatagttccatttgtgcctgtgcagaatttttctttcttcctgtgcaagggattcctgcgggggacttcaggctcacagaaacaaagggcttaaaccagggattctctactaaagacgagggcgcttattaaatctcccttcttgccagacgcaggggacgcagaggactttgccggagcaattgtttctggggggctacacggactcggggggcgcaggggacggcagaagtgctccggcttgaaggcagtcttgt

SEQ ID NO: 690621 - DNA, 268 bp, Homo sapiens
  misc_feature (44)..(44): n is a, c, g, or t
  misc_feature (55)..(55): n is a, c, g, or t
  misc_feature (144)..(144): n is a, c, g, or t
  misc_feature (148)..(148): n is a, c, g, or t
  misc_feature (179)..(179): n is a, c, g, or t
  misc_feature (191)..(191): n is a, c, g, or t
  misc_feature (210)..(210): n is a, c, g, or t
  misc_feature (215)..(215): n is a, c, g, or t
  misc_feature (230)..(230): n is a, c, g, or t
  misc_feature (255)..(255): n is a, c, g, or t
cagcttatttttggggggggggaaattttatttgttttcttccnttgggtccttnggcttaaagggactttttaatgaacccgggtttcccaccccaaaaagaattaaggattttttttccaagtaagagtcaaataatttgcncccngcttatgagggcaatgggggcccctaaactnttgatgaaaganctttaaaaaaaaatgtaanccccnaattccctttggatnttttagccaaaggaataaactggcnatttttcccgata

SEQ ID NO: 690622 - DNA, 1293 bp, Homo sapiens
ttttttttttttataacgaaacaaaatttatatgttatatatttttaaaaatacatcttatagattaaaggacttcaagaaacaatagcaagacgtggtaaaacgttgccacatcagggtgacacttgggccagagttagtggaaaagtgctgacaaaacaagaattgtgccagcagtgggcaaagatatacgtgttaccaacccaactgggttaacaatatctaatcatgtgagctacattcagaaggtagctttttgttttttttgtttattttttgtggagagacacagagagagttcctcctatcctctgtggtgcgcccagaggccggaggagcgtgcagagtggtgtgtgtgacaccctcgaggcgtccacgtgggaacacctctcgtgtgcgtggccgcgggtgtttccagaggcgatatctcgtgtggtgcgccctcagaccctctcgcggggagatatgtcacgaggcggccctgtggcacaaacacaaaaggcgcgcggggtataaaaattattgtggtggacacattatgagggggagacgaaagaaagcggggggtattaccccccgaaggggagcgccacagggggggagccacgagaacacaccccggaaacccttagagtgcgcacacaggcgcggggcccctcgaacacctcccacaagagggccggggggaaattaacacgagcgcgcagtgaaacacccagtgtgtgtgccccaagaaccaacgcagagtatacaaaataaaaaaaaatcgggggagaaagaaaaaatccccttgggaaattctataaaccttcgtgtataaagaggacacaacaacaagggggggggagaaaaaaataagaggggagcaccccacttataaaaaataacgcccggcacgttaaaagagacgaccacgaaaatacaaccagaggggaccacccgtggttaaccacaacgacattaagaaaaaccacccaagaagggttatactcacccagcgcgagagaaacaaactcactctcaggaaacccgcggttgtataacgcacccaaatgaactcccgggagagagcaaaggcgttcacagagggcgccacacacagagagaggcccaacaacaaaacagcccccgccgtattcccccaagagaggggcaccaaacaaataaagatctcacccaaaatgagagggggaccacaggtaataaacacaaaaccttcaacaacagcgagaactacaacaaaaactcgcgggaaaatacaagacagacaaaacaataccgggcaggaccacc

SEQ ID NO: 690623 - DNA, 132 bp, Homo sapiens
ccagtgatctataggatccccccggtaggtagctggaagggccgctctagtgcatcacttgctgctgagcctttcctcgctggccttgagccgtcctccaccagcccctggagctgctccagctctttgttc

SEQ ID NO: 690624 - DNA, 226 bp, Homo sapiens
gggcgactctacaggatcttatgggcactcgtcacagcgctacgctcggtatgatttttacctgagtaggcctagaaataaacatgctagcttttattccagttctaaccaaaaaaataaccctcgttccacagaagctgccatcgagtatttccctcacgccagcaaccgcattcataattcttctaataagctatacctcttcaacaatattacttctccggaa

SEQ ID NO: 690625 - DNA, 541 bp, Homo sapiens
tcctcacatctctatcagtaggtccaattatgattcttctcagttttacgagaaacgtggccgaataacatgtctagtcactaactatttaccttaatagaaaacagtgctattggtctgattgccatgccagcatcatattttatctgtgaagggtggcttggttgtggaaaactataaaaactggatgcaaaagtaaaatgcaaccttgtttggtgacgtccaattcctctggaataaggaaaaaccacttgtgtttaagaacaggagtcaaatcaatttttaaggaaacagattctaatacaaaaacctttactagtaagggtctagtaggtctggacaaaacatctccctctaggtcccactggtagggagagttctataaatcagcttttagactaagtatatggcctatagtcaggatagtaacatgctaggaagtgataaaatttagtcatcactcaaagaatttccattagaaacctgtcttcctgcttttggctccaagagcatcagaatgcacttttatggcctgttggta

SEQ ID NO: 690626 - DNA, 280 bp, Homo sapiens
tgagcagtgatttccttgggaacccatcatagaaaacgggtacttgtgcacatctagaatctggatctgtaacccctgaccatggcccaactggtctaccgtcatgtaccttggtcgagtgtcgtggtcagtctgtgtggtgcacacgaatactaaacactgggtaattagtatataatatggctgggagacagggtccgtccaccaagctcaatgctgtggcagatcatggctgaccacagcctcaagctcacagtctcaggtgatcctgctacctcag

SEQ ID NO: 690627 - DNA, 802 bp, Homo sapiens
gaagtagtgtttctgatcagacttgtaaagagttgctgtagctcagctttgtggagatatctagttgtatgcctgcctgtcccgttatgactagtgaggacttctttggctccaccataggtatgataatccatgggttctgttttaaacttgatggagaagtggcttccctatgaagtgcctctgactccagaattctcctctctattcatgtgtcacgtgtttattttattttataagaggggtcttcgcctaagtcctgggctccaaagttgtattctccatgtttctcacactcccaccaacagtgctgggattaatagtgctgtgagacctaccacgccctggttcatctgttcgtttttcagtggtctccgtgccatcagtcagtcacggtgctatgacatgtttagcgtattgtcatgcaggtttctctttcatggttcgcacgaggaatattgtgtggagcatacctcggatgtgagtaaggagtaccatgtgtattgcacccagctatcccttagaaaagctaatgtgttacgtgctaggttttgaaatactataaagagacagcgtgacgatgggtaaagtatattgacttagcctgtacgtttgtctgtgatctgtgtatgaggacaccagattgtctagaatcaagatggtcaatatggtagggaagagagtaggatttagattgccccaaatttgtaatatactcagtggcttaaaggagtgagggttatttacagacagtagcagtgtgaagagaattgacgtatgtgggggtaatataaggtttata

SEQ ID NO: 690628 - DNA, 194 bp, Homo sapiens
  misc_feature (76)..(76): n is a, c, g, or t
ctactaccctggaccccccaatagtggagggcagtatggtagtgggctacccctggtggtggttatgggggttctnccctggaggtcttatggacaccagctgtgagggcctatggacacccatgctgggatgttccctctggactcaggaggaccatatggcggttcactcccgggttcctatggtcagtcac

SEQ ID NO: 690629 - DNA, 444 bp, Homo sapiens
  misc_feature (30)..(30): n is a, c, g, or t
  misc_feature (157)..(157): n is a, c, g, or t
ctggggagagcttttgtgccaaggttatanagggtttcaggccattccccaacggctccaaacctggtgggccggggttttggcttgggtgaaggaaaagggggtggccctggtccatccagggcaggccctttggaaacagttccaaagtttttgnggctttttgtcagagttttttatgtcctttttccagtcctagggggccccccgggggggcaaggggggggtgaccccccaaaaggggtttgaacccccatcctcaaaatgaagaaattgaaaccccctttgcccttcccgtgacgggggaccccccctgacccctccctaaggtgttttgggccccgccctttcccgcccactcagtccccccgccgggggttcctgccgcagttttgacctgggggggtggcccggggtttttaataaacccgggttttttttcca

SEQ ID NO: 690630 - DNA, 361 bp, Homo sapiens
  misc_feature (43)..(43): n is a, c, g, or t
  misc_feature (49)..(49): n is a, c, g, or t
  misc_feature (52)..(52): n is a, c, g, or t
  misc_feature (54)..(54): n is a, c, g, or t
  misc_feature (68)..(69): n is a, c, g, or t
  misc_feature (77)..(77): n is a, c, g, or t
  misc_feature (79)..(79): n is a, c, g, or t
  misc_feature (98)..(98): n is a, c, g, or t
  misc_feature (102)..(102): n is a, c, g, or t
  misc_feature (212)..(212): n is a, c, g, or t
  misc_feature (307)..(307): n is a, c, g, or t
  misc_feature (311)..(311): n is a, c, g, or t
cagctttccccttggggttcaggggtttttgggttttttttgntgggtntgncnatgctttttggcanncctttccnanaggtgccggtaagggaggnaggncccccccattcagggcaggtcaggttaaggccagttgggtggtcactatgcaatgctgccctggggaggctccctgagggcacagtgggcgctggacccggccccccaanttttttgcctgctgcctgtgaccctgaagaacagaattgatttttgcccctctccctgtgtgagcttggccccgccttttgccccaggcccctgntggngggtctcaccccccacccctcgctttgaataaagcacttgggccccctga

SEQ ID NO: 690631 - DNA, 1506 bp, Homo sapiens
gtgaaggtgttcattgcagaatcacttgttagcccaaatctggaaagctcccattagccaatggcatggttacaagaataatggttcccatgctcaacatcaacatccatttctatttataacactaacaacatcgaaccatgcagcacaaactagtcacatcatgcaatgcacacaacacacacagccagacaagccaacaattgtactcaaatccatctgcatttccctgtgatctctcatatgcactggcaagctaccactaaacagggcacatcccagcaccatgcacacacacccatctctgtcagcaaacaggctggcagctgcgcaatgttttctgcctataaaataaagtattccatttgataatcattgcaagcacccaccaatcaacttcaaccagcaatcgcacgcacataccactggagaacgcatacagcacggcatctactacacgaccctaggcataccaaccatttccatgctcaccgctaggacagctctcctccccaaccactcacctacatgctctgcgggccccccaaatacaaaggcaactacaattacacagaaactacatctgttagcactgctgagcctctagagcactacagaataagacacaacatacacttaacaggtcattgaacagcatccttccacggctagatctctagattgacacctccacaggcgattaaacgccaatcacatttaagttcccatgggaaccaagtggttaattaccacgctgccaccttactggcatccacatccaagcactagtcctatttccataaacttaccacagagacttgcacacaccacaccctgcacttgcgtgacgatacagaacaacctcaacctataacagcgacgaactaggcacagcgcgacacgggaaaaaaagcacccagcgaatactggtcaccactgtcacaaacgcaaacaggacaccactaacgtgacaagcaacgcagctcacacatccgagcaccaaaaacgcaccgtgcacgacgagagaacaccccacatagaaacagtggcaaccaaacatcagaggtataacgtaccagcacacacgcactcacgacagacagaacgcatatcaagcgcacaccccaccaaacacacaacaccaggaaaccacgcaaagcagtcccaccgaactaacctccacaaatcaatctccacgaaggcacacacatcatcacaagagacagcgtaccaaccaccaccatgagtagcaagccacactgtcacatagagacacaccgcgcactcgagtacacacaatcaccagcatgggacggaaacagacgacgagggccaaaactacaaagaccgatcgcacatgtagagaacaataaacaatccatatgacaacgagcagagtacaaatctatcacacgaagcacatgacgaacactacgacgagacaaccgacatcaacactccagaacgttcacgatgactcgatcagacaccctaaatcaactacaa

SEQ ID NO: 690632 - DNA, 798 bp, Homo sapiens
atttgaggcattttaaaaagtcatcagaaggtttaagtttagtgtctcagcagtttcagctacttaaactcaattaaagcatctatcatttaaatttggattggctcacttatttgactgcagatgataaaatcaagctgtcatcttagggaaaaaaaaagaaccaagtttacctacacatccttgccattacccacagagtaagagaagtctggtccagagctaaccttttatgtcattacgttgcttaataaatgtaataaatgtactaaccactcccaaccccaaccgcgagtgtagagtgccctaagagtaaaggaactgtaatgaggacaatctggtatgcaaattcattcaagtgtgttactgagctgtttagcaacaacatatgtcgcaatcaccctcaaaacgcaagctgtacctctggggaggtagccctgctacagcaacatcaagtctgcatggatcaggagctgacctgtggcgacatcattaacccttccctaagctatgccaatgcagaaccctctagctctgtgtaattgctcctgtcagctaaagccacacgttgctagcacccccaaacgcccaggtgctacattattctccattaggtatccttaccacataagaagatgacctgtacatgcaattgtatcttagcagttatccctcgaaaatgaaacactgcagtttctgtacaaactgattctgagccttttggtctcaataatcattagctttcaggggatagaaattgtcagcaatgggaaacgaacatccccagagctcgtttcc

SEQ ID NO: 690633 - DNA, 237 bp, Homo sapiens
  misc_feature (80)..(81): n is a, c, g, or t
  misc_feature (86)..(86): n is a, c, g, or t
  misc_feature (109)..(109): n is a, c, g, or t
  misc_feature (139)..(139): n is a, c, g, or t
  misc_feature (141)..(141): n is a, c, g, or t
  misc_feature (175)..(175): n is a, c, g, or t
gactaacaagcaaagaataaggcacctgctatagaataatagcacaaccatcaaacagaatatagttaaccaagacactnntatanaaagggaaacaagtacagagacngattaactgggtgagaaaggcaagtaacantntagttaaaaacctgctggccaaggtcagttgatncattccttattccagaatagttagttcctgaaagtccttaaccactctgctcccttactgta

SEQ ID NO: 690634 - DNA, 1187 bp, Homo sapiens
agcggactcttgtgtctctatggcgacgtgggcgcggtcggatcttagcttccacggacgtgcgcgtcgcgcactctcagtacctgctgctgtcgggtgcccatgcatggagctgtgtgtgcgcagggtcctgtggcgcgggccgggggtccgttcgtcgttgctgcataacggggcccgtgggtcgagtctttgctgcaggactcctgcttgacccgtgtggattgccagtgccagtaggtgtagcagcgactcgggaggaggcttcttatctcctgtctgctcccttgaagtgccactcggaatcgtgaattgctcgttcaggatagagtcattgccatgaatgagtactttgtctcgtacctgtgggaattgcgttgtgacacccaattcaatcgttgtacctcggagattcgttgttgatccaagcgcgcttgatattccagtcgatagccaaattgagccaatgtttctacgtggagagaatctgagccgtcctaacctacgaatctgggcattaggttaacacacctgcctaatggatccacgaatttgggaactggttcgaaatttccaggattagacgcaaagagtaggactttggcttgttggtggatgcccttttcggtgtacagggattccgggagagatcgacgcaagggcaaagacgcgtatttctgcgacacgaataacgcaagtgagtattcgacgattttggcagaaatttaggtctgattcgtgtttgaccaaagccacagaaaccttagtgcatggagtccttctgtacgaatgacgattgactcgagggccccgtttaaaaaccacgtggccgtttcccaaggtttaagaagccataagggagggccccttccaggacggtccttctggagtccgacgcgggttgcgggcagagtgaactcacttggagacagtaaccaaccggatgggcaaaatgcacatttctactcaactagggacgccagtgtttgactcgttggcgcactatatgattggaccagattctaatgataagttggtcaatattgggggtagatgggcggaatacacaattggggcagctgcgcgtaggcatgtcccattttgtcacaaccgctttgggacaatagagtgatgtgcccatatgaccgccccaaggtttctgatacccgggcctgtgtcctaaaatg

SEQ ID NO: 690635 - DNA, 471 bp, Homo sapiens
tgctgcagacactcgtgttatcagaggagatgacggagagatagctggatcatgtgtcatttcctcatcgtctttggttggaagaggtctcatggcatcattagtcttagcttgatacgtgttcttctttttgtaatcaaggggcacttcgcagacagcttctttcaaactcacagggacctcgctgtggtagggaattccagaagcagcagtctttgcatctttgtagaaacccatttcttggttatttatgacacaataaacattgtgccaggacctgcttgaggctttcttattgtgggcctcccactcgtgtttccgattgaggaagccttccatctgggccgaaggtgtctcctgggttctggctggtaaggtggcggcactctgggctgggagggcagtcttggctttacgatcagaggtcggggaggggatggggctggactctttagagctcgtcctttgttc

SEQ ID NO: 690636 - DNA, 172 bp, Homo sapiens
acacagctggtgtcctgcagacacaccctgagtctgttatccagcctatccattatatgtcctttattattcatgatatcctattcttctacctttttgcctggtcactttttctgaggaccgagtttctgctcctattcgttgcactcttccttttttaatattgttctcc

SEQ ID NO: 690637 - DNA, 1177 bp, Homo sapiens
gggtttggtacgaccggcgcagaataggaatcatggctggctgcgctgttcgtgctgctgggattactgcgctgtctgtggcacccacggagcctccggggctgtcggcacaggtcttcacgtaccgtagaacgaccttggttccaagatactcctcacctgctccttgaatgactagctgctcacagaggtcacagtggtcaccgtcgtggctgaatggggggcgtggtgctgaaggaggactgcgctgcccggtcgagaaaacggagttcagaggtggagctccgaactgactcagatgtggacgatgtactcctgcggtcttctctccccgatgcccagtgggtctacggccatacgatctcagtcgtccacgggtccctcccagagtgaaggctgtgaagtcggtcatagacacatctaagtgagagggcgtgcacgacgggccactgcgtaggtactgaccagttcagaggtcccggtgccacctgtcaccgactgggccctggtacaggatcacctgactctgaggacagaggccctcatgaagcggcttccgcatgagcaaggttctccgtgagtttcctcgcctagggcccgcgttacaggagactacctcattgaggaatccttgaacattgggaggtcgaaccccggccaagtttaccggtgcaacgggtatctcagctccaactgggcttcccgaccagggccatccattcaccgctcccgggattgcgcaagccaacgctgggcggaccccttctgggacccttttgcttgggcattccggtggctggagggttgctgggtaggtcggttcacccatccattcttcactctaccgagacagcgccggaaagccccgacggactgtcctgggattgatcgacgaaggccgggctctgcaacccccctgacatgagtccggctcggggaccagtcctcccagaaactgaagtactagggggaaagacaccgctccggacagcaaggggaacctgcgttccctggaaggcatggtcgggcccctggaggaacggctccccttgcgtccacacggtgttgagtccgggccgccgggagttccacacctccccagtgcttgtaagaatttccagggtcatcaccttcccttcaaagaaaaacgcccaccccacgttaatatcccttagta

SEQ ID NO: 690638 - DNA, 143 bp, Homo sapiens
ttgatggttacactggtgaccgcaccatccatcctgtctgtctcacataagcctggcaactgtgctgccttctccagtttgatcagttactgcccacgctggagaaggcagcacagttaccattctgatgttggagcggccgc

SEQ ID NO: 690639 - DNA, 193 bp, Homo sapiens
ttacggatatcagagtgagagcgagatgacatgtcagaacagtgcgcatctgagaacgcattgtgatcgagcaggtgggagtggcctcaggtgcaggacagctgcgagctgagaggcctcgaagcagcagacatgccgctgtggtagtacaggagtctaagacaagctgtctgacgtgagatcgcctaccgca

SEQ ID NO: 690640 - DNA, 148 bp, Homo sapiens
  misc_feature (5)..(5): n is a, c, g, or t
tcagncaccatggaggatggaaaatcatgattttatcactcgtatcccaaatgcatttttttttttctgagaccgggtatggttctgtcacccaggcggggtggggtgcagttgcaggatcatagctcacggcagcctccaactcctc

SEQ ID NO: 690641 - DNA, 647 bp, Homo sapiens
  misc_feature (418)..(418): n is a, c, g, or t
gctcctctccagcccttctcctgtgtgcctgcctcctgccgccgccagcatgatcagctccatccgccagttcagctcctccatgctcctatgcaatgggctcctccggcctgggggtgcggctcgtcccgtacctcctgccggctgtcttggcgggctgggtgccggctcctgcaggctggcgatcttgctggcggcctggagcatggagcctcgggggtagcagctactccaggctgctacagctttggctctggtggtggctatggcagcagcttctgggggtgtcgatgggctagctggttggagggtgacgaacgtgcattcatgcaggaatcctattaatgaccggtctggtcgtcgcttatcgcgtggacaagggtgcggtgctcgcttggacggaggcgcaagcagcatngagtcgtggaggtgaagtactcctgtgacctggtatccagaggcatgccccgggtggcctctgccctgtgacatactagtcagatagatacgggagcaagttgacgtgagctgcacgaaacaagatcctcataggcagcgtggacaattggccgagatatcctggtaacagattgacgaagtgcccgtctggctgctgagtgagcttccgctagcaagtttgagacaga

SEQ ID NO: 690642 - DNA, 397 bp, Homo sapiens
agctcaaaggagtttgggggtgatgccctcttggtttttgccaacggccagcctttcaacggggatgcctttgaagtgggcaagggtgggcccttcatgccccgttttttcaaaaccccctggggggggttttttcagggaaaacaggccattttttggggcaagggggggggggggtccccttggggcttctcccccccccttccaaacaaaaacctgcctttttcccctggtgatggtgcccggggtccagactcaagtcaaaaccacccctgttttttgcccttgccctggggggggccccccatcctttttttccaacacccctttttcccttccccccttttgcccctcaagtaaagggggcaaaaatggggtccttttgggttaaaagcca

SEQ ID NO: 690643 - DNA, 369 bp, Homo sapiens
tcagagaacactataaacatctctacgcaaataaaccagaaaatctagaagaaatggacaaattcctggacacaaacaccctcccaaaactaaaccaggaagaagtcgaatccctgaacagaccaataacgagttccgaaattgagtcactaattaataacacaccagccaggaaagaaaaaaaaaaaaccggccccgacccggttgcattcccggttgattccaaccaaacaaacaaaagagggtgggacccattcttattgaatccataaaaaaaaaggagggggaggggttccttccttaattcatcgaacgaagcaagattcttcttcaaacaaaattcggggaaacacccagggggaaaaaaaa

SEQ ID NO: 690644 - DNA, 195 bp, Homo sapiens
tccccgggacgctttgcgcaaggaaatcatttgagaaataacaaggggacccccgacccaagatacacactcaggcctaagaggtttgagtttcttgaagagaacctcaggcagcaggccttgaagccactggggctccggaccctgccaacacctaattctgggaggaagactccttatggcgacgagggcatg

SEQ ID NO: 690645 - DNA, 304 bp, Homo sapiens
cgactatagaggaccccacacagcgcgcgaggatcgaggcatcctgtcggacagtcggcaccaggtgaccgccaggcgccaggacccaggcagtctggcgggaggcctgggaagaaggttccctcgggaggagaacagtctttgctgggcccagatccaccagctggaagacttgcggtgacaatcctcagccgagagccaggcgcagcctcggggggcccagcaccgccgctgcatgaaggaggcgttaccgtttatggctgtttagctccttaaactatttcaagacataaataaataacca

SEQ ID NO: 690646 - DNA, 1845 bp, Homo sapiens
  misc_feature (334)..(334): n is a, c, g, or t
  misc_feature (1525)..(1525): n is a, c, g, or t
tacttcccttcttctcgttcccgcacttcttgttcgtttatttattaactgcgcggtgttctcctaaatacaggtgttatactgcacaagttcccactttttggtgtgttgctccgacatatgttttctcgcggaccacccataataagcgggggttcatacactcaccctgtgtgccccaccactttttcatttggactcttataaaagtatttgttctccccttcgtattatttataaaggagggctccctttcttctagctcatgcaccaacaactttttcttttgtgtgtccccacacacctgtaatacgagggttttacatcacccacncttgtatacaaacagtgtttataacaacaacggaaagttttgaataaaactatgttttataatgcgccacacaccgctttcatacttctgggtgaagatgtagtcttccttcatctctgcctaaggaccacattgtctttcctcccatgggggagaaaccttcctcgtcggtggtgtttccttcggtgtatataccgaggtaaagccgccccccgccttcggcgaagcatgttacacaacaggagttgtgtttgttcggccgcgctgtcaccatggtggtaactacaccaccagaggtaaataagtatggggaggaggataactaaatagtttgtggtgggaagaattatcatgggagacttttttttggtgggttgctcttgcctcccctgtagtaataatattagagagattgttgtggtgtttttgtgaaaacaactctggccacatcttcgttggggaggagaccaccccaacttctcagcaggcgttggtgaaaaattagttagttagtttctctccctcccccccttttctcctctccttcgtgtacaccacagcggtgtgtagaaaaaaggggaggacaataattatttgggccaacacgtctgtttcctcggtgtgttctctcatcacggagttcttaaaaagtggggacaaccaccagcggagaagtgttttccccaccagagataggagacacccccctgttccacacagagttttgagttgtcacagcggacacacacccccagcgataacgagcgggcggccctgtgtttcaacacactctcacactctctgtgagaacacacagcacttttgggtagagaacacccttcttcctccctttgtcacacaatattggggggagagacccactactgttgtctctctgtcgctctcacttctctacactaggccccctctgtgtctgctgagagaagtgtgtgagagctttgtctcaccccccctctcttgtggtgtcgtctcaccctctcgcacacacaagtgtctccccggtgagatatagtctcccacacccgcggcacacaagagcacacgcgctttggtgtctccacacgcggtcttgtcgcacacccactctctctgcggtcacacacacgtgtggtcacaaggcgcgccacctctacagggagcgcacacagagagccgcgcacagaggagatntgtgaacacagagagggccgcctttgtgagaagagagcttgtttctacagcccatcatatgcctcataagagacccctcatattctgtgggacgcacactatacacaggcacacccacagagaggagaatataaccggggccacaccctcacagagagctcacacacacacatccccggaccacacaatgagaaggctgtaaggagaggttttttaacacttaagatcccagagatgtgccaccttccaatcccggaatggtcgggacattcccttccagatttctcacaaaaatataattttcccctcccgggtttgta

SEQ ID NO: 690647 - DNA, 272 bp, Homo sapiens
atcagctcggaccgggtcagtacggattgtatgtcatggcagctcctcgacagtgaagattacagtttcatggctgtggaccaggaagaaactgtgctgtcagggacaatgtatcaagattaggagccccacccagtattggaggctgagtgagactagatcttaatagtgtccattgtcggatgctgccagacacaggtttcgccagtatatcctggtcctttctctcaccgttatcaggcaacacaataactgcggcccgcacattccgt

SEQ ID NO: 690648 - DNA, 760 bp, Homo sapiens
cctttaccaaacaggctgagggctgaaagatcccatctttctcattgtaaactacaattataattcctgtaaaacttgatgtgacaatggaaagaaattaggtttataaatctcactactctcggaaccagagaacggcacagaactggtaataacaattacttaaatggggtgggggaggatcttgacatgaggaacctctacttgcctttgtgcccttagacccgaactattacagttcccacctacatgtctgcttttaagatgctgcgttgagactctctacctgattcccactgatatcatgctcgatgttgcctacagctacattatgacagcaacctcccagacaatagctagtatgtataatgctcccatgtccccacagccacaccacagatctcatataccatgggctgactatacattctaaacctattttatgtaattgcgaatctgtaccatctgtctgctgcctattaaataaaactacactccctttaaattttgatttcctctgaaatctggcaaaatcttaccctgtgactttatttcttatgactactcagtacgaatttttggcttcatccagggatcttaaccttagacatataatgaacttcagtcttctcaatgcctttggtcatggggagattccttgctaaaacgctgcatatagcattggttataaagaatggatgcatgggtcctgtattatgagtaataaaagaaccctgagggccaaaaacacatttccttt

SEQ ID NO: 690649 - DNA, 1062 bp, Homo sapiens
  misc_feature (292)..(292): n is a, c, g, or t
gggcaaccgttacagtcacaatcaagagtcccggacgatccgtgatgttacaaggattgagcgattcgtgtgcccactcccaaattcggggactggggctgtgacgatgccttgtgacgcctcggcagtgcttcgcgaggcctggttgggtccgcttggcggcttacggcgggctggcttggcgtgcgtcgctggagacttgatccgtggacagggtgactgatttgccggtcgggccgtccttattgctggccaggtctgggctgcgaggggcaagactggtcatctgccnatggcgtcatggccgcgaggctcctggagcgcgctgtactaagtccagttcatcgagtccaatcgcccgtggcatgtgaaaatcttgtcccgtggcaagatgtagctaacgagcgtaggcgcttgtacgcacaggcccttctcggacggtatccattcgtgagtttcgacatgcagggagtgcaggaccggacgtagtcaatcgtaagtgcgaagggtgggatggagaagacattcccaagaatcgtactcgtactccactccaatgatggcctaacagggatctactcaaaggaattggaggccaatagcctttggagacccacttcaaaatgtgatcgccgcacgcaagatactcgttatagaactccaactcctgaacacggacaactttggcgaggactcggaaacgaactagaggtggaacaatcgcgcattgagaccaggaatggatcataaagggatacccaagacgtcccagaggggggtatcgcttgactttctagacacaaagacaggaaaccgagcagggactgttgcaggggttcccaatcaatttcgtcgatattaccagttgggaaaggcaccaggccatccttatatacaggcgaacaggtcctcgcaccagtacaagaggcactaggtgaaaccaggccattgacttgtggtagtaggttaccccacaagatcgcagaaggcgctttctagatcgcacaggttgtagccctaacggaatctagggaagcaattccctcgtcaagagtaacaacg

SEQ ID NO: 690650 - DNA, 315 bp, Homo sapiens
  misc_feature (315)..(315): n is a, c, g, or t
ctgtaggaatactgcacgcgcggacctgtgacacagaatctacactaccccgtgttgtgtcgcgtggcatatctcctgcgttgcaaggcctgctgtctggtccctgtgttcctgtgtgtggatccccaaggagagactggccaacacccaaactgggtgagttcggctttaagctataccggcagagtgggacacacaagccaacagaaccaatatcttcttcttcccagagaggataggttcaggctttggaatggttttcctggggaccaaaggttacactcaacatgaaatactggaggggctgattcctcn

SEQ ID NO: 690651 - DNA, 486 bp, Homo sapiens
atcataaaatccatacctgacttccccttcccataggggcactctctctcttctgaatgccaaagcatgtgtactgttgcatagacttcagcaaatagttgatccctatgtatcccggattaaaccgcaagcttccccagagaaagacatcccactctctactctactaggcactaagaactgaactcaacaactattaggaattaatacgctgtgataggatatcagccaatcatgccaaccatcactgacaccaagagtagggcacctgcttaataaagtggccaatggattcatatctcggataaacgggatagtatagcatcttatcaggagatgccagctggtctaaaatgcgaaacaaaccctatcgctgcaaaagtacgcccttccaggtcccggggggcccaagtactagtagtgcgcgaaaaaacacaacccaccaccccaccccaacaacaaacacaaccaaaaacccaaacaccc

SEQ ID NO: 690652 - DNA, 341 bp, Homo sapiens
tcggtcatgagtagctgatgtctataatactatatgggataggggtgatgtgtgcttgtagtagaagtggctaggcattttaatcttagagcggaagctatgatcactgcgccgctcataagtggatgccatgggtaggtttatagatagttggggggttggtgtaaatgagtgagggaggagtccgaggaggttagttggtggcataaaaattgattaagggtactagtataagagatcaggttcgtcctttagttgttgggtattgggtatcattttgtttttgagggtaagttttgattaagtcaattgatgggccaacagccagtgtatttgaaccc

SEQ ID NO: 690653 - DNA, 1099 bp, Homo sapiens
gcgcgtcgccccgcgagcacagagcctcgcctttgccgatccgccgccgtccacacccgccgccagctcaccatggatgatgatatcgccgcgctcgtcagtcgacaacggctccgagcatgtgcaaggccaggcttcgctgggcgacagatgccccccgggccgtcttcccactccatcgtggggcgccccagtgcaaccagggcagtgatggtgggcatgggtcagaaggattcctatgtgggcgacgaggcccagagcaagagaggcatcctcaccctgaagtaccccatcgagcacggcatcgtacaaccaactgggacgacatggagaaaatctggcaacaaagcttctacaatgagctgagtgtggctcccgaggagcaccccgatgctgctgcacgaggacccacctgaaaccccaaggccaaacgcgagaagatgcaccagatcatgtatgagaccttcaaaaacccagacatgtacgttgctatccaggactgtgctatacctgtacgcctctggaccgtaccatggaatcgtgatggactccaggtgacggggtcacacaactgtgcccatctacgaggggtatgacctaccacatgccatcctgcgtctggactggctggccggaactgactgatacctcatgaagatcctcacgagcgcgatacagattcacaccaaggccgagcgggaacatagtgcgtgacattaacgagaaagtagtgaaagtacgccctggacattaggcaaaaaatggcacggatggttacagttcttcctggaaagagtaaaagtggattgaaggcacggaatacacatgggcatgacggcccgtgcatgaggacgattaaaggatacctccgggaaaggtagtcactggaaccgaggaaatcattaagaacacaaaggttcgagaaacgaagaccgcagcacagagacgtgagggcaccgagacaggcagagaacagttaaaatgacatgtctaacaaaataaaacgatgatcggaacaagcgcgaacacgacggtcccgggagggagagaaccctgccacgatcattaccctgtcttgctatcgctttggagaaatagt

SEQ ID NO: 690654 - DNA, 651 bp, Homo sapiens
  misc_feature (45)..(45): n is a, c, g, or t
  misc_feature (109)..(109): n is a, c, g, or t
  misc_feature (122)..(122): n is a, c, g, or t
caatcggccaattttctctgggtcctaagataaaaccactcagcntatgaaacaccatgggtgtgtgcacatacactgtccagcatgaacgcatctcagatcgggttcntttgtcccgctcntcgccccaccacagccaccctatattcgtctctttggggtggggccaacctgctcaaggtatggaccctggctaactgcaagctgaagacccaccccattggccacacaggctatatgaacacggtgactgtctctccaaatggatccctctgtgcttttggaggcaaggatggccagcccatgttatgggttttcaacgaaggcaaccccctttacacgctagatggtggggacatcatcaacgccctgtgcttcagccctaaccgatattggttgtgtgctgccccaggccccagcatcaagatttgggttttaaagggaaagatcattgtagatgaattgaagcaaaaagttttcagtaccagcagcaaggcagaccccccccagggcccccccctggcctggtttgttgatggccaaactttgtttgctggctacacggacaacctggggcgagtggggcaggtgcccattggcccccgctaaaagtttatggcagagctttccaaataaaaaaaaaaactggca

SEQ ID NO: 690655 - DNA, 354 bp, Homo sapiens
gccgaatgccatttgattttgaagctcgtgggtccccactcaccctctgccaggagctaagtaaggcaggagagctgacttgggactcctggctcggccgcaagaggagcccccttcgcaccagtcttcggcaggctgaccacctcatccattctccaaggcggctgtgcgttcttttgtgtgttttctgtgttcttagcctccacgctcctcctgccacccttgtggactgggaccaggtcctgaccccagtcaggaagtgatgatatgtacagtgggacaccttgaccagtcagtaattttgactgttgtgaaagggatgtgatttagaattaaacagatggttttacatta

SEQ ID NO: 690656 - DNA, 304 bp, Homo sapiens
gaggctccttgttcactgttgtctggccatcttgcagagctgagtcagctgcatctcctcctctgggaagctgcttggatatcctcaagcccacagagctagcttgtctcaacatcaggcatttgaccaccggcaaaacacccctactagcagtgccaggctcatacaggcctctagatggcgatggtctaggcgagtccttcaaccaacaatgcattcacagacaatgcggtgcccatggactctctatggtctcctcggaaggggctgggatggcctgtccccaaaggaggctcacacagtg

SEQ ID NO: 690657 - DNA, 348 bp, Homo sapiens
gggttgaccataagcctggaactcagagtcaatctgtccagttgatgtgttcagcaacactgctggaaactcatttatctccggcctatggtggtgcttcccatcattccagcatgtcgattcaaactcaatggcaattgagtagtcaaccaactgcttgaattagcttcttccgagatttccatttgctggcgcaattgcctttctcctaattaatccaagtccagctccgaagtcgtcacttcactgcggtccgttcaaaaagcccgcgaggctgaggcgcggatgttgttgacagctgtgtctaaggaggagacaccctgtgctccgcgcccgtcttcttttccg

SEQ ID NO: 690658 - DNA, 278 bp, Homo sapiens
gtacaggagtgtgtatgaccaggtagatgtgaactacgccgtagaagaacaagcctcaggttcgatcaccgccagcgtcggtatagcccagagtgccggtttgatcctgggtggttccatcacgcagaacaacttcctgggataccggtaaccgatgtgtccatcggcctgacccgcagcgaataccagagaccgatacaacttcggctataccgacccctactggactgcagacggtgtgagcctggtgctactacgccttctaccgcaccaccgaa

SEQ ID NO: 690659 - DNA, 554 bp, Homo sapiens
ttttctcattctttcctttgtcttgatctattgtcaattcgaataaaactgccagacttaaaatactcactatcgtgctaaaacaaacagtttagattgtacataactttcatcggtaactcagctgtctccttaaggattgtgttagatataagactgtttgcagtccttttttcagagcaaatcctaacaggtacttgtgaattgttttaaaaatagaaaattacagaaatcttaatttggggtgggagcttaaagggagaaaaacaaaacaggaccaaagtttatgtgccttcttcagtagtcttaattgaccttttcctatttgagactaaggtagcactggtattttggttttcaggaaatatctactatatagattaagagactattgtccctcaaactggtcatacaagtgactagttatgactgagttaaaaagtcagctacacttatgccttcagcattatgtgttaccagttgaagagcagaactgctctcggtctttatggtagtcaccgtagctttcgcagcttgtcaggggccttggtgtt

SEQ ID NO: 690660 - DNA, 794 bp, Homo sapiens
ggcatttaatacaatttttgtgcatgaacagacagactcagaacaaagcctctgagtatattgccatccagcttggatgaggatataagtctcttaatccccaacttatcttgttttctaacacaagcaatatatggggaattatgcttaagaggctgtgccactttgtatttaaaaacccaactctgttttttagactccttgttccttaagttggttatgtgttaggtgaccttgctagttccctaatttttccaagtttccattttctcaccaataaatcgagactaattaataatgacacattaatttgaggtctaaatgagaaaatctacacaaggcttttagcacactgcctgacacatagaaagtgttttctaaatgctagctattatttttatggcataattctgtcatagatccaaaaagacttttttatttttaaaaaatcatagtcgcatttttttaattattacttttcttctctttgaagtcaatcctctcaacacagcttgagaattgcaatgaatttggggatctgagaaacaatcttttctaaatatttgtatgttatttggaaacaattacagtggcaaaagagaacaagaggctaccttttagtatcaatctatctgtacacttaaaaaaaaaaaaaagcagcccatgacaagtacatgctgatttttaagaagaggtgaggtaaaagtggtacagctttattaagtacaagaacttaacaatcccttttattaaacagaacttgaatttgtattacactgaatttatagatcaat

SEQ ID NO: 690661 - DNA, 167 bp, Homo sapiens
cgacaacatcgatgtacatctatttctatgaattcaactttttttttccttagattccacatataagtgatatcatgcagtatttgtcttattccatttggtatatttcacttagcataataccctccaggttcatctatgttgctatcgctggcctacagcacatg

SEQ ID NO: 690662 - DNA, 180 bp, Homo sapiens
  misc_feature (51)..(51): n is a, c, g, or t
gcatcatcattgacatccctatcaatgtctacgctgctggcagaggactgnccatttggagctgagatgtgtaagctggtgcctttaatacagaaagcctccgtgggaatcactgtctgagtcttgtgtctagtattgacagatatagctttgttcttggagtagaattaaggaattgcg

SEQ ID NO: 690663 - DNA, 834 bp, Homo sapiens
  misc_feature (137)..(137): n is a, c, g, or t
  misc_feature (288)..(288): n is a, c, g, or t
  misc_feature (303)..(303): n is a, c, g, or t
  misc_feature (311)..(311): n is a, c, g, or t
  misc_feature (317)..(317): n is a, c, g, or t
  misc_feature (359)..(359): n is a, c, g, or t
  misc_feature (364)..(364): n is a, c, g, or t
  misc_feature (390)..(390): n is a, c, g, or t
  misc_feature (398)..(399): n is a, c, g, or t
  misc_feature (428)..(429): n is a, c, g, or t
  misc_feature (431)..(431): n is a, c, g, or t
  misc_feature (445)..(445): n is a, c, g, or t
  misc_feature (448)..(448): n is a, c, g, or t
  misc_feature (462)..(463): n is a, c, g, or t
  misc_feature (480)..(480): n is a, c, g, or t
  misc_feature (506)..(506): n is a, c, g, or t
agcggggtaggtgctaccagcatctggtgggaaggcaccgggggtgcttttaaacatttcacaatgcataggacagctgaggccaaaaaaaaaaaaaaaattatccagcctaaaatgtcagtggtaacaggggtganaacccctggtattaaatgaaagatagcaaaaaccccataagaaccccataagatatggtaggatctcattggtacgtccggtatttactcgggcaaccctacccccaggggacattgggcaatgtcgggggtggtaactgcggatggggtngtgtgtgtgtgtgtncttttttncttttnacgcacccaattaagccatagaatcgcattagaaaaagggtntgganggtcacatacctaagtcatgtggggntagggagnnggtcatcccttttactctaaataccttcnngnagggtttcataatnggngaagttaattatannctgaagtgaatatatcngtgtatacacacacacacagaaagcntgcctatcaaaacaatagatttttcacaatgtgaacacccccatggatgggctccgtgatgaagatgatgaactggcagtgttccattgaggcccttgggaggcctggcaagctctcccttcagagggcgggaggggagctgctgcctgacttccaacctggtgtgggctcacatgaaccgattttgccgaggcccgtgagaaggggttccctcagcaaggtgtggttcctctggggtcggacgggggggcgtcccggtgggataccccggtttgtcccgggtgaatggggtccctggggaaaaaagggtgactccccttggattgcg

SEQ ID NO: 690664 - DNA, 392 bp, Homo sapiens
  misc_feature (325)..(325): n is a, c, g, or t
  misc_feature (329)..(329): n is a, c, g, or t
tggcacagggtcttgctctattaacccaggctagagtgcagtggcatgatcacagctcactgtagccatgactgcccaggctcaagtgatcctccccaattcagcttcccaagtagctgggactacaggtgtgcaccagaatccctggctaaattttttgttgttgttttttgtagagacaggatctcgctatattgcccaggctgatctcgagctcctggccttaagcaatcctcccaccttggccacccaaagtactgggattacaggcaggagccaatgcactcagctcagtttttttttttttttgggggggggggtccancggnattatttatttttttagaacatcggtttggaaaactgtttaaatcttttaaaaaccttaactt

SEQ ID NO: 690665 - DNA, 324 bp, Homo sapiens
tgactacggattggcacagctcctgttccctattacttaaacttgagattcgatagaaaatataacctataagttgctatcagcttccatttcaaaaggggagtaggagtcaaggtggtagcgtttaattataccaaccaccccccaaaaaaacaaacaaaacaaacaaaaaaacctttactagtcactaagcatccaggaaacaaaggtgaacttttacacctttcagagcaaggcaggcagctccttatggagaattctagaatttgttagatcaaataattgtttagagaaggatgacatcacccatacgaatagtcctgt

SEQ ID NO: 690666 - DNA, 486 bp, Homo sapiens
cgctacataatgttcagcaagaaggtgtgtcaaaggcaaacacagatcaccttctgttcagaaagctcaatcttaaaggagtcctatgtcagaaaaccacttgtagagatatatccttgtattacggacttcaaagaactgatcatacagaaaagatttttgaaaaagtaaattagagtaatgtaaaaacgtcttttccagcaagagctggacatataggctgtcctcactgagcacattattattggctggttttacatgtaactatggatcatattttatcacagccacatctcagtccagcacgctgtgtggaccacataggtcgagtgcttgtggaccccaatgcacaattttgtacgtgtatggggtcaagacttgggatcacaaacagacaggatggtggacgtggactactcctacttcctggctcctaaacgtcttcaaacctgcctggacaaccttgttgaaatggtcgccaatccg

SEQ ID NO: 690667 - DNA, 127 bp, Homo sapiens
ttcccccggcctttgggttttttaaggggcccccccccctttgggtttcccaatttttcggttttccccggggtttttttaaaaatttttttttttaattattaaaattaaaccccccttttggcca

SEQ ID NO: 690668 - DNA, 841 bp, Homo sapiens
gaagttactatagaccttctcggatgataatctgtaagccaaccgatggaatacggtagagcatcgaatgacaaatggctcacgagattggcaaaatctctatctatcttgggagcgattactagtcacgatatgtgcttacatagacagagatgttattaataatatatattctatagcatatcgatcaatctgtggtgggatgatatgagtaagatggtgggaggttagtgatgatagtagtggtagaataaatgtggataggggatatgtgtgcttttctgctcaatcaagcagtaaaaccagaacaagtgttcttaaaaaatgcactattttaaaagagagacgcattgcgacttaaagtagaactgaggagcaattcggttcccttggcttcgtagtaccctagactcaaacatgtcataacattctagtctaaaaatatttcagccgacaaacattgtcaccaacctggcttttattgtatacgcgagctatgtaccaactgatgcataatctgagaccttgggataggcttctccagcagtggcggaaaggcaccctccaccttctactgacagatggcttcttagctctcttgaaacaccgcatgcttacgacatccgatgccttctgcaccctatatcagggactcgaaaacctactgcataagaaacaatcgcctatatacacgatgaaattctcttatctctgtggtcccacctgtgggcattcaagtcactgtctcacactcacatcctcctctgaactctccgcatacactctgaccacaccttctaacgaccagaaaattgaccgtcctggcatcggatacattcac

SEQ ID NO: 690669 - DNA, 125 bp, Homo sapiens
cttgccgggcttacgtctgcggatcttacgggccggctgttgaaccacgtgacacgcgccgtgcagtccttgtggaagtggggcttcaagaccatgccattccggctgtgcgccatggttgccta

SEQ ID NO: 690670 - DNA, 290 bp, Homo sapiens
tagtggcgcacggaataccgtttcgtaaggcatctttgcctgcttcatcgacgcggtaagcaaaccattttcaacgctgccggaaagcgtcccggagaagtgttccgcacccggtaataatttccattgcttccaggccagatcgctccacgatgcctgaaaacgggtcttgtctgccgcctgaagcgggatatccagcgccagagtgttaatcttgccgctcggttgtgtggagcgccaaacatcacccagtgcaggtgaaagtttcgcggccagggggcgtatgcctc

SEQ ID NO: 690671 - DNA, 470 bp, Homo sapiens
cacgagggccggcgccggcaatggtgttgcaacccgtaatcagcgtgacaccggccagtgcgaacagcgcgatcagctttttcatgacgatctcctttgcttagctagggtgcggcgcgttgccgcgacggggaaaacggatgctgcccaaggatcggtcgatggagcccggcacgagtcgtcgccggccgccagcctcaagccgttcggtcgaactcaggacggtgcctgggcgtattcctcgatcacgcggaatacctgttcgagctcgagcgacttgtcaaaaaaatagtcggctcccgcctcggcgcactgacgccggtaggtgggcacctgcgcatgattggtgtagacgatccggatgcccggcgcctgcgccttctggatcgcccgcagtacgttgataccgttcccctgacgcaattgcaggtcgacgatgacgacctcatacctgccgctttccaacaggc

SEQ ID NO: 690672 - DNA, 120 bp, Homo sapiens
cgggcgcctagatactaagctaagattgtgtgtgaggaaggtaggtttccccaaggccacattgtctttttcaccttacacccagatgctgactgcttagatcatctgcccggaccgcta

SEQ ID NO: 690673 - DNA, 654 bp, Homo sapiens
cgtgtcccggcccccttcgcgggtttaggggtttctgggcccttcctggatgccgtgtcattgggcttcttctttcggtggaacctccgttggtcgcggcaagatctccgagccctgcccgtgtgggatgcgcccgtgcggtcgtcctgcacctgccctccctcggcgattctgtgatctctgtccgccccatcccgagtcgactaagggcgctctcggggaggccgcagcaccttctggaagactttggccttccgctctcacgcagggccgagctgggcagtccaggccgtagaggcctggcaggccctgaaggtctgcgctgggagccgggacgaagcacgtggtatacaggcacatcttcctcccgagtgacatgcctcctaggatgacatttaggggagcggacagaggcctgcagtttggcttcacggctgtgctatgtggacagcaacgagtctgagttgtcgtcggtaagccgactggcgagccaggccggtcgggccccccgatcgccgccccatttcccttccagcaaagctcaactcggcaatccaagcacctagataccagcacatagtcggataatccctgtctggactgagcctccgttggcttctgaactgattctgcagctaaaatcccgactgcctt

SEQ ID NO: 690674 - DNA, 843 bp, Homo sapiens
  misc_feature (843)..(843): n is a, c, g, or t
gttgcaaaacattcttatcacccccaaaggaggccctatacctattaagcagttagtccccattcccttctcctccgactgctaacaatagccactaatctgcaccctgtctctgtggatttacctattctggatatttcatataaatggaatcatatgatatgtgacctttttatgtatctggcttctttcacttagcataatattttcttttctttttttttttttttggaggacagagtttactcttatggcccagggggagtgcaaggggcaatttaaacctcggcctcccaggttcaggagattctccggcctcggttccccgagtagcggggaattcacggggggggtaccaccacgcccagctatttttgggtccctttagtatagacgacggggtttcacccatggtggcccagctgggtcctgagctggacctcaggtgatccaattgggctcggctcccaaagggggtgggattatagggtgtgagctaccacacgcgggactcatcatattttcaaggtttaccccaactttttagctgttcaggacttatccttttagtgggtaaataatatccattggtgggttccaattgggcaacggacgggagactggggggcctcctggatgggaaggtcgggcacttggctcacactgctggaacccgtcacttggggaccaggaaggatgcggggggggggagagccagaggagggtacgcaggcgagggggaggcgcgcacaaatcccgcgggggtccccccgcggggcccccaccggtagtcaggcgcccgagtcaaccagtcagcaacacctagccaaagtaacacgaagn

SEQ ID NO: 690675 - DNA, 305 bp, Homo sapiens
ggtctgaatcatgaaaaagcccataagagagatacagtgactccagtttcaatcatattacaggagatgaatctgttgctctcccattttgctcttgtcacaccatatgaagacatcaaaaaacacttaaggattcgagaaagagaacatcttttgttaaagaagagaataagattttggaagaaaaagtaatagcaaatttgaagaagaaacaagttacgtagggacgagaacaagtaaataaggcctatcatgcatatcgagaggtttacattgatagagataatttgaagagcaaatggaca

SEQ ID NO: 690676 - DNA, 114 bp, Homo sapiens
aagctcgctaccttttaaaatcacaggcagacatgcagatacatgtcaatatctacatacagggatatttgtatgtgtggtatgtgaaacccatacacaagtggatttggccat

SEQ ID NO: 690677 - DNA, 367 bp, Homo sapiens
  misc_feature (65)..(65): n is a, c, g, or t
cgacgcacagggtggataaatgtgctcccttgaccaggcgcattctcctctgcctccctcctcangcttgttcactcctaagtgctgaggtctgatgtcaccccagctcttccacggacactgcgctcaccaagtctgctgatggtctgagtatctccatctaagagacgcttggtctttgtgtagggtcccttggtcacatttgctattgtaaccacaccctctccttgacccaactcttctgatggtgtccccaacacaacagcattctggtcttcctcatacgctgtggctgtgccttggtctcccttacccgcggcactgcatctaacccagtgcaagaagtagaagcatcattcatgcaggg

SEQ ID NO: 690678 - DNA, 557 bp, Homo sapiens
  misc_feature (290)..(290): n is a, c, g, or t
  misc_feature (336)..(336): n is a, c, g, or t
tgtaccagatgatgtcgagaacccttcacaatgatccagaagttgagatagaagcaggatggacaaccgtaggggatttggaaggatgtgtacgttataaagttgtaaaatatgaaagaatcaatatttctggctgattgctttcgaagagttcgtgtcggacgtctatgtcgtgggcaccaatagccatatcacaaatttatggccgtttaagatcatttggatgaattggtacataatgccattactggctggatctcactgttgagtgaaggccagaaggttgaaangtgatctatgtgatcctgttgctgggattccattgctgttgatgtnggattcagagactcagtctatgcacatttatctagccagacacatgtacagaaagaacccacactctatgatccagtgtagcatcaaaccccatgcaatcatcatcctccccaatacagattgaatggagcttctggtgcgctatgaagatgagggggtttatgtaaacacatatggaaggatcaccaaggatttagttctacagtggggagagatgccta

SEQ ID NO: 690679 - DNA, 581 bp, Homo sapiens
acgtacccacctgtatccatctcatccacactgttcaggaagtcatctggggtcgagggacagtgtagctgctcactgcttagctccactgctctgtactctcatctcgagagtgataggcgccactacataaacatgacagttaaagaccaacacaaaaaattttaaaaatcaattcaaggtgtaaataaacacctgctgagcggagacataatgctcacagaggattagtgaaaattcctgtcctgcaatgtctgaaacaagcaccctccctcagggccatagacagggcttgtgctatgaagtgagatagacaagttgatcctaattgaagctggcatgatctaaggaagcaagatatctcctagggtactgtgcttggtgacaatccgggacatgaaatgatacccccagttgggttgcctggctgacaggaaaagttctctgcgtgagtattctcctctctgtaatatcatttgcatctgggggtgcggaggtacccatacaacttacttgtcgcaaggcctcaagttctccaggtggtggtgcacagagacgttacagagaaactccagggggcc

SEQ ID NO: 690680 - DNA, 109 bp, Homo sapiens
gatcccccatctggatgcccctggatgcttacgatttcaacatgaagaaactacatagccactctaaaaattggattagcggaataaaagtgattttagaacagtctct

SEQ ID NO: 690681 - DNA, 171 bp, Homo sapiens
tgattggggccttcaggaagataacttaacctctatatggccccacatatatagctcacagtgttaaatcaagtttagcctaaagctgcctccttacatattttaagtttggcctgaaggtttttctgtacgtcgtgaactataacaagtggaggtgtaaacagaaggtgg

SEQ ID NO: 690682 - DNA, 216 bp, Homo sapiens
gggaagttccgagggctacgtggcccagagagaacgtctgcactggctgtataggaaggctcaggatgtatagaaacgacaacgtaaagctctgggtgagtctagcactggggctaaaaccagactccacttatgcagctcctatggtttccgcgggatgcaagaatcaccaaacaaccttatgtggtatggggacaggaactgtggcttgatagg

SEQ ID NO: 690683 - DNA, 183 bp, Homo sapiens
cgagctatcagctactcaggaggctgacgtggttgttactgaggtcagaaattccagcctgaccggccgatccacatggcgaaacccgtctcaactaagaatacaattagccaggcgcggtggcgcgcgccttaatcccagctactcaggaggctgaggcaggagaactgcttgaactgtgga

SEQ ID NO: 690684 - DNA, 478 bp, Homo sapiens
ctgtcaccagatgctctgcccgtgagccctgggacgtcacccaggtggatgttacaagtcgagtggcagcctggtctgcatgggcagccgaccaaggtggactatcgagaaaccaaggcagtatcatgagcaggaagaaacacctgagatgatggcagcccgcattgacagagatgtgcaaatcttaaaccacattttggatgacatagaatttattatcacaaaactccagaaagcagcagaagcattttctgagctttctaacaggaagagaaacacgaaaggtaccaggaacggaccaggagcgggtgtcttcaacgctgcgggcacaacctccacctcctgatgactttcttgactgttaccaaaagtatatacacacggatattcaaccttactaggctaaattgaagtctcctattcagaatcctagtgctgccgatacggtacactttctgtatactccattaaatatggt

SEQ ID NO: 690685 - DNA, 324 bp, Homo sapiens
ctgatgaactcactgctgcccaaggccgtgcgcagggcgctgaccgatagtacaggagcgccagcgccgccgccgcgccgaagaagcattggccgacgttgaggcgcgtgcttggatcgccatcgacgctgccggcatgggcacttggtacctgcgcccgcaggaaggcctgctgtgttgggatgaccgctgcaagacgttgttcggcctgcctaccagcaccgaaatgagccttgaggtgtcctcggtggatctaccccgatgacctggcaatggtgcgtgacgcggtggaatatgccatgcgccccgaaagcgaggggcagt

SEQ ID NO: 690686 - DNA, 132 bp, Homo sapiens
  misc_feature (4)..(4): n is a, c, g, or t
  misc_feature (15)..(15): n is a, c, g, or t
  misc_feature (39)..(39): n is a, c, g, or t
  misc_feature (49)..(49): n is a, c, g, or t
  misc_feature (103)..(103): n is a, c, g, or t
  misc_feature (122)..(122): n is a, c, g, or t
aaanttaaggtacanttttcttctagctacgatgtatgntttacttacntgaagacccctttaaaatagtaggaaaatcagcagtcttgtttaatataattanaatattcttaaaatgtacnaaaaaggatc

SEQ ID NO: 690687 - DNA, 1347 bp, Homo sapiens
  misc_feature (381)..(381): n is a, c, g, or t
tcttctctcgccagtgctgtcctcgtggaatgtgccctgggaccgcggagatgggtgtcggctgtgaccagtgcctgaggctccctgtctctcctctagtgacactcgtctttaaaccctgctgtgggaattcccttgacgcacctgccgttgatgcccccagggaagcacagggctgaccttggaacgtccaagcataccttcccttaacgatcatcccaacttatttggattgacttatccgacacatgtgttccactatcgtggggacgcaagaaccaacttgtggaggcgtccaagggcaggattgccacgcaaggagtcccgcgatgttccccctttcgccggggacacgggcttgtagagttgccttgacttggngccacaggaaacacctcatgttgattgcgctagagggtccattcccgtagtgtgcacgctttgtgacaacagcaaccgccagactcttgtgacgaacgacttgcgtagccatcaataattccggtggggaaaattggtgcggccatcttgcgtgtaacagcccaagggacgggggatgccctttccaactgttgcagtgactacatgtgggaacacattgttatgtgcgttggcgcccaaatttaaatagggttggcccaaggaccttggattggacccccgtgtggcacttgtatttgccccagtttatggccccccctagttggttggaaccagttcaacagtgtgtgccccaacgcctcccgtaataaaagccaccatgggtccatcggtgagccccccggaatggaaaaagaaagtcctgtcgcttttttttttccccgagagccttattgagaggcttatcgagccaaaggttacaaagatgctcccagcgtagagcagtcccattttggagcaacttcacgtgtcagctttgacttggctcgccacggctttggcaattccaagcgggaactgttgggaatgtaagcaaacggtctggtggcatgaccaaagtggggtgaatagggccgcaacgtcgcattgcgttgggacagacaactttttgcgatcccaagcgagattccgttcacgcctcacatttttcctttacccatttattatggggaccgcattgaggtactaatctcccaagagcaaaggaggttggtgttcacacgacgcaaaaaatttgtggatcctggcacattttctttaaagaagagccacccttaggacaacgatgtcgccttatagactgaatccaacacgcagcgagcggagaacactctacgttgagagatttacattacggggtaattaaccattagagaccggttgagaagcccagccgaggaacgaggg

SEQ ID NO: 690688 - DNA, 183 bp, Homo sapiens
tatgaaaaaagttaaaaaaaaaaaaaaaaaaaaaaagctaggcacggtgatacatgcatgtatcccagctacttgggagggtaaagtggaagaattgcttgagccccgggagttcgagcctgcagtaagctgtgatcaggtgactgcactccagcgtgggcgacagagtgaaaccctgtgtta

SEQ ID NO: 690689 - DNA, 398 bp, Homo sapiens
gctgtcgcctactactactaagggccccgccggtcgactttttttttttctttgagacagagtctcactctgtcaccaggctggcgtgcagtggtacaatctcggctcactgcaacctctgcctcccgggttcaagctattctcctgcttcagcctcccgagtagctgagactacaggcgcataccaccacacccagctaatttttgcatttttagtagacagggggtttcaccatgttggccaggatggtctcaatcccctgacctcgtgatctgcccaccttggcctcccaaagtgctgggattacaggcatgagccaccgtgcccagcctgctgaagaatttttcatgtgaaatacgatttctctaacagatattagtccctgttagccttttag

SEQ ID NO: 690690 - DNA, 168 bp, Homo sapiens
ctcctggccgcacactcagtgtgtacaggtgtgtaaactcatcatccttgccacggatgtccttgttgatcgagcacgttcttgcccttgtacgttgaagatgactacgtgccaggtggagtccggctcctatgaagacgattggaacttccttgccacccaataacg

SEQ ID NO: 690691 - DNA, 717 bp, Homo sapiens
  misc_feature (15)..(15): n is a, c, g, or t
  misc_feature (99)..(99): n is a, c, g, or t
  misc_feature (107)..(107): n is a, c, g, or t
  misc_feature (307)..(307): n is a, c, g, or t
  misc_feature (313)..(313): n is a, c, g, or t
agcggggcaacggcngcctgcgcctgaggcccggccacgccccatcccgctcgctccacgctgcggcagccccggcggccccaggtgcgcggccccgtncatcccgncccgccgccctgcgcccatgggaggagggccctctgccggggcgggcttgcccagccccgaggatgcgatggtgacggagctcttacgccccgagggtccgttcgctttcggagcacatcgcgctgaaggcccccgtgaacgtaccgacggagggacgagttccactgtcttcaaacgaaagcgtacgcttgggcccggncgggancccaagggaaccctgttccttgagacgcgtacaacccctgctgctggggcgccggacttgcaaaggggcccaggtcaagggcagaaagacatccgccgcggagtggccgaacagggggaacgacggggcggacgcctaccttcgaggacgagatacccccggggaaattccgcagaaggctcacgccgcggctgggcaccggaccgttccgcaggcctccttggcagggccccccgggaggcccggccaccgccttggcacccgcgtttgcacgctttcgctggggttccttccgggctgtggtttacccccgggcgacacccggggagccccggcgcgggatggttggccccctgtggggctgccttgggggtcccgtggcgaggggagcgcttccccaccgg

SEQ ID NO: 690692 - DNA, 163 bp, Homo sapiens
  misc_feature (145)..(145): n is a, c, g, or t
gaaatgggaacaatgcactgaatgatcttacactggatagacacgcactgaatgatcttacactggaggacagaggaatggaatcacactgtgagaaatggaacaggcaacccagtgctttaacaaacacacaatttctcatccnttgtgagggtgtactgat

SEQ ID NO: 690693 - DNA, 625 bp, Homo sapiens
cttatgtacgctcttttgcctaaggctcaggctgttggctggactacagcacaacatgacccactagtactaacatctgaacactttttggtggtggttaaccgaatgatctctactgcgccgtcatcatactagatcttatggggcttccatccctacgcataccttacataacagacgaggataacaatcacctcccttaccatcaattcaattggccaccaatggtactgaacctaccagtacaccgactacgggggactaatcttcaagtcctacatacttccacgattatgcctagaaccaggggacctgcgactaattgacgttaacaatcgagtagtactaccgattgaagccccctttcgcatagtaattacatgacaagacgtttagcactcatgagcaggccccacattaggcttaaaaactgatgcaattgccggacgtctaaaccaaaccactttgaccgctacacgaacgagggtatactacggacaaggctctgaaaactgtggcgcgaaccacagggttatgcccagcgtcctagtattaatgacccataaaatttttgaaatgtgataagattaatccaatttgcatggggggcgccttgtccatacgt

SEQ ID NO: 690694 - DNA, 1047 bp, Homo sapiens
ggcaggctgagctgaaggcacttagatgcccacaaccgcaccaagaagcacgacctgctgaggctggcaaaggaggaggtgagccggcaggagctgaggcagctgggtgcgcatggctgacaacgaggtcatggacgcctttcgcaagatcatggctgccctggcagcaagcaagctggactcccaccaatgcaaatgcaacaaggcacccagtgcctaggaagactcctgacaggagcgtgagcagcatcctgcaagctgctggcatgggtacgccctcacgccctgcctcagtgcttgattatcttggacctagcggtgagtgggaatgggacggccacacttccttactatctggagcacagggacaacacttgggcacttgttgtcgctagttcccatacaaacttgtgcgtgcacgtcatactacgacgtggccggttgagcccatatcaccacttgatgtgtactatcatcttgggcactaagccataccttgtttaccacaacacaatgtggaccaaacactgggcacaagggcacccattggtcattgaggtgaccttaacgacacattggacgagccgcaataccgctcttccttggcctactggcagttcccaccctggatcgaactagggcggggataagcagcatgggagatgaaccataatccaggatccatcaatttgagaagatcgataatccacatccatatttgcacccccatcaatttaataacccacaattacacaggcccaaaaacgattcgcccgtagcaatgcgccccaccaataagcgcccaccaatgaaaccgacaccgacccctacgaccacaaaaggagaacaacatcaaccaaacaccccccacacgcccagcaccacacagccggggaccacacacgacaggccaacagacccacacaaaagcaaacacgtacgacaaccggcgcacacgtggcgccaaggacgcggaattacccaccaagagacaaaacaacacagacgacaaacaaaacacagacccacacagaacaagacgcacgg

SEQ ID NO: 690695 - DNA, 367 bp, Homo sapiens
tatgattatcgccacacatcggaacacagatagcgtgtgatctctctggagaagtcagatgaactacgcggttacatatatttcacaaggtccttctctgaaaaagcgaggaggagagtgagaggcttctgagggaactctatttggttgatgttctccgggcagatcgaactactggttgccatggtcttgaactgagaggccatttctagatcatcgattttcttcctattacttgtctctggcaccagaaatgagaattcccaagaatgggatagaaaaacatctcctgagagagacgtttgaggattccaatctgatacccaaagagattctctggggagcaaaagaagccttcagtgttggg

SEQ ID NO: 690696 - DNA, 310 bp, Homo sapiens
ctgctggtcgtctctgcaggatcccccatctgccgcctcatttagtgaagaacctatttgtctatactgctggctcatcaggttactgggagaagacatacagcattgtgtctgcagtgcacggctcacgctggcgtatggatgggtgtctctggttcccagtgatgaccaatggccattgccgagaacactcttccatgccaaaatggaagctgctggataggtgtttagggaacactgcctcccccatatatgacctgccgtcccactacacagcacggggaggcagcccgcagattaggtggtggtg

SEQ ID NO: 690697 - DNA, 688 bp, Homo sapiens
  misc_feature (688)..(688): n is a, c, g, or t
tcaggtagggtgtcccatttttagccgccaggggttcccccttaatgtttcgggattgtttttttgtgaaattgtaaaggcataaccttttacgcaggaaacaagtttgtcctttgatacgccaggttataattttcccccaataaaggagccaatacctggagttccccacggtgaagggccgctctaaatatagtgaccccccggggtgcagaatttggggcgagccgtttaattccgtgtgagtccggcagttggcagcctcaataaagaccttcctttgtttatcccagcattagactgttgtaaacaagatatcctttcttatagagacaaatcatattcacgtgctgacctcgtgaagtcaaaatttgtttcagtacctgttcaaccattagatatatttcatgacaggtaggaaaacgctaggagaacatataatcatatatcgccatggatggttatattcaaagggatcgagattagtgtatacttcattgtccctgttcacaggtccatgagaaacattgtaatacgctttaatacatgtcacgctttgtgcatggaaccacaacctttatatcgtcccctgcaaggttccgtcgtgtttcgcaaaaattcagcacactgtggacccatttcatgcaggttggtgttgtgtaaaccgttgtgcgcaactagttacctn

SEQ ID NO: 690698 - DNA, 815 bp, Homo sapiens
gaataggctatgtcgaggctggtgtaatccggacgaggctgtttcctgcgcatgagccgaggccgtagtgcagccatggcgcccagcctggaatggcattgtcttgaagccccacttccacaatggactggcagctggctgctgtgtgccacgtggttcaaccatgcctggccctgtaatgattcctgcatgactgtaatgtgccctggcaatgccaatggctgctgcctgcattctgcccctgctgcccctgctgtcttgtggtcccagtcctggcccattctgttgctgctttgcctccactgtgttcttgtgtaccactactgaagtgttgctgctgcctgtgcctgctggtgcttccagccttggcatgtgagcgctcatcgtcggttgtgcctgtggcattcgacaatgaatgtgttgtgccctgggagccattctgagcattttcttgtgtgaatcctgagtgatgggctgtgagaacacatgtccaactgtgatggtccccctagaccaagagccctagagactgattgccatgacagtgccattgaaaaggaaggttaccctgtcatcacaaagaaagtccagtcacttaccatttcccacccaacgtgcacaaatggctcccattccagagggtggcccctcccattggcacctggtgcggatgaaacactcgatatacctttgacatttgagcacacaaacctttggacaaacatttgtgtcctagcacccaaggagttaggacacctgcggacacccatgtgggttcatattcgctcaccaggtttcacaggcggagagagcgg

SEQ ID NO: 690699 - DNA, 1529 bp, Homo sapiens
gggagctgcggcggtggcggtgcaggaggccgggcaggggtgctggagtgtgaccgactggacgcactgtggctggtgcgtgccgtggagccatggagctgctggaccctgtgggccctggggggcgctgggccggggtgggcttccacacgggcactgacatggagacctgtggtttgcgaggctccctggggctcggcttggaccgcgatggggcttggggcccctggccttcctaaaacgggtgctggcttgtctggaggggcgagtacgcctggggtggggccgactcatcaccacaagatggcaccggcggagagtcgggcaggaaagccgcacaaggagattcaccacattgcccgggtcaaagggacccgagagcacggagatatggaacgggagagggagacacccaggatgagaaggaccacggacacatcgagccggaagagaacgggccaatggagattgggagggtggaaaagatgaaagtgaagacatcatgaggtagggaatcagttggtggataggaaggagcacatagaaagacggagaacaggaattgagatagacaaaaaagagtaggaagtatttaggtggacggaacggggagaggacagaagataaaatacgaaaatgagagaggaacatggaaagcagcagaagggaaggaaggaacctgggaatggagggacgggagtacaagcgaaccacaattttgataggagaccagtgaagagagcacatcgttctagggaaggcaacacacaggggtgctgcaatggaaaaaaattgatcaaaaattgtgaacaggacagagcgaatggcagggaaaatatacaaaggtgaaagaagacaagaggggcggaagagatgtgagaaagaaaaaggacagggaatattacacagcaaacaagaaaagagtcgacggagagagaaagcggaggaaatacagggaaagagaaagagaacagaatgaagggacaacggaggggaacaaggggaaacacagggaaggacaacgaatagaccgagaagcggtcgaaatgggacgagagggaacaacacgaggcaaagagaaaggaagacagaataaggaaagaatatgaggccacggggaagaatccaggaacaacagaacgaggaacacagcggatagacagtaaagaaacaatacgacagaggtaaagagcgagagccaagactaagagaaggctagagcaggcaacggaacgaagagaaaaccgccgacaaatgaaagagaacaggacagcaagaagaaggagaagacaacaaagaagcaacagagagaaaggaaaaaaagagcacagagacaaagaataacacaggaaaatgagacaaaaacaagcaagaggagaaacaccagaggacaaggaaagacgacgaaggaagagagaaaagcaggacatgaaacgagctcacaacggagaagaggagaaaaacgacagagaaacagagagaaggaggaacgagacacaagagagtcgaaagagaacaggaacaaccac

SEQ ID NO: 690700 - DNA, 227 bp, Homo sapiens
cccagtaatcgagctcggtaccagatatgcagagaaccaaaatgcctgcgtttcagcaaggatgccctcgccaaagcagctgtgcacagcagtgccaaaaaccctggggtacccagtgggcggccaacccctgtgaacccaatgaccagtgttacatgacacatatgaacaactgtgacaactgtgactctgtgtatcccacgagtcaacacacacagggtgaacct

SEQ ID NO: 690701 - DNA, 130 bp, Homo sapiens
cgtgatcggtaccttggttcaatgcgttgtgctgtgtacgataatacactcagtattgggatcaggggtgtaggtgtgccttgtggtcagaagtgggctcagtggcatatttaatcttagagcgaaagcc

SEQ ID NO: 690702 - DNA, 287 bp, Homo sapiens
  misc_feature (279)..(279): n is a, c, g, or t
tgtatccccaacaccccgggagggcgaggaggcggatcacctgaggtcaggagttcgagaccagcctgaccaacacgatgaaaccccgtctctaccaaaaatacaaaaattagcagggcatggtgtgggcgataaatacgtgatgttatccccaacaccaaccgaggcagtcagcccaatgacctggggcagtgggcctgaagatcctccaagtttctgatctagataattaaacatgatcatattgtatgggtgttgtttactagtgttgggcgatancatcagtg

SEQ ID NO: 690703 - DNA, 1396 bp, Homo sapiens
cggaagccacgcgcagatggagcagtggcgaacgcggctggaggccctggagcgcctgcggagctggtaaaggcgatggaggttgctggttagtgaagggcggactgcgcgctccccctgcttacccgcgcacctcgtgggccggtccatgctcccgacgtgctgcgggcttcatgctatctggcggccattgttgcgggcggctcgcggtccacgtgactgcagagtggttgcggtcagatgcgctcggtgccggaagcgcttgagtgcctgggctgatgaggccttgggcatcgagccatcttggctattctacctaggatgccagagcgcctggagggcaggcaacgtgagaagtgcgccaggagactagcacgaagacgaaatacactacttcttgcgcatgattctgtgcgccaaaccatcaattcaggatatacttgccctggaaatttagttctttgcgggcccaatccagttttgcgtattcataacatttccagttggcgcccttggctttgaccccacgtctaccggggcccatcccttccctttttcatacacgtttgcaatacaagctggcgcatttgcctttgtgaaacggccttatcacgacgtggaaccatggcattgcgaatctgcggcattcgtataaatcgacagggaacacgccggggattaagacggcggcgcaagtgcttgggagcaattgcttggacgggggaacccgcgttagattcctagtcattgtagcccttgtttcgtgggtctaaacctttgaggcccctttgaattggttaccccctttgagatgccaagcggacttgttttctttcccaaatagttctaacgccatttgatggttctcggcgcattgttaggcgccgagggctccagcatagggctatgaggagccttcccaagagaagttacctatggtgaggtccccagaagtgacaagtttgaaggcaagttccgccagagagcgattagaatccgggagctttttggtcccctgggggacattcccggggatgactttcccgcggaatacttaactttaacggaccctctcgaaaagggccctttggcattccttggttccaccccttttgtttgttccctttgcgagacatttcgaaggcttcctttctttacattggaccctcccttcttaaaccttgttttccccatttatcttcttggaagcggcagacccctttttaaggttttaggggcttcctatggtaagcggaccataggttcccagagaattgggggccctcttagggggagtcacaacgtttggccccccacatttcgggccttttgctttgaaaaggttctgggttcaatttcagagctgttcaataccaaacctttgagatttcaaccg

SEQ ID NO: 690704 - DNA, 287 bp, Homo sapiens
gcctggggcctctgttcccctaaaatctagcctaaactattcccatccctttagcataatttcttccatagcctctttgccttaggattgactttgcaatttttttttgagactgagtctgctcagttgccaggctggagtgcagtagcatgatctcagcttactgcaacctctgcctcccaggttcaagagattcttgcgcctcagcctcccaagtagctgggatttcaagtgcgtaccaccacacctggctaatttttatatttttagtagagatgggggaacag

SEQ ID NO: 690705 - DNA, 766 bp, Homo sapiens
aaactacggctaggtacgaggctggttgtgagatcgcggtgccagttgccatggagccggccgggccctgtggcttctgcccggcgggagagctccgcggttgcagcgctcctcccagccgcctagcaatgcgccctacgccgtgctgcgtcagcaacgcgagaccgagtgacgagcctgggtgaagcagtgcctcatgctcctggccctggctgcccatgctggcctatctgggactcttgtgtgatgctggcttggctgcctgtggctgacaaaatgcttgccttctgatgctggcttgcttgatgccgctggtgatgtgcctgtggctgtgcttgctgcctccatgtgctgtgcctgtggtgtgttggaacctgctggagcctggacctgcatgcttctggatggatgctggataatgccccgggtagtgacgcctgcggatgctggatgctcgcccctgcgatggacccctgccggattcttgtgaaagatgcctcctgccgctggatgccctgctgtgccgcctgatgcgggttctttggatgatgtccctgtggggcctgcactgcccgtcgtacccacccgcatccccgcgatagtcagcctgagccgtggccagtctcgccgctcgtgcgcttccagctgcccaatgtgctgttctgcctacgcgcatactctcgccctgtatcacggcggtgacgacgcgctgtctctgacttctgtgccacactgctcggcgtttccggagcctggggtgccacaa

SEQ ID NO: 690706 - DNA, 170 bp, Homo sapiens
ccgccaagaggtgagagagagaaggtgtgcatgacagcaagcatgaccaactggggccctgctagattctggcggaacaccctgggcacgaggatgtgcacgtgagcaacggtgatactcttgtgctggcagtatggccacactcgcccagtctcatcgtcatcgctaac

SEQ ID NO: 690707 - DNA, 161 bp, Homo sapiens
attctccctcagtctctagaaaccactaagacactttatataacatgtagccttgtgtgactggcttctttcacttttaccataacgttttcaaggctcatccacatgtagaatctatctgtacttcattaccttttgtgaataatattccatagtataga

SEQ ID NO: 690708 - DNA, 359 bp, Homo sapiens
ctttggggtctttgctatctaaaaaaaaaaaaaaaaaaaatcaaatttaaaatctgagtcagtcggcctgcctgggttctcattaggtaaattcttaatgccttgccctttccagcaatcattcaatcaaaggagggaaatgaggcactttaacaaagcagggggcgccagggaccgcttccttaaaaacggctctttccgctttaattccttgcccacaggcttgccctggaagctgaataaaaatccccaaaactcaaacttcctagggatgccacccttttagtggctaacacctcccccttccaagagctaaaaaccaagggagaatgtccttttgtagcttaaataaccaaaga

SEQ ID NO: 690709 - DNA, 631 bp, Homo sapiens
gactctccccggccgccgctctccggccctcgccctgtccgccgcctccgccgccgccgccgtggtgcccttcggggtgccagcctctggccacggtgcggcggcgtcgcgcaaggccggcctctgtgtgtgcgctcagcgagcgagccggtgtgcggctagtgacgctcaatacctgacgcctatcctgtgccagctgcgcgccgccagaccgtcgctccggagaggcgtgcacgcggccgccggtcatcgtcctgcagcgcaggaagcctgcaggccaagggcaggaagatcccaacagtttggcgccataaatattacctttatcgcggacgtggtgaagaagatcgcccctgccggaggtcatatcgacatggtatcgcaaggcttccagtattctaaaccgaagaggtgccggtggctaagtggcgactagagtaatatagtagtcggaaagaatggcactgattcgtgaccacattgcccacgttggttgaccaaacaagacaccggggttcaaaagttgacgctgaaagaacggtgcccactttacccgaaggcccaaaattcaacggaatggttgacatgacaaaacaggcagaacatcgccactccatccaaatttgcacca

SEQ ID NO: 690710 - DNA, 415 bp, Homo sapiens
gtctggtctctgtacactatgggcacacgactcctcccagctctgtttcttgtcctcctgagattggcatttgaggtccaggggacccaacagccgcagcaagatgagatgcctagcccgaccttcctcacccaggtgaaggaatctctctccagctactgggagtcagcttagactgccgtccagaacctgtacgagaagacatacctgcccgctgtacgatgagctcagggacttgaacagcacaagcacaggagccatgagcacttacacaggcatttctactgaccaaggactatctgtgctgaagggagacgagtaacagccagaccccccatcagtggacggggagagtgccctacatacctgagcccccaggttcagactgagctcccccttgccaggagcgtcttgc

SEQ ID NO: 690711 - DNA, 205 bp, Homo sapiens
cgttgtcgccatggtaataccgctcagtacgggaggacccacaggctaagacactcggagcacgagctcgcctgagggaccaacgaggcgaagccacaatccgcgaactcatgactgaccccttctaagtaagaatcccacccaggcaaaccaatccgacaaccgaaatagcgcaggcaccgccaaattcaaggcgccccaaaag

SEQ ID NO: 690712 - DNA, 326 bp, Homo sapiens
taaaagctctcttaccccatgggctgcaacattaagtgtggaacctctgcttaatgagctcctatcggtaaatttagcctgatccaactttatattttttccactattatcctatacctttaatatctattcccatacatatttccttggtttttgtctgtaaattggagaaattatgtagttctttggagtatagcataattcctcatgggtcatacttcacacgtcacctttaggagtctgctgagacttgaactagttataggtgtagaagcaaagaggggtagtgggagtgaatcaggagtgtcttgcatggcggatacctc

SEQ ID NO: 690713 - DNA, 111 bp, Homo sapiens
ctgagcctgccccagattaggaaaatgattatgagggcgtgatcatgaaaggtgatagctcttctatgatagcgcaagtaggtctacaagacgctacttcccctatcatag

SEQ ID NO: 690714 - DNA, 366 bp, Homo sapiens
cggcacgaggaggagctaaggggcagatgctaaccagtcgcaccactgtcttgtggctcccaatcccatcatctttccacatacctcacagccatttccttcttctcatcctgtaaggaagttcctagctgattctataagagccttattacaggaaatgggaagtcaatacccgaataacaaaggtactaggtgtctcctcaaaaacatgtcaagaaaacaaaatgtggtacatccaaaaaactgaagactattcagcattaaaatgcactaaacacctgatgtgtgctacaacatggatgtactctggggatcttactgaggtgatggaatgtcccagcactgggctgtgacaatgactgcaca

SEQ ID NO: 690715 - DNA, 923 bp, Homo sapiens
tgcaatggtcttgttaacagaggtccgaagtgatgatcaaaactggagaaactgatgttatgagagttaagaaaaacattcaggaatctgaggttttagatgaaaattaagctcgatgtatctcatgctagagttcgaatagcagagcacttgtgtgtgtcatcacaagctggagaaaggaagtttccgtggtctggtgatttcagagtggtgttcaatctcggatcttcaaagcgatttagagcttctgcaaagcatgtgaattgggggcattcttttcatggattaaatgctatggtgtttacgagaaatccaatattcagacattgcttcacagaattcatggacgagaaacataaggaaatcgggatatattatagtacaagagagacaaacccctgatcatttcgtttggtatgcaaatgagtttgattttagacataattccgcagcatcaacatgaatttcccatctggtgtaaatcgttggttgtgcgtctaagggtggctggtcgagagcagccgttcgcgatgggtgcaacgggcgcgcgaggcgaaaagaaactctggacgttaggagggcatccgacagtgcagaacccagtgggacagaatctcgccacagccgcgccacagcggcggccccgcacccagcacggcagcaggcccgccacccaacgccgacctccctgcctgcacacacgaagccccaggccccacacgccaccccgccaacggatccgccgcacccgccacacggacgccaccagaaccccgcccacccaacgcggaccccagccccacccaaacaccggagacgcacaccgccaccgtgaccacctcccggcccacccccaccggcaccaccaaccgctcacccgcacgacccacaacacccaccgccagcagccacccccaccccca

SEQ ID NO: 690716 - DNA, 103 bp, Homo sapiens
tagatctaattggtatctttcttcataacacggaaatttaaatatttctcctgatggatctatgaggttatcaccgttatgagtagtgcacagtgtcggcaca

SEQ ID NO: 690717 - DNA, 181 bp, Homo sapiens
ggacagtgttacagttgaacacttagcatcctgttttttggttggtagttaagcaaactgacattacggaagtgccttaggcactacagtactaagcaatgttgatatatcattcgctctatacactttaatgtattcagttttgctgtctcatatcatgtacctctctagtcaaagtggt

SEQ ID NO: 690718 - DNA, 530 bp, Homo sapiens
  misc_feature (88)..(88): n is a, c, g, or t
  misc_feature (92)..(92): n is a, c, g, or t
  misc_feature (102)..(102): n is a, c, g, or t
  misc_feature (162)..(162): n is a, c, g, or t
  misc_feature (164)..(164): n is a, c, g, or t
  misc_feature (233)..(233): n is a, c, g, or t
  misc_feature (255)..(255): n is a, c, g, or t
  misc_feature (257)..(257): n is a, c, g, or t
  misc_feature (328)..(328): n is a, c, g, or t
  misc_feature (369)..(369): n is a, c, g, or t
  misc_feature (386)..(386): n is a, c, g, or t
  misc_feature (426)..(426): n is a, c, g, or t
  misc_feature (438)..(438): n is a, c, g, or t
  misc_feature (521)..(521): n is a, c, g, or t
ggttgactccgggggcgcggcgaggagagacatgaggctgagctggttcgggtcctgacagtactgtccatctgcctgagcgccgtgncacncagggccgangggcaaaaggaagctgcagatcggggtcaagaagcgggtggaccactgtccatcaaatcncncaaaggggatgtctgcacatgcactacacggggaagctggaagatgggacagagtttgacagcagcctncccagaaccagccctttgtctncnccttggcacaggcaggtcatcaagggctgggaccaggggctgctggggatgtgtgagggggaaaagcgcanttggttgatcccatccgagctagggtatggagagcggggantccccaaagattccagncggtcaacctggtgttcgaggtggactgctcaaaatagancgacgaactganctgtaccagctggggaaggcaaggggagaagccccatcaggaccagactgttccaaaaaaaacaaaacaaaacaacaaaaacncttaaagcc

SEQ ID NO: 690719 - DNA, 517 bp, Homo sapiens
gctgattcaaccgatgcgatgcacctgaatgtcgaagtcaccggtattcgcgtgcggtcgagtttctctgccgtcatgttcggcttcatggccggcagcgattacatcgacggcaccgtcacgttcaccgatgccgacaatcatccggttgaccacttcaaggtgtcggcgtcgtatgcgctcggtggtatcgccggtgtcgacagcatccgcatggactggctgtacgagaaattcaccgagaagacgctcgcgacgctcgatccggcgaccgcggcgcagcaggccaacgcagcatcggcagcctcgaagaagctgtaagacccgatgcccgacggaacgcagatgcgcggcccgtcgggccatggcggcagaccctatgtcgccgcccacgagcggcctcgccagtcgcgaacccacatcatgcaatgcgcgagtgaatgccctgtgctcgcagctggcagcagcagcgctcctgttccgttggcccagccgattggcatcggagcgcggccgc

SEQ ID NO: 690720 - DNA, 348 bp, Homo sapiens
gatggacgagagctggtttgttacccctcccgcctgtttacggctagaggtgctggactcggtcccgtccgctccagagcatgtcccctggaggacctcctcatcgagcaccccagcatgtcgtttacgtcaccggcgagcaccatagtgctagagcccgggtcccctctccccgctcccggactgcggccactgcgctgactggagtctgagcctctagacgacagtgcggaacttagacgacccgtcctcgtcctgctgagctctgctggtgctcgctgcgcctcgcctgctcctctcccagcgcgggctggcgctgctggagaaaggcgtgtgccaggtgctggt

SEQ ID NO: 690721 - DNA, 639 bp, Homo sapiens
tgttaaactgtctattacaaaaaaagatggaagataacaagtgttgccaacgaagtggagaaaagaaaatcctgtacactgttggtggaaatataaattagtacagccattttgaaaaacagtatggaggttccacaaaaaactaaaaatagaattactatatgatccagcaacctcatttctaggtatatatccaaaggaacttaaatcagtatgtctaagagatatctgtgctcccttgttcactgcagcattattctcaatagccaatatatgaaaacaactgaagtgccatcaacagatgaatggatttttaaagtgtggtacacacacacacacacacaatagaatactattcagcctttaaaaagcagaaattctgtcatttgcaacaacatgagtgaatatagaatgcattatcctaagtgaaataagccaggcacagagaaacaaatactgcatgatttcacttacatgtgaaatttttaaaagttgaactcatagaatgagaatagtggttaccagaagctggtaaggtaaggtaactggagaaagaataaatgttggtcaaagggtacctttcttgttgtatgttttggtgatcttttgtacagcatggtgactgtacatgatgactgt

SEQ ID NO: 690722 - DNA, 814 bp, Homo sapiens
  misc_feature (115)..(115): n is a, c, g, or t
  misc_feature (745)..(745): n is a, c, g, or t
  misc_feature (775)..(775): n is a, c, g, or t
caccattacccctccataaagctagcggtctcagatctccacccttgagggcatccagcccatttctgttttttcttttatcgagtccaggttttcattcaggtaattgtacatntccatgcagtagtaagaaataacacagcaagatcccttacacactttgcctagttatccccatgttaacattttacaaagctatagtgtaataccataaccatgatatttacgttatcgatccactagttttattcagatttttccagtgttacttatactcatttgtccctgcttgcaagtgtgtgtggactaagttctatacaattttatcacctttgtagattcgtgtatccacctaccacaggcaagttattaaacagtttcaacacctggaggacctcgtgttgcccatttataaacaccccttcttaaaccttggcatccattttgtccatcatttctaaaatgttatcatttcagaactgcaatataggtggatgccaacatgatccccatggagctaccatagctaacggtgcctacgccaccaggagcatctaacatgggcacggctaaggctaaccactgggcgtggctgctggtgctcagattcctgtttgggtgcagtgtccttcagatcctactcccgtccttctcttttatgtccagggtgcagcgaaggatgcagaacaggagtcgcagccaaagcagagatccaggatatgaagcaagagttatccgcggtcantatgatggacaagtttgccagatctgccangctggaaagaaagatcaacaagatgatgaataagctcaa

SEQ ID NO: 690723 - DNA, 241 bp, Homo sapiens
  misc_feature (48)..(48): n is a, c, g, or t
  misc_feature (172)..(172): n is a, c, g, or t
  misc_feature (202)..(202): n is a, c, g, or t
agaacaggaacacatgttttctgtactacatggctaatgcaggatatntggctgcagttgttgggtgaagctttgcccgaaagttgagaaatgggtgcagcgaaggatgcagaacaggagtcgcagccaaagcagagatccaggatatgaagcaagagttatccgcggtcantatgatggacaagtttgccagatctgccangctggaaagaaagatcaacaagatgatgaataagctcaa

SEQ ID NO: 690724 - DNA, 937 bp, Homo sapiens
tagaccctttttccaggggcaagaaaatacacaagcgggggaacccaacaacacacgaggggcacacccaggagtcaaccgccgcggcaaatattgcagtgcgcgcaccgtgccccccgtgtaatatgcctcgcaggggggtgcgcagccccggcacaacgtgttaacggcgcacgcgcccaggtcgtaaagaagcagcaacccgctggtcatagcgaacaacggcggaggacccctccgggcaacaccacatggggacaattgccccgcctcgccaacgagcgcaaccagcccacaaatctgaggggcgcaaagcccccgagttccctgcttatgtgtcgcacataccgagggacccgcactcttgcgcggggtgaaaacctcctggcgacaatattcttggcgaaggacagagtaatccctcgaaaaggagtctttcacaatattgccacgagggtgttcgccaagcactacaccccggttctaagagcggtacagacaaggccatataccttcgtgcataacaacacgcccccacccgacgctagaagacaggcgggccgcctccttaaaccgcggcttggacacagcaacgcccacgggggctactcggcgtggtgtgaaaacatcgagtctcgtggcgcgctgcagttagataaggtaaccttgcgttggttgttttcgcccgtaacagttacattgaatatgtctgtgagacaactagtagcaaaactcttaaaatttttattgtgggcaagaacaaccacttctcgcgctcaaatactcataaaagacaacctataaagaaaggagagacaagagagacaccgttgatcctcctttatggacgacgcctcaatccctccgggttctctactcaaccaagatgtttcaagcctgaagattttcttcagtgttaaaaaaccaaaaaaaaaca

SEQ ID NO: 690725 - DNA, 626 bp, Homo sapiens
  misc_feature (11)..(11): n is a, c, g, or t
  misc_feature (80)..(80): n is a, c, g, or t
  misc_feature (216)..(216): n is a, c, g, or t
  misc_feature (228)..(228): n is a, c, g, or t
  misc_feature (242)..(243): n is a, c, g, or t
  misc_feature (249)..(249): n is a, c, g, or t
  misc_feature (255)..(255): n is a, c, g, or t
  misc_feature (295)..(295): n is a, c, g, or t
  misc_feature (304)..(304): n is a, c, g, or t
  misc_feature (325)..(325): n is a, c, g, or t
  misc_feature (362)..(362): n is a, c, g, or t
  misc_feature (395)..(397): n is a, c, g, or t
  misc_feature (410)..(410): n is a, c, g, or t
  misc_feature (422)..(422): n is a, c, g, or t
  misc_feature (425)..(425): n is a, c, g, or t
  misc_feature (427)..(427): n is a, c, g, or t
  misc_feature (436)..(436): n is a, c, g, or t
  misc_feature (438)..(438): n is a, c, g, or t
  misc_feature (457)..(457): n is a, c, g, or t
  misc_feature (460)..(460): n is a, c, g, or t
  misc_feature (548)..(548): n is a, c, g, or t
  misc_feature (555)..(555): n is a, c, g, or t
  misc_feature (567)..(567): n is a, c, g, or t
  misc_feature (581)..(581): n is a, c, g, or t
  misc_feature (585)..(585): n is a, c, g, or t
  misc_feature (588)..(588): n is a, c, g, or t
  misc_feature (594)..(595): n is a, c, g, or t
  misc_feature (598)..(598): n is a, c, g, or t
  misc_feature (621)..(621): n is a, c, g, or t
ttgccctcgancggaggcaacagcaggaagcaggggagccaggaggggctggagggggcgcctctacaacggaggacctnataggtgtggcggggaaggtggggtgcgaaggagagtgacggtccttaggagcctgctttgcccagcctggagggcgtcagtgaaaagcagtacaccatttacatcgcacctggaggcggggcgttcacgacgttnaatggctcgctnaccctggagctggnnaatganaaattntggaaggtgtcccggcccctggagctgtgctatgctcccnccaaggatncaaagtgacccccccaggggncagccaaaggaaggggaccatggggtatccctgtgtnctggtctatcaccccaggttttttgtcccccannncccccagcccagncagccaataaanggncncaaatgggncncgtgggttttatacaaagnatntatatgagatttttttatattggacagagtggggcaaaacacgcccccctctgctgccttttttattgccctgcaacgtcccatctanacgaggngttggagaaggngaagaaccctcccnttcncgnccgccnnccnacaacaaacgggcttttttcctntttga

SEQ ID NO: 690726 - DNA, 425 bp, Homo sapiens
  misc_feature (77)..(77): n is a, c, g, or t
aaaaaccaccgttgaaactgtgtatccccaaaaaggctgaatttagcttgaagcaatcaaggaggtagttttgtganaagatggcctcaagagaagacaaagccagaaatagcctccccagaacaatcaaacccggccgggagtggtcacttatgcctgtaatcctagcattttgggagaatgaggcgggtggatcacttgaggtcaggagttcaagaccagcctggccaacatggcaaaaccctgcccctactaaaaatacaaatattagcccaggtgtggtggcacacacctgtaatcccagctactcaggaggctgaggcacaagaatcgcttgaacctgggaggcagaggttgcagtgaactgagatcgcaccactgcactccagcctgggtgacagagcaagactccatctcaaaaaaaa

SEQ ID NO: 690727 - DNA, 431 bp, Homo sapiens
actaaccacggttggctggggcatcgatgtttatcgatgccactaatgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatgtaggtatgtatgtatgtatgtatgtatatgagacagagactcgctctgctttgcccaggctggctaattttttagtatttttcatagagacaggcgtttcaccatgttggccaggctagtctcaaactcctcacctcaggtgacccacccacctcggactcccatgcctcggcctcccaaagtgctgagattacaggcgtgagcccgaggtgggtggcatcgataaaca

SEQ ID NO: 690728 - DNA, 348 bp, Homo sapiens
atgcaattcaaatcttatgagaaatcagtatttgttaaatcctgtgactgaaataaaaacgtctcctgcggggcgtggtcgtcacgcctgtaatcccagcactttgggaagccgaggcgggcggatcacgaggtcaggagatcaagaccatcctggctagcacggtgaaaccccatctctactagaaatacaaaaaattagctgggcgtggtggtgggcgcctgtagtcccagctaccggggaggctgaggcaggagaatggcgtgaacccgggaggcagagcttgcagtgagccgagatggcaccactgcactccagcctgggcgacagagcgagactcagtctcaa

SEQ ID NO: 690729 - DNA, 117 bp, Homo sapiens
  misc_feature (39)..(39): n is a, c, g, or t
  misc_feature (50)..(50): n is a, c, g, or t
  misc_feature (117)..(117): n is a, c, g, or t
gctgcatgtgacatatttctaccagattttttttcctgnatgattcagtnattggctgattatttaatctatagtgctatcgagcgatccctggtactttggacttcatggcttgtn

SEQ ID NO: 690730 - DNA, 117 bp, Homo sapiens
accctctgtctcctctcttcttctgcttcctgcttctagcctttcctgcttctgcctgcttcctgcttctgcctgcttcctgcttctgccagagttacctaccaggtcttggtgagg

SEQ ID NO: 690731 - DNA, 680 bp, Homo sapiens
taatgaacagaattcccaaataccagctccaactgatggtccatcattcactgttatgagacaaagttgctttaagcattccaaagactctgacccagaacagatgcgacagagtttgctgtatctgcaatccgttcgcggagaggctgctgccagtatggactagagggttaccattccatcaaatacaatatctgtgaatggaaggtcaagactcagtccattccatgtcgcctgatgcccaggacggccagttaaactgttaccctgccacaccactgcagcttcacttccacttcagaccaacttcatactaatggaacattttggcaaatgtatattcagatgtacagcttaataattattatttctaattaaaaattttagcaaattgggtttgggtggctttaaagtgccagagagaaagagttaccagaatataataatcctatagtaattttgatgatctattgtatgggccttaagagttgaatatgctgctttagaactttaaaacaaggtgtaaatgattttcatgttttacaaatgaaaaataattcctttgtattgatttcacttaccagcacattctctacaatggtgacttagacaaaagtatacacgattcatagactttatacttgtatgacatacaacttaggacaaacataggatatgac

SEQ ID NO: 690732 - DNA, 817 bp, Homo sapiens
  misc_feature (13)..(13): n is a, c, g, or t
  misc_feature (80)..(82): n is a, c, g, or t
  misc_feature (87)..(87): n is a, c, g, or t
  misc_feature (93)..(93): n is a, c, g, or t
  misc_feature (108)..(108): n is a, c, g, or t
  misc_feature (111)..(111): n is a, c, g, or t
  misc_feature (115)..(115): n is a, c, g, or t
  misc_feature (124)..(124): n is a, c, g, or t
  misc_feature (133)..(133): n is a, c, g, or t
  misc_feature (138)..(138): n is a, c, g, or t
  misc_feature (141)..(141): n is a, c, g, or t
  misc_feature (153)..(153): n is a, c, g, or t
  misc_feature (165)..(165): n is a, c, g, or t
  misc_feature (175)..(175): n is a, c, g, or t
  misc_feature (177)..(177): n is a, c, g, or t
  misc_feature (179)..(179): n is a, c, g, or t
  misc_feature (182)..(184): n is a, c, g, or t
  misc_feature (212)..(214): n is a, c, g, or t
  misc_feature (216)..(216): n is a, c, g, or t
  misc_feature (218)..(218): n is a, c, g, or t
  misc_feature (237)..(237): n is a, c, g, or t
  misc_feature (242)..(242): n is a, c, g, or t
  misc_feature (244)..(244): n is a, c, g, or t
  misc_feature (246)..(246): n is a, c, g, or t
  misc_feature (255)..(255): n is a, c, g, or t
  misc_feature (260)..(260): n is a, c, g, or t
  misc_feature (271)..(271): n is a, c, g, or t
  misc_feature (273)..(273): n is a, c, g, or t
  misc_feature (276)..(276): n is a, c, g, or t
  misc_feature (283)..(288): n is a, c, g, or t
  misc_feature (304)..(304): n is a, c, g, or t
  misc_feature (307)..(308): n is a, c, g, or t
  misc_feature (347)..(347): n is a, c, g, or t
  misc_feature (360)..(360): n is a, c, g, or t
  misc_feature (371)..(371): n is a, c, g, or t
  misc_feature (378)..(378): n is a, c, g, or t
  misc_feature (381)..(382): n is a, c, g, or t
  misc_feature (386)..(386): n is a, c, g, or t
  misc_feature (398)..(398): n is a, c, g, or t
  misc_feature (412)..(412): n is a, c, g, or t
  misc_feature (429)..(429): n is a, c, g, or t
  misc_feature (431)..(431): n is a, c, g, or t
  misc_feature (435)..(435): n is a, c, g, or t
  misc_feature (442)..(442): n is a, c, g, or t
  misc_feature (444)..(444): n is a, c, g, or t
  misc_feature (561)..(561): n is a, c, g, or t
  misc_feature (614)..(614): n is a, c, g, or t
  misc_feature (616)..(616): n is a, c, g, or t
  misc_feature (816)..(816): n is a, c, g, or t
ttttattttatanttggatattgggagacttggcaaatgctgtgagattacttagtaaagttaagtatgatgtatatacnnnggggnccagcncaccctcataggttngtnctgnagatcaggnacagtctcnaaggnttngaaatgtggttntatagaccaganaattccattntnanttnnnccccagtatacttatcactgttcatttnnngngnggggtcacggtgtactggnctggntngnacccgaggnatatngggggggggtngnggngttgggnnnnnnttggttatacatagcnggnngccttctctgtagtagccttgggacataatagaaatggngtgagggtcctcngtggttgggtnggatctngcnntggntatttgcaaggntgagtccatattanccttcagcacctgggtncnaagntggggtntnttcatgggtgatgtgaaggtcaagagagaatcagtggctgcagtccttctatatatctggtcactagatccgccagcttcttcaacttgttgggcttattatatctctgaaaggggncctgaacctgcatcattctgcaaaggagatgattcctgagagatgggtgaaananaatcactaactaaagagataaattcttcactttacttcctagtattgcatcccagaaagggttaaagtaagggatattggctcctgctgatcaggccacagtgtgacacattctataaaatgcatcacaaaactacattattcaatagacttgagtgttgcacctgctttcttatctccttgtaggtggttaagtttccnc

SEQ ID NO: 690733 - DNA, 154 bp, Homo sapiens
atagcgacgccagaagagccggttgtaggcattcaagcctccaggtatcacattactctgggcacctctcacagcaaccagtcatcactctgcaagtacactcaccaccgagacacgtttccagaagggggaaggtcgaccttctttccatgaa

SEQ ID NO: 690734 - DNA, 862 bp, Homo sapiens
  misc_feature (635)..(635): n is a, c, g, or t
actttttggctccacatttaatgcaaaagaatcttgtgatgtctacaaggagagatgtgggatatatttcctttctgacacataattgggggcaaaaaagaaagtctaagagtaatcttttctctgctgatacggttgcttgataaagacttctcaaaatgtttaccaatgttttaagaaagcttggtgtgatattcttccaaatgtagttaccaaatataatatggtagaaaaggctaaatcatacttaatgagcaaatggaagtaagctttaaagtatattctctttgtggtgaaaggccaatgagacattgtgaatttaagtgaaccattgtgcctcaagatgtaacctataaacacatggcatacaattttcttctgaataacaaatgattgcttatgtgtgcatgatgtaagcaaaagtcattattttttcctattcatttgacaataagttatggcttaaaatgcttggggagtttatttctcaaaattaaaatctgtcacatgagcttagtgggttctggtttacaaaataacaggtttctcttacagtatttccagtgacaatgcaggtaggtatatcaaacggaccatcaacagtgtgctgggggcttgtggtatggaatatgatnactgttttcgaacaattgtctgtgcagttaaataaaaatttcgccttaagatttctttagacaacaacaaaatatttgttctttcaaggaggttttcttcggcgggtacaacaggagcgcactttctgagatttggaaatatagggggcccagtaattaaaattttgggtgaggccaagcattcttttgcgcatgagattcatacgacaaaaaagttggtgtaagaa

SEQ ID NO: 690735 - DNA, 426 bp, Homo sapiens
  misc_feature (43)..(43): n is a, c, g, or t
  misc_feature (223)..(223): n is a, c, g, or t
  misc_feature (229)..(229): n is a, c, g, or t
  misc_feature (270)..(270): n is a, c, g, or t
  misc_feature (331)..(331): n is a, c, g, or t
  misc_feature (336)..(336): n is a, c, g, or t
  misc_feature (348)..(348): n is a, c, g, or t
  misc_feature (362)..(362): n is a, c, g, or t
  misc_feature (376)..(376): n is a, c, g, or t
  misc_feature (393)..(393): n is a, c, g, or t
  misc_feature (395)..(395): n is a, c, g, or t
  misc_feature (397)..(397): n is a, c, g, or t
  misc_feature (415)..(415): n is a, c, g, or t
gcataaaggtcactcgtggtgagggtgacatgctcccaccttnccccagtagagagggaaaatcctaagccagaggaactccaaaaatgagtgtttggagcgcttcagttcacctttaaaggccaggacgggccccacgtggctgggggcctcgttccagtggcggcacgtccttgggggtctttaatgtttgcagcccaagggcgggcccttttttaaaaanaaaaanggggggtatttttatttttttttggaaagggatttttggtnttctgttgcccttcggggggatcctgttttgccctggggacaatgtgagatcggggggttntcctnatgttttcccgnggcttggggattgnacccggggcccgcncccgtaatgccttgccngnancaatgtaataaaaagccncttttttttta

SEQ ID NO: 690736 - DNA, 241 bp, Homo sapiens
tcccctgtcgaaccctatctggggaagggagcctactagggtgtagaataggaagtatgtgccttcgttcaggcgttctggctggtttcctcatcgggtgatgattgccatgtggggataagtgtggttccgaaggagatctcacatatgatttgttctgtggctgtgaatgtcatccttaaggcgatatgtcgggcgattagtaccgataggtcaagctttttatgcgcgatacgggttc

SEQ ID NO: 690737 - DNA, 838 bp, Homo sapiens
aggcctggacttccccaatgcctccacgggggaacccttccaccagccaaggcctggtctggtgcctgctcgccggtgcgcacagtcatgcctggacatcgcctccttctactggaccctcaccaacaatgacacccacacgcaggagccctctgcccagtcagggtgagtgaggtcctccggccagctgcagaccctggcaccacaatgcgtgcgtgaactgtccgctctcgctgtgagcaagcccagctgggccctcagccactaggctggacctgtcgtggctctgctgcagagctgggtgcccaggtcctgcatggtggcacatgctgaacgcttgacccatggcgtcctgcattccaggttctgggtggtggaccagacccacttctacctgggccgtgccccacatggacttggcgttcaacttgacccatgtgtcataggatgctgggctgtgggtcgtcgtcaactgctcgctgcctggctcgccagacctgaccgagaatctttgaggcctactggttcctgggccaaggcggcagctccgtcccatcaatcttggccccggttctattgacacccccgctacaacctatgagacaccaatcgagattttgctcaatggaacccctgtctctgtgccctaccttgcgagtgcgcccccaccccttttgtccctgtggccgcactccagacttgaaggcgtctaactcaacgtgttggacgatgccccggagtttcatctacggtcgctgtcatgaactaaccttgccccctctttgtgtttttccccccccccaggttcttgcctgccctgacgattggcttgcggggg

SEQ ID NO: 690738 - DNA, 163 bp, Homo sapiens
gggaggtggaaatgaaccctgagggcttccccaacttgccatgcctgtccttagtagatgagttgctcctgattggtcaattgggtttgggtaaggcctggaggcttcagaggtgaatttatgctttgggaagccttatccaaacctaagggaagggccttgg

SEQ ID NO: 690739 - DNA, 188 bp, Homo sapiens
tagaggatccctgaggctagtgatcctcctgctcagcctcccagctaggactacaggtgcacaccacatgcctggataattcttgaaaactttctgtagagacaggatcttgctatgttgactaggctggtgtcacactcctgccctcaagcaatcctcccgcctccgcttcccaaagtgctgtgact

SEQ ID NO: 690740 - DNA, 344 bp, Homo sapiens
agaaggctgaagggggacttaatacctgcttataagcccattaagaatgattaaaagggccgggtgaggtggctcatgcctgtaatcccagcactctgggaggctgaggcaggtggatcacctgaggtcaggagtttgagaccagcctggccaacatggtgaaaccctgtctctactaaaaaatagaaaaattagctggacgtgttagcaggcacctgtaatcccagctactcaggaggctgaggcaagagaatcgcttgaacccaggaggcagaagttgcagtgggctgagattgcgccactgcactccagcctgggtgacaagggcaaaactctgtgtcaag

SEQ ID NO: 690741 - DNA, 801 bp, Homo sapiens
agtttgttgtgggagcagcgtgagtggaagcacaatggatctcgtgtcggaagagactggggatgttgtacgaaaatgaaaacaaaacagaatgtgggaaatcgcagctggaggtaggctgagtgaagaaggtgggcaaatgcagagtgagataccattggtgacaataggagcaccattgagcggggagatctgcagtgcacatatgccatatggatcggtggagtatgtactaatcccgagttctttatcagaggacccacaagatggtgggtggtggatcaaagagtcctttggagaaagggacacgtacaaaagttcgtgcatcggtggcaactaggagtgtgctcgagaagattctatagaatgttgagggattaatcctaaagacgtttatacacagcacctcaaaaattggatgtagcaagaaatcacgcaggatttggtccctgagatcctatgatggagaagaagtcattgagggttttgactttatttgaaaagttgagcatcatggtcatcgcgaggaaaaaggtcctattgtaacacattgtgtaggttcattctgtactttgaatatcacggtatttcgcttaaccctttctgtgactgtttcaaaataataaccccccgtgagaccttgcctaattgtaactttagcagtcacatttaagttgcctctaatgacaacgagtcaaaaatcataaggtgggtttacagactagaattgttggatatacatgtgcctgaatattcattctgacaaagttggaggacaaaaaagtcggaggcttggagccg

SEQ ID NO: 690742 - DNA, 119 bp, Homo sapiens
cttaattcactttatttttcttgtataaaaaccctatgttgtatgccacagcatggtagcctgagttccgctgtcacggagactctggtgtgggtcttgacgaggatggtcacgtgaac

SEQ ID NO: 690743 - DNA, 323 bp, Homo sapiens
caaacatcatccaaaaaaacaacaccaaccccctcccctaaattattttaaataaatactgatctccatgataaatcattcattattttcatctcttatttatccctattataaagaaaaaaaaagggtgagtttgttttaatgattaagtgtttaatctcaattctctctggcctgttgctgtccagtttcagaggagggttagtccaggtcctccttatttgtcatctgttttagatgattagaaatcccttaagtttatgtcagatgctcctagaaaaatgttctctcaaggcagaagtcacttagtgttgtgaaggtgt

SEQ ID NO: 690744 - DNA, 721 bp, Homo sapiens
atcttgcttgaatcacgccgattttatctgaggcactgtgatcaggtgctggcaatcataatgaaaaagatggctactgtgcctcgctgttacttaatcatacagtaagctgacctggaaatgaatgaaactattactcctagaataattacattgtatagccccacagattaaattataagttagagttcaattacaaaacatgttaaagcgttacttaaacatgtactatggaaaagtacaaggtaggttgagatgagtgatttccaagaaagtaagtagtattccccttttcctaggtcttctgtgatatgtgagtgttgtgaatttcttttatgtgcagtttataaaataaagatggattatgtatttttaagctaaggtgagacagtgatatatccttttgtctacaatgctatagctaatgtgctgagcttgtgccttgggtgattgattgattgattgactgattgtgtaaactgattactgtagatcgaacctgatgattgttagtgggaaattggcaggaaaaatgcagctgtcaaatcattggggggagaagaaaggatgtctttcaggattattttgatgaattttttgtcgataattggagacagaactgttgtgatgtaccataatgctaaataaaactgtggactattagcaccataatttagttcagtggaaacaagaagacaatgcttccatattgtgataggta

SEQ ID NO: 690745 - DNA, 648 bp, Homo sapiens
  misc_feature (25)..(25): n is a, c, g, or t
  misc_feature (65)..(65): n is a, c, g, or t
  misc_feature (130)..(131): n is a, c, g, or t
  misc_feature (145)..(145): n is a, c, g, or t
  misc_feature (150)..(151): n is a, c, g, or t
  misc_feature (154)..(154): n is a, c, g, or t
  misc_feature (158)..(158): n is a, c, g, or t
  misc_feature (162)..(162): n is a, c, g, or t
  misc_feature (165)..(166): n is a, c, g, or t
  misc_feature (170)..(170): n is a, c, g, or t
  misc_feature (225)..(225): n is a, c, g, or t
  misc_feature (232)..(232): n is a, c, g, or t
  misc_feature (234)..(234): n is a, c, g, or t
  misc_feature (241)..(241): n is a, c, g, or t
  misc_feature (244)..(244): n is a, c, g, or t
  misc_feature (253)..(253): n is a, c, g, or t
  misc_feature (295)..(295): n is a, c, g, or t
  misc_feature (310)..(311): n is a, c, g, or t
  misc_feature (349)..(349): n is a, c, g, or t
  misc_feature (351)..(351): n is a, c, g, or t
  misc_feature (353)..(354): n is a, c, g, or t
  misc_feature (362)..(363): n is a, c, g, or t
  misc_feature (365)..(365): n is a, c, g, or t
  misc_feature (374)..(374): n is a, c, g, or t
  misc_feature (402)..(402): n is a, c, g, or t
  misc_feature (421)..(421): n is a, c, g, or t
  misc_feature (457)..(457): n is a, c, g, or t
  misc_feature (469)..(469): n is a, c, g, or t
  misc_feature (472)..(473): n is a, c, g, or t
  misc_feature (476)..(476): n is a, c, g, or t
  misc_feature (478)..(478): n is a, c, g, or t
  misc_feature (480)..(480): n is a, c, g, or t
  misc_feature (482)..(482): n is a, c, g, or t
  misc_feature (484)..(484): n is a, c, g, or t
  misc_feature (491)..(491): n is a, c, g, or t
  misc_feature (558)..(558): n is a, c, g, or t
cagatgggtgatctaaaataaccanaaagtgtatacatccgagaagccgcccaagaacatgaaanacaaaaaaaaaaaaaaaaaaaaaaaaaaataaaagcctgcctcaccccttaccaatgagggcagnnaaagaccacctagnatgannaanaggngatnagnnatgnacttcagcccctctgctctgtaccctttttccttttgtccccggcagcagggaanaagctgnangccgtgnaanaatggctgngcagagcagaggggcagcgatagactctggggatggagcagnacggggacgggaggnnacggccacctgtctgtaaggagactttgttgcttcccntncnnccggaatnnanagtgctctncttctctgtgtcgccccgcccagccccntggtgtggagggaggggtntcgtttgtgcgcgtgggtgtagctttgtgcatcctntcccagtggagnaannacntntncntnccataanactttgtttgcccctgtgtggttggtcaaggagggatgtgagggaaatagggaccccccgacttccntcctgcctcagtctttcccccaccctgtctcttccttgtccttctctggaaaatgccaaaatacacgatgtgaataaaagtacaacggct

SEQ ID NO: 690746 - DNA, 426 bp, Homo sapiens
  misc_feature (202)..(202): n is a, c, g, or t
atcatatgtgtgccaggtgtgtggagcttaccggtatcccaacagtctgggtgggaggatctcttgaggcaagagttccaaaaaaaaatttgctgggccaggcgcagtggtcatggctgttattcccagcactctggaaggctgaggcaggcagatcacctgagggtcaggagttagatcagcctggccaacatggtgaaancccgtctccactaaaaatacaaaaattagccaggtgtggtggcatgtgcctgtaatcccagccacttggaggctgaggcaggagaatcgcttgaacctgggagacggaggttgcagtgagctgggattgctccattgcactccagcctgggggacaaaaacaagactttgtcttaaaaacaaaacaaaacaaaacaaaacttactgtgggcacacattatggag

SEQ ID NO: 690747 - DNA, 207 bp, Homo sapiens
ccctgtctcaccaccctctgtgtctgctggctgtaggtctgtctggtctgtctggtctgtcaggtctctggtctgactggtctgctggtgtggctggtctgctggtctggctggtctgctggtcttgtctggtctgctgagtgggctgagtactgctgggtctagctagggttctgctgggtctggctggggatcttgctagggtat

SEQ ID NO: 690748 - DNA, 741 bp, Homo sapiens
  misc_feature (35)..(35): n is a, c, g, or t
  misc_feature (412)..(412): n is a, c, g, or t
  misc_feature (436)..(436): n is a, c, g, or t
  misc_feature (446)..(446): n is a, c, g, or t
  misc_feature (502)..(503): n is a, c, g, or t
  misc_feature (516)..(517): n is a, c, g, or t
  misc_feature (541)..(543): n is a, c, g, or t
  misc_feature (554)..(554): n is a, c, g, or t
  misc_feature (581)..(581): n is a, c, g, or t
  misc_feature (614)..(615): n is a, c, g, or t
  misc_feature (636)..(637): n is a, c, g, or t
  misc_feature (670)..(671): n is a, c, g, or t
  misc_feature (739)..(740): n is a, c, g, or t
tccatcatgggctatatgatggccaaaaagcactnggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgatgtgccccntgtcccacctggctccccccctgnggtgtctagntgtttttttcccctctccctgtcccttgttgttgaaggccaagtaaactaagggtnngtcaagccccatnntcccctctctatctcttgacagcnnnggaattggatncgttgtgggtattgtggttatattctntatttttctctcactttgtgttctgcaaattannaagtaaatgcacaaataaagnnaaatatgcccggtcttttaatcacacaaaaaannaaaaacacaaggggcggggcgcgtctctaggatgtactcctctacaagaggcgccccaaggcttacgnnc

SEQ ID NO: 690749 - DNA, 189 bp, Homo sapiens
atttccacaaatttactaattatatttaaacttttactggttgttttgtatttagtcatcacatgttgtcttattagtgggagaggaacacaagagagtccctgggcaatggaagtaaactggtctagaaatgtgataattcaaaaagtggagaattcgggtttcagtaaacaattaaattttgttatt

SEQ ID NO: 690750 - DNA, 308 bp, Homo sapiens
caggaaaaaacaaaaaggaggaaggggaagcaaacaacgaccgtcatcaatggggacagaaggagaaagagatcggaatgaaggagagaagccactataaaaaaccatcagatcggcatgacaacttacatatcacaagactagcatagagagaaactgaccccatgatgcaattacctcccactgggtccctcccactacatgtggggattatgggaactacaattcaagatgagatatgggttgggacacagccaaaacatatcaatagaaaatgaagcaccaagttccttcagtattgtataaag

SEQ ID NO: 690751 - DNA, 804 bp, Homo sapiens
tatatacacatatatatattatggaggagtctcactctgtcgcccaggctggagtgcaagggcgagatctcggctcaccgaacctccgcctccctggttcaagcaattctcctgcctccggctcccgagtggctgggatgacaggcatgtgcgcaccacacccgacgtaatttcatatatttagtagagacggggttctctccgccgttggtcaggccgtgctcgaagacttctgacctcaggtgatctgcccgcgctcgacctcccaaagtgctgggatgacaggcatgagccactgtgcccagctcgccgatatttctttaaattatgtgtagggacagggtctgttctgtcacccaggctggagggcagctggtacagtcatagctcactgcagcctcaacctcctggtgctcaagcgagtcctctcagctcagcctcccgtgtagctggggctccagggacacacccccagtgctggctaataaagtattgttggtagagtcagggtttcaagcacatgaacagtctggtctcaaatgcctgggctccagtagatcctcccaccttaagctgccaagagtggccacggattccacaggcgagggcaccacccagggccgcaaggtaataaacccaaaggagaagaagaaaagggacgcgcaagtgtggcccaaggggggaacatcgaaacgtccggggctacaaatgatcgtcccaacgtaaagactctgccagtgccaaggacctacggggtcagcaacaaaccgaaggacactatttggcaaagacgcgccggcaagg

SEQ ID NO: 690752 - DNA, 280 bp, Homo sapiens
ccctcacgcccatgtcacaagctccctcacacactggctgttgacatactgcacctcccctgccatactgaacctccccgtggaggcttccctgtgctgcctcactcccaccccctgctgtggccagtgcctcacatgcagtgtgcatggtgtgaccatccatgtgccactgctaatgcccctgagcatgtgttccacacaaccatgtgtcacatgagtgtggactgcctgggtcatggagacttgtggtggccttgggtgagcaatggctgtggtacct

SEQ ID NO: 690753 - DNA, 490 bp, Homo sapiens
tcctgttgatctgtgaccttaccccaaaccctgtgctctctgaaacatgtgctgtgtccactcagggttaaatggattaagggcggtgaagatgtgttttgttaaacagatgcttgaaggcagcatgctcgttaagagtcatcaccactccctaatctcaagtacccagggacacaaacactgcagaaggccaaagggtcctctgtctaggaaaaccagagacccttgttcacatgtttatctgctgaccttccctccactattgtcctatgaccctgccaaatccccctctgcgagaaacacccaagaatgatccaaaaaattttttttaaaaaaaggaacaagtaaggacaccaaaaccaaaaatcaaaaattagccaggcatggtggcttgtagtccagctactcgggaggctgaggttgggaaggatcacctgaatcaggggaggttgaggctgtggcgagctatgactgcaccactgcactccag

SEQ ID NO: 690754 - DNA, 555 bp, Homo sapiens
ttcgtaatgatgtatggttgagaagaatgaggagtgactaatgtccacagggtgtatctctggtcgggggtgataaaaccttctaaaatggattgctgaattgaaattgaatgtgcacaaacactaggtatactaaaatccacttaattcagtgacttatagattggggcaattgtatgtggcacactcttatggagaacacggtagacatagtgagagagaaaaaggtgagctagaatctctgaaacggagcgcagaatcagagggaatgagaagcccttctgaatggaagggagagagaaaagggaatatggtccgtattacagatgacagctgtgaaactggggttcatacctcagcaatgtcactgccaggaaggagggtgatgctagccatgtcagcggtagcgtggcccgcagggacgccgacatgctggagcgtcgtgccagcatgggctgtggcagccacgtgggccagcaggagggtcccgctgcacagctgtggggtgaggttagactgggcggtgatatcggccattacaggggcctcttctgc

SEQ ID NO: 690755 - DNA, 585 bp, Homo sapiens
  misc_feature (39)..(39): n is a, c, g, or t
gctgcctccgtcgctgtaccgcagccgcctccccgaagnctcctgcaccccgcctcggctcccagcccgccgccgctgtctgttccattcgctgctattctcatgggtcacacgagacagatgaggagtttgatgctcgctgggtgacatatttcaacaagccagacattgatgcctgggaattgcgtaaagggatgaatacacttgttggctatgatctggttcctgagcccaaaatcattgatgctgcattgcgaagcatgtagacggttaaatgattttgctagtgctgttcgcatcttggaggtttgttaaggacaaagcaggacctcataaggaaatctatccctatgtcatccaggaacttagaccaactttaaatgaattgggaatctccactccagaggagctgggccttgacaaagtgtaaactcccttcgatgggcttcctaaggacttaactgctattgctacttgattgaaacagttgcctggaaatgttttatttgaacaaattttcctttgagtatcaaaccatgtaatagtaacttggactttaataaagggaaatgagtttgaactgaa

SEQ ID NO: 690756 - DNA, 236 bp, Homo sapiens
  misc_feature (224)..(224): n is a, c, g, or t
gaattccatatatggagcagtggggttattctctatgctttattatgtggaacccttccatttgatgatgaccatgtgccaactctttttaagaagatatgtggatgggatcttctatacccctcaatattcaataccttcgtgattacctttttgaaacatctaccgcaggcggataaactaaaaagaaccacactgaaagccacgcgggccgtgcattggcnaggatattatca

SEQ ID NO: 690757 - DNA, 325 bp, Homo sapiens
tcggggtgatgccatagcagcgagcaccgtgttgcctagggctgcggcatggactcgggctctgggaggtttacgtcgcccccacttgtgcgcccagatacagacgccctggacgcagcccgactagcagtctagaggcctgaggcttctgggtcctggtgacggggctggcatgaccccgggggtcgtccatgccagtccgcctcagtcgcagagggtccctcggaaagcgccctgtgagtgggccattcggaacattggacagaagcccaaagagccaaattgtcacaattgttgcacccaggatgggcatctgcatctccat

SEQ ID NO: 690758 - DNA, 190 bp, Homo sapiens
actgagtccagcttctcatgccattacatcttctgcctaagctactcattttaattataattgcagaggaagaagaatatttgagtagacatgtagtttccctttagagtcattttttaatcccgccaattgcaaagccaggccaggcacggtggctgacacctgtaatacccgccgcgtggagaagcaa

SEQ ID NO: 690759 - DNA, 406 bp, Homo sapiens
gcgcaagagcttcgttaatctcagtcacttctcctgataaggcaatatagagtcctatagcagctttcacactttccaaagcaccaacctcttctggtgtgtccaatttgtgtcccaacttcagggagcctccaataccaactatctccaaacgcttctgtgtgcaaaattgctgattcccactgttccaatgccattttctgttgttacccattggtgtttctctgtgaatttacgcaccgagaccagagcgggtccagtgcgcagcgtacggtcggcgcacacccacagctgacagggcctcggcgcacagggcgcggcgggtaacggcaccgcgcacagtgtacagaacagggcgcgcacgctgcgcacctctcgcagccacatgttcacaggtgtgcgggct

SEQ ID NO: 690760 - DNA, 308 bp, Homo sapiens
gaagctccacctcccaggtacacgccattctcctgcctctgctcccgagtagctgggatacaggtgcttgcacccacgccgggctatttagggtatatcaagtatagacgaggttccaccgtgatggccagtgtgctctcgaactcttgacctcaagtgatccgcccgcctttggcctcccaaagtacggggattgtaggcatgagccaccacacccggcctatctaatgtataactaagctaaatacctcatcagtggaatgagaagctcatgagacgctgtacttaatttttctttcaatcctcca

SEQ ID NO: 690761 - DNA, 245 bp, Homo sapiens
acgatggttggcaagacaaagagaagatattaaagtagccagagagaaaaataggtaatacaaagccggctagcaagacttctcaagcaactatcaaagcctagaaaacagtgcaagtaatatcctttttcttgtaaaagaaagaaaaacaataaaaaaaactgttattttcaagtttcaggggttacattgttaaaggtatgggcaagctttgttacattaggttcaactgtatttcactgagg

SEQ ID NO: 690762 - DNA, 373 bp, Homo sapiens
acgacgcgtggctcgacgcgctcacgcgcatcgtcgagaaggggcgcaagctccacaaggaggtcgtgctccacacgcacttcaaccacccgaaggagatcaccgccatcacgcagcgcgcgctcgctcggctgatggagcggggcatcttcacgcgcaatcagagcgtcttgcagcgtcgcgtgaacgacacgccggagatcatggggctgctcgtcaagcgcctgggccacgtcaacgtgcacccgtattacgtctacgtgcacgacctcgtgaagggcgtcgaggacctccgcaccacgctcgacacggcgctctacttggagaagcacgtgcgcggctcgacggcggggttcaacacgcccgtgttcgt

SEQ ID NO: 690763 - DNA, 165 bp, Homo sapiens
ggcacgagacggcgtggagaccatactgcgggatacacacatccactacagagtgccgggtctatagttgtagattttatcaacacatatttcctgaggtggaggatgtagtgatggtgaatgtaagatccattgctgaaatgggggcctatgacagcttgtggg

SEQ ID NO: 690764 - DNA, 809 bp, Homo sapiens
cacgtggggagcggtgcccgccggggcgcgggtcgtgctaccagggttacccgccctcgcgcgattggcccggtgtgccctgtggggggtccccagcggcacaggtgaagaagaatgtgtctcgcggtgaaaggaaaagagtgttctcccctctggtgaaaagccggcggagaagggccccccacttcgcgagagtctgggggacaacgacccccactggtgaataagcgctcgcctcgcgacacccccagatcgtcctggagacagcgtttcccgagacaccaacccgcgggggcgccgtacagctcgcgcaacttagacagccccgtgccgtgggggtctcatcaaaaccccgggccaaagaagggctgcgctgagacgagccacgagccaccccaagttgtgcccccacaggtctcaaagacgggcgtaaatgagacaaattgcgcccgagaacgggcgcccccccgccgtctctagaccaggggtggaaaaccacgctctttccaaagacatcgttggtcgttgcacagacatggcccactcagacatctcatgctctgaaaaagcggtgtatgaagacaaacgaggtactctgcatcctcctcacgatacagaagagagcaataattttgttggagcccacccctgtagtggttatccttgtttcgagtcggtgggccaattgttgatgatggatgtaaggttttcataaaaccacacgtatttgtttgtaatgggaacacacacctgcgccccaaatgtgttcccaaacttttggaccccctaaaaaaattgaaaccaaaaca

SEQ ID NO: 690765 - DNA, 275 bp, Homo sapiens
gcggatctgtcttattgctctggagagggccattcaggcgcatggtacgaaaggagaacacttgcatcgtgtaccacaaccccagcgtatgcttcaggtagtgtcgcgacatatgatttcatttgcgcaccatatgctgacctgactgctgaattcctccccaggctttctgtacacgatgggatgttctcctttctccatgcgctgaatggccctctccagaccactaatagcagatcagcggtccggggtatcctctaaagtcggtctgtacg

SEQ ID NO: 690766 - DNA, 110 bp, Homo sapiens
ggatcccccatgtcattggtgtttggcaatgttctacgagtcgcactggagtgtcgtgcggaaggtggagtagcacctaagacacgcacagtccgggatataaccccctg

SEQ ID NO: 690767 - DNA, 181 bp, Homo sapiens
  misc_feature (76)..(76): n is a, c, g, or t
  misc_feature (156)..(156): n is a, c, g, or t
catgtttgctcctgaagaagatttgaagtaaagaacctctcagcaagcacatacatcctggctgtctgcagttgtntggtttttgccggggaaggagatagaaggcagaagaggggaatggaacagggggaataggacaatctggttgaaactgtntctattcctttcttttttttttttt

SEQ ID NO: 690768 - DNA, 154 bp, Homo sapiens
tttaactgttgaactaacgaaccttttatagcggctgcaccatcgggatgtcctgatccaacatcggggtcgtaaaccctattgttgatatggactctggaataggatagcgctgttatccctatggtaacttgttctgctggacaagttattg

SEQ ID NO: 690769 - DNA, 858 bp, Homo sapiens
  misc_feature (7)..(7): n is a, c, g, or t
  misc_feature (63)..(63): n is a, c, g, or t
  misc_feature (101)..(101): n is a, c, g, or t
  misc_feature (106)..(106): n is a, c, g, or t
  misc_feature (112)..(112): n is a, c, g, or t
  misc_feature (137)..(137): n is a, c, g, or t
  misc_feature (164)..(164): n is a, c, g, or t
  misc_feature (196)..(196): n is a, c, g, or t
  misc_feature (307)..(307): n is a, c, g, or t
  misc_feature (347)..(349): n is a, c, g, or t
  misc_feature (353)..(354): n is a, c, g, or t
  misc_feature (391)..(391): n is a, c, g, or t
  misc_feature (401)..(401): n is a, c, g, or t
  misc_feature (415)..(415): n is a, c, g, or t
  misc_feature (431)..(431): n is a, c, g, or t
  misc_feature (439)..(439): n is a, c, g, or t
  misc_feature (459)..(459): n is a, c, g, or t
  misc_feature (608)..(608): n is a, c, g, or t
  misc_feature (622)..(622): n is a, c, g, or t
  misc_feature (653)..(653): n is a, c, g, or t
  misc_feature (672)..(672): n is a, c, g, or t
  misc_feature (688)..(688): n is a, c, g, or t
  misc_feature (751)..(751): n is a, c, g, or t
  misc_feature (758)..(758): n is a, c, g, or t
  misc_feature (766)..(766): n is a, c, g, or t
  misc_feature (835)..(835): n is a, c, g, or t
aaaatgngagaatttataagtagtggtaccactaggaaaaagaaactgattaccctgaaaaangtaaagaaatagggtggtaatagcgtgggggacagganggggncgttangcgacccagaaaaggagatgcgggnctattggggagaacttcgaaaggagantgccaaatcccctccgggggcagcctgacagngacataaaagaaccagttgagaaacaaaccgagagggatgagacaaatgccgagaatcagacagagggtcaatcacagggaccgccaaacccaacttcccaaatcacgggngcggagaggccaaggggggggggggggggggggcggaaannncganncggaaaccaccacattaaccaaaaccaaacagataanttttgaaagncccacctgtttggncaagagagcgtagagnggcgcgtncagggggagcagactgctgnaacggcgcgaatggcactgggagcgattcaagaatcattgatgattttttcctagagttttaaaaagtaaagtcacttgactcagttgctccaaaaagtccagtcagaggtttaaggctagtattgaaggataagatatcagctgatantaaatcatactatnttgaaaatactatagtttaggattgcatgcngtggaaaagatgattagcngccccccgaaaaccantcctcccttaggcacacagctagactgcatttcccagacagactcgcttacagttaggtgaanatgagcncaagttcnatactgaaatgtgagcagaaggtctgccattactgggctgggggtcttaaaagagtagccatgcctccnccatgttctttttctctttctgc

SEQ ID NO: 690770 - DNA, 662 bp, Homo sapiens
  misc_feature (470)..(470): n is a, c, g, or t
  misc_feature (492)..(492): n is a, c, g, or t
  misc_feature (496)..(496): n is a, c, g, or t
  misc_feature (503)..(503): n is a, c, g, or t
  misc_feature (556)..(556): n is a, c, g, or t
  misc_feature (621)..(621): n is a, c, g, or t
  misc_feature (640)..(640): n is a, c, g, or t
aatatatccggcctatcctctggtggccattcagaccagcccgaatctcaacctacctgcacatgtggagtgcacctggcgtcctgccctccagatgaagaaattctggccaacccgtgttctactttctgcacgtcagaaatcaattcatgtcaagctcgagtcctgctcttgctggtggcccagccatctgattttcttctacatcatctacctggtggagggcagtcagtcataaacaagccagacctttgtggtgctctacctgctggccaggcctgatccaggtgacaatcctgctgtacctggcagaagtgatggttcggctgacttggcaccagccctggatcctgacaaccactgcatccctaccttacagggctgggggacctgctcggtactgcctcctgcactctgtttttactgactgctactgaagagcaaggcaagctgggtggatctaaaactgnatctgacctcctactggccccntggnccatttntcattagaattcctctacatcagtggatacagaattagttctcccttgcaggncttggatggttacccctgctctgagtacctttgtgagctgtaaggagctctcacacacctcggtntggggtgatcctgaacctnaataaaccctgaataaaacatg

SEQ ID NO: 690771 - DNA, 574 bp, Homo sapiens
actagttctagatcgcgagcggccgccctttttttttttctgagacaaattcttgctctgtcgcccagggttggagtgcaagggcacgatcctatcacactccagcctcgtgcctccggggttcaagcgattctcctgcctcggcctcctgactagctgggattacaggcacacgtcaccacaccggggtaattttggtatttttagtagagacagggtttcaccacgttgggcaggctggtcttgaactcctgaccttgtgatctgcctgccacggcctcccaaagtgctgggattgaaggtgtgaaccactgtgcccagccaagggttccatttggatggcattatcaagagattgggggcttttaaaaaatggatagtgaccatttaagtgggtgtgaggggattggtttctcatggtgattttaatgcatttctctacaaattagtaatttggtgtgtcctttcaaaggtttgtaataggggtgttcatgaaaatttatttgaattatttatttctaaataaagttatttacctttatggtcccgttttaaaaacaaacaaaaaaaaacg

SEQ ID NO: 690772 - DNA, 174 bp, Homo sapiens
acgtaagcaaggaaagatacggtagtatctagagcaggccccgattaggtactgcctaggccctagctaggtagcccctaagtagacaaagggtagaaaagtaggtcccaagcggccctagctaggtcccacgtaggagctcgctggtagcccccaggagaccagtaggtagag

SEQ ID NO: 690773 - DNA, 350 bp, Homo sapiens
aaatgggcttttggggcccccccgtttttaaatgggtttttggggtttaaaaaattttttttcccggggccgcccccgtttaactgaaattttttttccccctgggcccttggccccttaaaaaaaaccccctggggggtataatggggccaaattttccaaataaaggcctgttttggggtggggggtgtccttaggctgtgtttaagtgacttttttttgtggggtattggggatccctttaaatgggtttgttcccccctttcccttaatgggccttttaatgcccccgatttcctttccgggggctttccctgaatgaataaaagtccatgcttttgggtttttta

SEQ ID NO: 690774 - DNA, 768 bp, Homo sapiens
ggtgcttgtgtgggtcccaatgctgggccccagcccaccctcctgtcttcccagggtagcccgcctggcagtcctagctgctcagggcacgttgggcccaatccctgtctggtagaagggccctggctgtttcttatgcacttggcctgctgcggctgggccttgcttggggactggggggccgccgagtctagccgtctctccgcagttatacctcagtagagagccccattcgcgccattgtggatacgacggagagctcctcaggtggcccatggtccctccacatgcttggctgctctagattctggtgccttgtccgaggcttgcactcccctcgacgagcgtcgacatcacttgatgacgctcctatggctctcgcaggacgtccagtcgcttccagagccctcatggttgcacccatagatcacagttgcacttgccgattggtcggagccttgcataactcgccaatgtgcgccctgtagggcactcctatgtacgctcgaggttgggtggatggcctggagcgtctccaagcccgagctagtaggctcgggaaaacttgcacgaccgtgtcgctccatgtgtggcgtcctaggtgggcccctcctacgcattgtgtgaagccctcgacactggggtgtgtccgccgtgctcctgtcatctcgtcccatcggagcctccagcctccctttgcggcccagtggacacctagtcaggcacttgtgctgaccctccttgttgcacccagccctggtctcaaga

SEQ ID NO: 690775 - DNA, 657 bp, Homo sapiens
  misc_feature (36)..(36): n is a, c, g, or t
  misc_feature (75)..(75): n is a, c, g, or t
  misc_feature (104)..(104): n is a, c, g, or t
  misc_feature (111)..(111): n is a, c, g, or t
  misc_feature (116)..(116): n is a, c, g, or t
  misc_feature (123)..(123): n is a, c, g, or t
  misc_feature (125)..(125): n is a, c, g, or t
  misc_feature (130)..(130): n is a, c, g, or t
  misc_feature (143)..(143): n is a, c, g, or t
  misc_feature (149)..(150): n is a, c, g, or t
  misc_feature (155)..(155): n is a, c, g, or t
  misc_feature (157)..(157): n is a, c, g, or t
  misc_feature (159)..(159): n is a, c, g, or t
  misc_feature (170)..(170): n is a, c, g, or t
  misc_feature (188)..(188): n is a, c, g, or t
  misc_feature (202)..(202): n is a, c, g, or t
  misc_feature (207)..(207): n is a, c, g, or t
  misc_feature (209)..(209): n is a, c, g, or t
  misc_feature (211)..(211): n is a, c, g, or t
  misc_feature (218)..(219): n is a, c, g, or t
  misc_feature (221)..(221): n is a, c, g, or t
  misc_feature (223)..(223): n is a, c, g, or t
  misc_feature (231)..(231): n is a, c, g, or t
  misc_feature (260)..(261): n is a, c, g, or t
  misc_feature (274)..(274): n is a, c, g, or t
  misc_feature (277)..(277): n is a, c, g, or t
  misc_feature (295)..(295): n is a, c, g, or t
  misc_feature (300)..(300): n is a, c, g, or t
  misc_feature (317)..(317): n is a, c, g, or t
  misc_feature (365)..(365): n is a, c, g, or t
  misc_feature (472)..(472): n is a, c, g, or t
  misc_feature (489)..(489): n is a, c, g, or t
aaattttatttttagttgcacaaatttgggccaaangaaacattgccttgaggaagatatgattggaaaatcaanattgtagaagaataaatacttttttactntccaaanacatntttatantnctctntaaattttccttncctttnnagtcncngncaaaatccttnaagaaaataaaaatttangaaaaccaaccagnaattntnanttaagcnnananttaaagtnaatacccgtttcacatgctttcaagaatnngccaattactaanaancagataatggtgtttttnaaaancctaattgaagtatatncaaccaaatactttaatgtataaaataaatattatacaatatacttgnatagcagtttctgcttcacatttgattttttcaaatttaatatttatattagagatctatatatgtataaatatgtattttgtcaaatttgttacttaaatatatanagaccagttttctctgnaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagagttt

SEQ ID NO: 690776 - DNA, 1143 bp, Homo sapiens
gggaagtgccagtgccacggaggcgcgctacaacaagctgaagtgaaaagcttacagtgagctcgctccatgtgcacgctggagctgctcagaaataactgctggacagcatgccaaggtcagctgacggtgacgcacgtcaaagccatgcgagtgacggctgcgcgcgggctgaagtgagcatgctggccttccttggtgtgcatcaggtgcacatgcggcgcaagtcgtgaggttgacacggctagcatggatgaacgatgtctgacacacgccttggcagcaacgtcttcacaatgagcgtgcaggcttggacgcgtcctaatgtgctccgttgaggaagcctttggtcccctgcggcctccaagggaatgtgcccctttgtatgttccctctctactacgcatgttcagagactcctcgctcctccggcagtaccgtcgtcgcacgtcctcctagcgcgtgttgagcagtcacgcgggcttggagtgcttgccgtcgacgggatagtgtgaccttgcgctccctcgaccgcttgcgagtgccttagctcgcctgcgccaggcgcgccgtgaggcggcgagtgtagcgccttggcgcttggtcctgtcgctcgccagggagggccctttgggctttgcgcgctgactgcacgcccgaccggggcccgtcgcgggccttgcgtggcccatgcgtgtcaatgcccatgagcacgcagcgtgccagttatccgcccatagggtaggtccaagtgcgcccggaacggtttggccacgtggtgccctgtggtccttggctaacgaactcaagtggaagttcttcttccaccggtaggccagtaggtgggccttggcgtggccactgcacgtcgtccttgtactttggcaccgtcatgtcaagtgcttccggcaaagtaagagtttgggcgcatgggtcacgtgcctgtcgttggaccaggaagggtccaccgtaggggtgctatttgcattgccaggggaattgcccagtttgtagtatccaaaacgactgtgaacagaaaccatccccttgccacaccatggcgagcaatgtaactcaagatgttcccccccagaaatctaaccctttgggtattgacccaagctgggtcacccagagcgaagg

SEQ ID NO: 690777 - DNA, 1317 bp, Homo sapiens
  misc_feature (294)..(294): n is a, c, g, or t
  misc_feature (558)..(558): n is a, c, g, or t
agcggaggtgcgtgcccctgtccggcagcgcgaggagaccccgtcgcagtgctcgcagacgccctcggtggaggaagcatggaggtcatcgatccaggattgtgacagatattctaacaatcggctgcgagtacgaagactatcttcagctaatgccagactgatcttaagtgtgttggttggtgggcggatggtgcgtgattggtaaaatcaatgttcatccgtagatatccgtacgacagacaatactagaattattccatacagagcaattcactggtatccagacatgtntgtcttgaacaactaaatggcgagtcgaacagattcatcgactctgtgtcgcgacgatacccaatagtacctacatctgggcacgtttctttctcgactaccgttgccacgtgggcaaacgagcgcgagtgtagtagaccgacggagtttaacgggacacgggcatgggaagttttaactgcgcaagctagagatcacgagattgttactgtgtaccttaagggttcgttgttatgatgtctagcagagattgtgggtcctacntgcgtcaattacgtctccaattttttggaaaacaatccgctttgaagagcgcggaaaacaacacggtccgcggggattggcgcattggaacggtatttagagcggtccaagccaccaaacttgtagtgtttcaccgcaaatgagaaggaactcttctcagcttttgtccgtttggtctattatagtgatctgggggcggaactcttcaaatacaatgttctgggaatctctgttcaattggaaaggaaagttggaacccctcgcctgttctcgatcaccttctaatgttgtcggaatgggaaaaaacctgttcttggctccattaggtggaaaagtcaaaagtaagcctaatgggaaaatgcccgccgttaatttcaaaccgatacccgaagggaaacggaaccggttgggcgtttggaaccaacagaaagggcctatggggggggcccacatggagtatggatagggccgtttagtataaagcggggcctctgtagtcccaacaggttaacttgggttgcgcaaaggcgtgggatattccagttgagctaatccgcttttaagccaagcaaatggaacacgacggtggtccccttctaaaaactatggacaagacgttggtgtgaacgttttttggcaaaacagcgaaataatgcgcccacaacttacggtgtagagggggctcttgggcgcccccatatgtggggaaagagcccccttccccttagtgaaaaagcgtccggcaaccaaggggagaat

SEQ ID NO: 690778 - DNA, 594 bp, Homo sapiens
  misc_feature (80)..(80): n is a, c, g, or t
  misc_feature (86)..(87): n is a, c, g, or t
  misc_feature (92)..(92): n is a, c, g, or t
  misc_feature (94)..(94): n is a, c, g, or t
  misc_feature (96)..(96): n is a, c, g, or t
  misc_feature (107)..(107): n is a, c, g, or t
  misc_feature (125)..(125): n is a, c, g, or t
  misc_feature (139)..(139): n is a, c, g, or t
  misc_feature (144)..(144): n is a, c, g, or t
  misc_feature (146)..(146): n is a, c, g, or t
  misc_feature (148)..(148): n is a, c, g, or t
  misc_feature (155)..(156): n is a, c, g, or t
  misc_feature (158)..(158): n is a, c, g, or t
  misc_feature (160)..(160): n is a, c, g, or t
  misc_feature (168)..(168): n is a, c, g, or t
  misc_feature (197)..(198): n is a, c, g, or t
  misc_feature (211)..(211): n is a, c, g, or t
  misc_feature (214)..(214): n is a, c, g, or t
  misc_feature (232)..(232): n is a, c, g, or t
  misc_feature (237)..(237): n is a, c, g, or t
  misc_feature (254)..(254): n is a, c, g, or t
  misc_feature (302)..(302): n is a, c, g, or t
  misc_feature (409)..(409): n is a, c, g, or t
  misc_feature (426)..(426): n is a, c, g, or t
tggaaaaacaagagtggtaaaaaataaatctggtttaccggtcaaaaaaaagttaaaagggccccggaaaaggtcccttncctttnnagtcncngncaaaatccttnaagaaaataaaaatttangaaaaccaaccagnaattntnanttaagcnnananttaaagtnaatacccgtttcacatgctttcaagaatnngccaattactaanaancagataatggtgtttttnaaaancctaattgaagtatatncaaccaaatactttaatgtataaaataaatattatacaatatacttgnatagcagtttctgcttcacatttgattttttcaaatttaatatttatattagagatctatatatgtataaatatgtattttgtcaaatttgttacttaaatatatanagaccagttttctctgnaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagagttt

SEQ ID NO: 690779 - DNA, 255 bp, Homo sapiens
  misc_feature (2)..(2): n is a, c, g, or t
  misc_feature (17)..(17): n is a, c, g, or t
  misc_feature (34)..(34): n is a, c, g, or t
  misc_feature (36)..(36): n is a, c, g, or t
  misc_feature (48)..(48): n is a, c, g, or t
  misc_feature (56)..(56): n is a, c, g, or t
  misc_feature (60)..(63): n is a, c, g, or t
  misc_feature (94)..(94): n is a, c, g, or t
  misc_feature (96)..(96): n is a, c, g, or t
  misc_feature (127)..(127): n is a, c, g, or t
  misc_feature (129)..(129): n is a, c, g, or t
  misc_feature (133)..(133): n is a, c, g, or t
  misc_feature (176)..(176): n is a, c, g, or t
  misc_feature (178)..(178): n is a, c, g, or t
  misc_feature (221)..(221): n is a, c, g, or t
  misc_feature (226)..(226): n is a, c, g, or t
  misc_feature (243)..(243): n is a, c, g, or t
  misc_feature (246)..(246): n is a, c, g, or t
tnttgatataataaganctagtatcatataacananaactagaaaganggtttaantctnnnnctaatattctacaagcctcatggggaaaatntnttatgaaggattcaaatacattagataaaantnagtntcaataatttaactttgtacaaattatagtctgagatcttctnanttttcctaagacaaaggagtgtattatccagcaatttattgtnttgtnttgttataaaataaatnttntattaatgt

SEQ ID NO: 690780 - DNA, 414 bp, Homo sapiens
  misc_feature (9)..(9): n is a, c, g, or t
  misc_feature (14)..(14): n is a, c, g, or t
  misc_feature (16)..(16): n is a, c, g, or t
  misc_feature (23)..(23): n is a, c, g, or t
  misc_feature (53)..(53): n is a, c, g, or t
  misc_feature (59)..(59): n is a, c, g, or t
  misc_feature (61)..(61): n is a, c, g, or t
  misc_feature (69)..(72): n is a, c, g, or t
  misc_feature (74)..(74): n is a, c, g, or t
  misc_feature (81)..(81): n is a, c, g, or t
  misc_feature (84)..(84): n is a, c, g, or t
  misc_feature (86)..(86): n is a, c, g, or t
  misc_feature (95)..(95): n is a, c, g, or t
  misc_feature (98)..(98): n is a, c, g, or t
  misc_feature (100)..(100): n is a, c, g, or t
  misc_feature (121)..(121): n is a, c, g, or t
  misc_feature (232)..(232): n is a, c, g, or t
  misc_feature (238)..(238): n is a, c, g, or t
  misc_feature (241)..(242): n is a, c, g, or t
gatttgaanaattngngcaatanaccgaatgcactacatatatatatgctacncacacngnactaacgnnnngncaaatcnagnanactcctaanctncnataaaaatacaatatacttgnatagcagtttctgcttcacatttgattttttcaaatttaatatttatattagagatctatatatgtataaatatgtattttgtcaaatttgttacttaaatatttagagancagttntcnnctgggggtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagagttt

SEQ ID NO: 690781 - DNA, 205 bp, Homo sapiens
attgagtacttaaataatcatctcttccataagcattatcgggtctcagtctgcaccagacacagtggaggcgcaggtggaggaaccacgaaggctctacaggttagaagatgcagttcctgcctcaggaagccaaatcgctcgtgcttcagccgcagatgtctgtcagcccctactgtgtgacggtaacaccacagctacggga

SEQ ID NO: 690782 - DNA, 332 bp, Homo sapiens
gaaagtttccaagctaggtctggccgttgggatctcagcagtgggcaggaggtgcctgatttcgggagtcctacccgagcctgttccagagttggagggctctagcactgttgtcagcctggtctcccatcccgagcccaccgttcctgtccaacccacaatcgactggtctttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagagttt

SEQ ID NO: 690783 - DNA, 682 bp, Homo sapiens
  misc_feature (36)..(36): n is a, c, g, or t
  misc_feature (75)..(75): n is a, c, g, or t
  misc_feature (104)..(104): n is a, c, g, or t
  misc_feature (111)..(111): n is a, c, g, or t
  misc_feature (116)..(116): n is a, c, g, or t
  misc_feature (123)..(123): n is a, c, g, or t
  misc_feature (125)..(125): n is a, c, g, or t
  misc_feature (130)..(130): n is a, c, g, or t
  misc_feature (143)..(143): n is a, c, g, or t
  misc_feature (149)..(150): n is a, c, g, or t
  misc_feature (155)..(155): n is a, c, g, or t
  misc_feature (157)..(157): n is a, c, g, or t
  misc_feature (159)..(159): n is a, c, g, or t
  misc_feature (170)..(170): n is a, c, g, or t
  misc_feature (188)..(188): n is a, c, g, or t
  misc_feature (202)..(202): n is a, c, g, or t
  misc_feature (207)..(207): n is a, c, g, or t
  misc_feature (209)..(209): n is a, c, g, or t
  misc_feature (211)..(211): n is a, c, g, or t
  misc_feature (218)..(219): n is a, c, g, or t
  misc_feature (221)..(221): n is a, c, g, or t
  misc_feature (223)..(223): n is a, c, g, or t
  misc_feature (231)..(231): n is a, c, g, or t
  misc_feature (260)..(261): n is a, c, g, or t
  misc_feature (274)..(274): n is a, c, g, or t
  misc_feature (277)..(277): n is a, c, g, or t
  misc_feature (295)..(295): n is a, c, g, or t
  misc_feature (300)..(300): n is a, c, g, or t
  misc_feature (317)..(317): n is a, c, g, or t
  misc_feature (365)..(365): n is a, c, g, or t
aaattttatttttagttgcacaaatttgggccaaangaaacattgccttgaggaagatatgattggaaaatcaanattgtagaagaataaatacttttttactntccaaanacatntttatantnctctntaaattttccttncctttnnagtcncngncaaaatccttnaagaaaataaaaatttangaaaaccaaccagnaattntnanttaagcnnananttaaagtnaatacccgtttcacatgctttcaagaatnngccaattactaanaancagataatggtgtttttnaaaancctaattgaagtatatncaaccaaatactttaatgtataaaataaatattatacaatatacttgnatagcagtttctgcttcacatttgattttttcaaatttaatatttatattagagatctatatatgtataaatatgtattttgtcaaatttgttacttaaattcatatacgcttctgtcatttaaacaaacttccagagaaaactggtctctatatatttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagagttt

SEQ ID NO: 690784 - DNA, 124 bp, Homo sapiens
gaagtgaggagaagcaggaagcatgggaaaataggaaatgaggagaagcaggatgcatggggaaacaggaagtgaggagaagcaggacagcactgatggcttctcatacattctctgtcgacgc

SEQ ID NO: 690785 - DNA, 211 bp, Homo sapiens
gagacgcagcgaggttctgttcgacccagcggccgatgtgaaatctcctgcagcggatcctcaatagccactgcttcgcagagagaggaaggggataacccagcgccaccatccacggccagccgaaccatgccgttctaagcttgcacagccgcgcggcacagcagttagagttccagggtctcctccacttcttagtaacccggtccgg

SEQ ID NO: 690786 - DNA, 433 bp, Homo sapiens
taaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttgggaaaattgtaaaaggttggtaaccggaacctccttagggtaattttggccgaccgattttgcctccaggaagggcccaccggggattttttcctgggggaaatggccaaaattgttaacaaaatggttatatggaacatgcctattaaacgaattttactatcttccctaaaaaa

SEQ ID NO: 690787 - DNA, 316 bp, Homo sapiens
ctatgttcccccctatacagaagtgtttccatgtccacctatgggagactcacgacagccattatttctcaccccttacattgaagctggtgaagatccaaaaaggatgagaattgagtttggtcggtcctttcccaggactgaacatgaagagttatgccggcttcctcactgtgaataagacttacaacagcaatctcttcttctggttcttcccagctcagatacagcacgaagatgccccagtagttctctggctacaggatgggccgggatgttcatccatgtatggactctttgtggaacatgggcctta

SEQ ID NO: 690788 - DNA, 787 bp, Homo sapiens
  misc_feature (13)..(13): n is a, c, g, or t
  misc_feature (54)..(54): n is a, c, g, or t
  misc_feature (127)..(127): n is a, c, g, or t
  misc_feature (137)..(137): n is a, c, g, or t
  misc_feature (225)..(225): n is a, c, g, or t
  misc_feature (477)..(477): n is a, c, g, or t
gtgcgcccccccnacctgcccctcttccgcttccccgcgcccttttttttttcncatggttccgaagaggcattccatggtcagcaccgagcccggcgacatcacgacacgagtccgaggacggggngtgccagacncccacagacagggtagtaaacgtaccgccaggaggaaccgcgagaggagaggttgcgcgtggcgtgccgtgcgccccccgcccggcgnaaccgaccacacgacgacgagcgcacctcagtgtgagagaaggcaaggtgtacgagtaagacggaaccacgcgtttgcctgattctcaccaccccccaccgtcccttctatctgcttcctctcgtgcccgccgccagcgcccccggccgcccgcgcgccctccccccactccctcccacccacaccaccctcacacacggcgacacgtccggctcccgcgcattgatatagttctgagaggtgcgacgactnctcccattctttcatacttgtcccggctagtggacagtcgaactacctacgcctagcgcgccgcattgtctttcccgtctagcgagggagtggcctcgccctgtcccctccacggagactccgctgcttccctccccggccgcccccgtcctcctgcgtacccgtcgctcactgctccacacatcctcatcacagtcgcgtctcatactacctcaagccagaatctaccattcatcacaacaccctcgcgtcaccaccacactcgaccaatacgcgtacagcccagatccgtcaagtcaactactacacg

SEQ ID NO: 690789 - DNA, 86 bp, Homo sapiens
tttggggggttttttttttcttccctttgggtcccccctggggcccgtttttttccaagggggaccccttaaggggtttcccctta

SEQ ID NO: 690790 - DNA, 311 bp, Homo sapiens
ttatttcccccggggggaatttgggggtaaaaaccccccccccccggggggggccccccccttgggggggggccccggggggggggccctttttttttttctttccggggcggaccccccccggggggtacccccccccggggggggggggctttttttttttttccgggtcccccttccccccaggggggcccaggattttttggggcgccccttttttttttttttttttttttgggggcccggggcccccccccccccccctttgggggttttttttttggggggtttagcccccctttttcccccca

SEQ ID NO: 690791 - DNA, 106 bp, Homo sapiens
tgcaccttagatcgctctgacctgtagatcgctccaccaactaagaatcaggattttatttcttcttggctaatgaagcttagttgggctggatatgaaattctgg

SEQ ID NO: 690792 - DNA, 109 bp, Homo sapiens
ggctcagattggaaaagtggacccagtggagcatgtgcttgagcttcatctgaactggtatgccagtaaaactgtgagcatgtcccacccatctccccgaatggtgtgt

SEQ ID NO: 690793 - DNA, 411 bp, Homo sapiens
  misc_feature (43)..(43): n is a, c, g, or t
  misc_feature (97)..(97): n is a, c, g, or t
  misc_feature (135)..(135): n is a, c, g, or t
  misc_feature (148)..(148): n is a, c, g, or t
  misc_feature (162)..(162): n is a, c, g, or t
  misc_feature (185)..(185): n is a, c, g, or t
  misc_feature (198)..(198): n is a, c, g, or t
  misc_feature (230)..(230): n is a, c, g, or t
  misc_feature (263)..(263): n is a, c, g, or t
  misc_feature (294)..(294): n is a, c, g, or t
  misc_feature (299)..(299): n is a, c, g, or t
  misc_feature (304)..(304): n is a, c, g, or t
  misc_feature (306)..(306): n is a, c, g, or t
  misc_feature (357)..(357): n is a, c, g, or t
  misc_feature (385)..(385): n is a, c, g, or t
gacttgcttcaagagcatgggaagattggcaatttatccaagnaccatttttgatccaaccaccaatatttcttaggacttgtaaatattattgagnaaaggaaacagaggatgttccagatgaccttgatggtncccccatcgaggnagagcttgatggtncacctctgggagatgtagatggnattcctattgatnctactcccatcgatgatcttgatggagtcccnaaaaaaagtcttgatgatgatcttgatggagtncctttggattcaactggagactcccaaaagnatgancctananttaaagtttccccatccaaatgggaaactgtggatgaatctgaattggaancacaggctgttacaacttctaaatgggnattatttgaccagcatggagaatccc

SEQ ID NO: 690794 - DNA, 530 bp, Homo sapiens
ggagtcaaagagagagacaaagtcaaagagagaaagaaagagagaaagagagagagatacaaagttaagaaaaaaaagccatctataccaattctaatttagacaaaacaaggtcttattaatagcaaaggataattaaaatcccaaacttacaaggttttctttttattattattattattatactttaagttttagggtacatgtgcacaacatgcattttttttaaattttttttaaaggttttcaactaaagtttgctaaaagttaacagtgtaacatgtatatagtaacttatattcttgtggcctagtccacaagacacaaaaaaggttcgctttgggaaagaatggttatcatcttcgaaaaaaaaaagggaaaaaagggggggcggaatttatataaaaagagtattatatggtaaattcttgtcctgaaaccaaattaactggttgtttaaagaaataaatatttgtaataagtcagaaagttgaggcatatcgaagaattttctgcgaagtcacgaaaga

SEQ ID NO: 690795 - DNA, 124 bp, Homo sapiens
tctggatgcaagtgtcctatctgcgaatgagaaattcacaagacgcacaggaattttcttgaagatagagaaagtgatggctttataagatgcctctctcttaactctgggtaggattttaact

SEQ ID NO: 690796 - DNA, 345 bp, Homo sapiens
gggctgcgctggtgtgagagggaggtagtagcctgatcatataatgtcttggtggttatagcaggggattgctttggaggagagatgatggaatatttttctttttaaattattgtagtttagctctttgaaggctcacaccccacaggaactataataggctgcatctgaccttcagtagattaatagaaacatcccctgttaagcccaggaggagcgtgccctcagaggcattatttttctgctattgaaatactctggtcattactgggaaagcccacagcactagctgaggttgtgtggtctaatttatatgttgtgcaagattttgcaattggagatacg

SEQ ID NO: 690797 - DNA, 394 bp, Homo sapiens
  misc_feature (15)..(15): n is a, c, g, or t
  misc_feature (43)..(43): n is a, c, g, or t
  misc_feature (53)..(53): n is a, c, g, or t
  misc_feature (191)..(191): n is a, c, g, or t
  misc_feature (211)..(211): n is a, c, g, or t
  misc_feature (252)..(252): n is a, c, g, or t
  misc_feature (316)..(316): n is a, c, g, or t
ttaaaaaactaacanccattaacaatagtttaaaacacccagngtggaagatncttacccgccacatcccagattgggaaaagccggtatgttggggtgccacaaacatggggtaattgttaatgaaggaccatgtggcccacccggaattaaaatagttaaggagggccttttgaaaatgatggtgaagnccctcagtgtgcctgaagtnataagacactcgccccaagaaagaggagttttttcttaggnctgtgacctgatttgacagaaaacatattcctgggttttggaagaaagaaagaatttgttctcnggttattattattatttagatatgagatgctttgatgttatgcaatttttctctgtactacttttttgcaagaagtgg

SEQ ID NO: 690798 - DNA, 216 bp, Homo sapiens
cctatgaaaacttcccatcatcgtgttcttctcctcttcatcttatacgtattctagtcctctcttatagtggttccaagggcttcctttatgttcctcagtgggttccagacccattcgtggctatgtcttggatggggaagatgctccttccaaatatgtgcgtgggcaagtcgttcacttccttcaagtctgtgcttaagtgtcactatgagc

SEQ ID NO: 690799 - DNA, 352 bp, Homo sapiens
atagtgacacacatgtctgaaaaagccacaatgaaacccagtctttgtatgctaacctgaagttaatttagagcaagcataaaaaaatattgtgtttttttatacttttttgggtgtgtatgtgtataagtgagatgtgtgtgtttatgttcatatcggtgtgtgtaggcatatgtgcacatgtgtgtgtgcgtgtgcgtgtgcgtgtgtgtgtgtgtgtatataacagcaacatcttaaaatgaaacaaaaatattgcatagtgagagaatgactaagcagccactaaagtactgcttttagagaatatcaaatgacatggaaaactcaaaaatgtacaaaatgtcgacgc

SEQ ID NO: 690800 - DNA, 405 bp, Homo sapiens
  misc_feature (87)..(87): n is a, c, g, or t
  misc_feature (147)..(147): n is a, c, g, or t
  misc_feature (185)..(185): n is a, c, g, or t
  misc_feature (187)..(187): n is a, c, g, or t
  misc_feature (201)..(201): n is a, c, g, or t
  misc_feature (230)..(230): n is a, c, g, or t
  misc_feature (259)..(259): n is a, c, g, or t
  misc_feature (280)..(280): n is a, c, g, or t
  misc_feature (283)..(283): n is a, c, g, or t
  misc_feature (291)..(291): n is a, c, g, or t
  misc_feature (322)..(322): n is a, c, g, or t
ggtaaccaccaatctactgtctatctttaagcatctgctttttgttgttgttgttttgttttttcttgagacggagtctcactgtgncacccaggctgaagtgcaatggtgcaacctcacctgactgcaacctctgcctcccaggtncaaacgattctcctgggctcaagtgatccaccttcttngncctttcaaagtgtngggattacaggtttgagccaccatgcctngctgggagatttttaattaaggctttgantccattatttgttactggttngtngaggtttncttttctttcctggttcaattttggtaggtngtgtgtccatgaatttatccatttttctgggtttttcaaattggttagctggtatagtagtggatagtagtctctaatgagtc

SEQ ID NO: 690801 - DNA, 511 bp, Homo sapiens
  misc_feature (57)..(57): n is a, c, g, or t
  misc_feature (71)..(71): n is a, c, g, or t
  misc_feature (96)..(96): n is a, c, g, or t
  misc_feature (187)..(187): n is a, c, g, or t
  misc_feature (219)..(219): n is a, c, g, or t
  misc_feature (252)..(252): n is a, c, g, or t
ctacagaacaacaaaggcaatttctcataaatttcctcctttatgcctggcttaaantcataagttaaaanggcaaagactgacaaacttagtttnccagaatcttcctcacatacaccctgttccttattggtcccatcatatggcaatataaaacggagctgtctgtagcagtggttgtgacagnccatggcccaaacaaaacccataaggcacttnatcttaaagtccatatcacacagagaaatggcntcaaggatgtcagaaagtcatctgatcacttctttgtccctgattagctaattggcactacacataagccaaaaacaaaaacaagaaaaaacaaaaaaaacaaaaaacaaaacccaccagaagtctaacccagtgacagtgggcactgtgcatccttggttatgaagcaggagggtggaagctcacaatcctagggctttcctctccctagaaggcacctggttctggaaccatgggagttcttcaggtaaggtgatgc

SEQ ID NO: 690802 - DNA, 284 bp, Homo sapiens
tgtttaagctgtagtctagcattatcacctggaggtcaggatatccagaacatcctggtcatacatggtgaaacccggtcactactaaaaacacataaaattagctcgaggtgtgtggctcgtgcctgtaatcccagctactcgggaggctgaggcaggacaattgcttgaatccaggaggcagaggttgcagtgagccaagattgcgccactgcactccagcctgggtaacagagtgatgactccatctcaaaaaacaacaacaattaacgaccgtatccgca

SEQ ID NO: 690803 - DNA, 395 bp, Homo sapiens
ctccagagtctggagaagggggtgcagcagctgatccattcactcttttctctcatcctcttcttcagacgtgcttctatgggcgcgttaagcactctttggatatcatcgaccctcgcacactctttgtcactgagggaaggcatgggtgtgacctcagtggcccttgggcctttgtaccttgtgatttcagaatatgtgggtcattaagggagggtgaggatgggggagtgaagagaatatgggaggtgagaggtgagaggaaagtaacttctctctacctggagctggctggttatggatctgtgtggctgtctgtatctgagttgatacattgtgctgtatgctctttacattatatcatttggatctcacaacaaccctctgatagattt

SEQ ID NO: 690804 - DNA, 157 bp, Homo sapiens
  misc_feature (136)..(136): n is a, c, g, or t
tcctgagctcatggcgatctacactacggaaaacggcattgcgaaaagagctctctcgctgagacctgatagcactgcagtctggacccccagcgatcagacatgatttataccctagaagatgtcctccctgtanctgtgtatatatctggggcta

SEQ ID NO: 690805 - DNA, 317 bp, Homo sapiens
ttttgatgagcctagggggttttttttttgaaagtccgctgaaggatggttagaccgcccaacgaagactgcttaatgccctggcccccccccttagaatgtggtttttgttcccttttatttttctgggggcttttggttttgtttttgttttgggagattttccatttgggtatttgggggagtgaacctcgttgttttgctggagggaagattttgatggggtttttttcccccaaaattggctttgatttttaaatttgggggttataaaaaagagtttaaaaaaaatagggttgcttccatttaaatttcca

SEQ ID NO: 690806 - DNA, 741 bp, Homo sapiens
ctcccgtgaccccttccctcacccctccctaagctcggtgcaccggatagcccttctgtgtcctgttgcccagcccagccctagtgtcagggccgggggcctggagcagcccgaggcacgcagcagaagagagaaaagacaacggaccgaccctcagctcgccagtccgggtcgcgtggcttcgccgccggcatggcaatggagacagacgccggctcacctgcttctggccacgacgcgacccgtggttgattgggccttcagtgggcatcacgccttatgggtatttcttaatcagcgcttgcaagagatggtaaacctatgctacgccagggagatacaggagactggatgggaacattttgggtcataagaggtgcgtgtgggggtgcaacactgaagtaacggatgccaccaaagcagctacagcagctgcggatttcacagccaaagtgtgggatgctgtctcaggagatgaattgatgaccctggctcataaacaccattgtcgagaggtgtggattcagcgcaggatagtaattaatttgttaaccgggggacaggataaacgtgttacgcatatatgacttgaacaagacctgaagcagaaactaaggaatttaggggcatacttctggtatagaaaagctctggggggattgagggttagcagattttttggggatgacaaagtgtcgatggggtatgggctatgagaggatcttaatttatatttggacg

SEQ ID NO: 690807 - DNA, 273 bp, Homo sapiens
gctgcagtatactctgctcatggcaggtcttgtatggatcttgtgctggcggctgagcaatatagtgtgagccagtgacccatgaacttgctgctctgtgacggccaagagtcagggccagtcatggtaatgggcctgaaggcacttatccagaacctatttatgtctctcgtgagcccatctgttaagaactgttcttcttggatgtggttggtaggcctacgctgtcgcatattctgggaaaccttccttgagtgctattcgcacatgtgt

SEQ ID NO: 690808 - DNA, 189 bp, Homo sapiens
tcaagttagcaacgacagatacattttagttaactgtttcatattccttatattatttcagtatgaattaagataaggaatatgaaacagttaactaaaatgtatctgtcgtcgctcttttaaaatgtgatgtagacacagtgtggaaaagtgtcggaattagaagttatccagggtgcacactctttg

SEQ ID NO: 690809 - DNA, 426 bp, Homo sapiens
  misc_feature (8)..(8): n is a, c, g, or t
  misc_feature (68)..(68): n is a, c, g, or t
  misc_feature (212)..(212): n is a, c, g, or t
agaaggcnagctcttgactctgaagttcaggtgggaaaaaaatgctggttggataaaacctccctgtnaaggcctctgagccccaagctaagccatcatatcccttgtgacctgcacatatatatcccagatggcctgaagtaactgaagaatcacaaaagaagtgaaaatggcctgttcctgccttaactgatgacattaccttgtgaaantccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggctcagcccacctgcacccaggtgattaaaaagctttattgctcacaca

SEQ ID NO: 690810 - DNA, 517 bp, Homo sapiens
cttggatcatctgtaaggagagcatcagtgtcagctcagagcagctggcacaattccgcagaccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagttttacagattgatttgaaggcatgctgtcttgctaatattgaaataaatttgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctcttt

SEQ ID NO: 690811 - DNA, 1008 bp, Homo sapiens
gcgtcgttctggattcccgtcgtaacttagagggaaattttcaccaatgtccggagcccttgatgtcctgcaaatgaatggaggaggatgtccttgaagttccttgcagcaggaagcccacttaggtggcaccaagtcttgcacttccaggatggaaccagtacatctgaattacaacaggaaaaagtgatggcatctatatcataagatctcaagaggacctgggagaagcttctgctggcagttcgtgcaattgttggcatagaaaaccctgctgatgtcagtgttatatcctccaggaatactggtcagagggctgtgctgagagtttgctgctgacactggtagccactccaattggctggccgacttcagctcttggaaacttcagctaagccagatcgcaggcagccttccgggagcgacggttcttgtggttactgaccccagggctgaacaccagtctctcacggaggcatcttatgttaacctacctaccattgcgctggggtaacacagattctcctcgtggggctatgtggacttgcatcccagtgcaataactagggagctcactcagtgggtttgatgtggtggatgctggtcgggaagttctgcggcatgcgtgggccatttcccgtgaagcaccatgggaggtcatgcctgatttgtacttctaaagagatctgaatgagattggaacagaagagcaggctgtgctcgacaagggaggtgaccaggggaatctccggtgatggactgctcccgaccctgaggtcactgctatcagctgagtgccgactggtgagtggaaggtgcctctgtgcaatagaaaaccactgaaatgggggcagctgcaagaaaagggtgggggcccggccgccgatgtgggaccctggggttccggcggttgtaaccagaatggggactttaaaaaaaacgctctttgggggggggttccctcttgatgcttactttttaattaaatattaaaaaaaaaaaacgaaa

SEQ ID NO: 690812 - DNA, 358 bp, Homo sapiens
atggaatggttcagttggtttaggccggcagtctgtctacctgctgagacctagacttatagagccagactcaagctatgggattcccctgcccgagcttagacaacactgacccacggtgacacactgcatggcgaacactggaggtcccttatctcaggccgcagaggcctgatcttgggttcggaagcatgagccgaggacgttgcctgtggcccactctggctgctagtgggtctaagtggaccagtacctcactggacccaccattatctgacgcactcaatgtgtgaccaccattcctaccacatatgcctcctgcgcggtcttagtgagcggagagctgaccagcaggctc

SEQ ID NO: 690813 - DNA, 295 bp, Homo sapiens
aaatttccccgggggttttgggggttttttaaaggggaaaaaaaaaccccctttaaaaccccccccgggggggaaaaaaaaaacccgggggccccccggggccttttttttttttggaacccaaggcccccccccccccggggggtaaaaatgggggaaaattggggaatttaggggggccccccttttagggggggggggggttaaccccaaaaaagggggttttggaaccctttggggtttttcccccgttttggatcccccaccccgggggaaaaattttttttttttttta

SEQ ID NO: 690814 - DNA, 149 bp, Homo sapiens
cgggggatctctggcttcacagagatcgcgagctgagcagccaagagagagggtcatatggttcccaatcatgaacaggcacattctacaggcacggtcccaggggcatatagccttctacttgtccaaccacctgtcttcgcctgcat

SEQ ID NO: 690815 - DNA, 300 bp, Homo sapiens
gcaggtctttggaacctggtggagtggctgtcacatgggtccgtcccctgacatctgggaccaggccgctcctaggaacagccagcagcagtggactgggagggtgttgtctctagggcctccagcagagtcttggccccagctggcttgccaggttctggtctcccaggacacccccactttcgctcctcccaccaggcaaggagatctcttaaggggtagcgctgttcttcaccttggcgagaaccttctctctttgaccggcggtctgaaccatatggtatctggcgctccgagagg

SEQ ID NO: 690816 - DNA, 462 bp, Homo sapiens
  misc_feature (301)..(301): n is a, c, g, or t
  misc_feature (404)..(404): n is a, c, g, or t
ctgactctgcatttgtgtgagggtgggagatccaccttggatctcagctttggcttttggatgtgaggataaattcagggtctttttgtctttaaaggaaaaaaggcctgcattcttcctaccaatccgtcagagctttacttaggaacaaagtgtcctaagcttccgagaaattccctatccctgggaagcaaccccagggttcacgcaaccccagggttctcctgtaagtgacaggaatggttgctctggaggaattctgagttgctgctaactccccgacaagcctgcccgaccaagngcccctcggcctcctgtcatccctgaaacttgattcagggtttttgtccttgctaagggaagccaaaaagaaaagagtcttactccaatctttctggcccttngctttcctcattttccttctcctgtgaagatctcgaacaagcgtctttgaaattgggc

SEQ ID NO: 690817 - DNA, 310 bp, Homo sapiens
cttgaagcaaatggtggacaccaggtctacgaagaaactgttgcacatctgccggaagcgggcatgcttttcaatggtttcccttagaacacgagaaacagaagacaggtggatggtgtttcccaaatgcctccttacagaatgacttgagatttgcacagcatttcacttttttttttttgggaaagggagtccactcgtgtggccagggcgggagtacgggggcgcgatctcggctcaggggaacctcaacctccagggtccaggtgatcctcggtgctaagcctccaaggtagcggggatcccgggc

SEQ ID NO: 690818 - DNA, 154 bp, Homo sapiens
aaaaaaagggttttccccgggggggtttttgccttccccccggaagggggttaaaggcaaatgtttttgggcctttttttccccccattggaggggggcccggttttttactggggcccctgccccctttccataaagccaataaatgttttta

SEQ ID NO: 690819 - DNA, 417 bp, Homo sapiens
ctccaccatactgccctacaaccttaacgtgcccgtagcaccccctgaatgctaggcgatctagatggaaccctgacacaatgaatatgtgaccggaggggatggatacccccttatggccctgcatactatagcacggactatgagctatacctactgcataatgaatcacctgttggcttgccatggagagacaagcctaacactttcagaactggactatctacctaagaccagctctcagaacacacgcgtctatgcacatccatacttggaacacctataggtagaggcgacccacctaccgactctcaagatacctagttatgcaagatagcatctgtagcactgctttcatgagctcactgaagccctgtactaccactgactggccaactgttagttgcgaggatctgt

SEQ ID NO: 690820 - DNA, 484 bp, Homo sapiens
atgagctccctccatcataactacatgacgtcataactactactcatccccatcctgctcgattccataccagacacattcctccttgccggtgctcacaaccatcaatctctcaccttaatgcctttctttatactgtctgaaactctgaatggaaccctcttcccccagatatccaaattgctaaccctcttactctttagaatctttgctcaaatgtcatcttctcaatgaggcctacctctgaccatctatttaaattttcaatctgcctttcttcctttatattcctacagcaatttcatcttctggtatagtatctaatcattatgcttattgtctatcatctctctctttcctgcttgcatgaaagtgttatgaaggcagaatctctgtgtctttttgtacaccaatgtatcccatgcgtctaaaacaggacttgtcacataattgatgcttaccaaatattaattgaatggaacga

SEQ ID NO: 690821 - DNA, 274 bp, Homo sapiens
  misc_feature (239)..(239): n is a, c, g, or t
gtcagacgctgaactatttgacacagacttgccaggcagcctggggcagagtgaagagaagccctgtgcctgcttgcgcgctgtgtcccatgcccggttggcccctggccccatgtgccatccaagaaggaaatccccctgtgcggcaagtccagcctcgctcttgcggttagctctgtactgtccttgaaccgctgttgttcctgtctttttccgtccatgcttgttgaacgtgcacnatagttacagcgtcgtgagcgggtacccgagctcg

SEQ ID NO: 690822 - DNA, 260 bp, Homo sapiens
agcgggccacctctccctcagacttcacgcccaccacccttgccgttctccatgatgatgtcgtccacaggtttggtcagcatatatgtccccccatagatggaactcaatcttgcaaaaccctggggcgctcccccaagccgtagaggcggtataaaatatggggcttttgccatacctgggccagggactcactgtacaaccttgaagcggttgacggtcttcaaggcaggcctgtccaggtagtcctcaatgcgggc

SEQ ID NO: 690823 - DNA, 222 bp, Homo sapiens
gggtgacagaatgagaccctgtctcaaaaaaaaaaaaaaaaagtataaattatttacccaatatttggcgaatcagtgagtgacagcagttgtagtgctagtgggttaaatcaaggaataactgttgggaagtgaaaattttaaggagcgcctcctaccaccatgcagttcaaaaaccaaaaataagaaataaagtgggcttgctgagtgctttcattctgc

SEQ ID NO: 690824 - DNA, 707 bp, Homo sapiens
  misc_feature (672)..(672): n is a, c, g, or t
  misc_feature (681)..(681): n is a, c, g, or t
  misc_feature (683)..(683): n is a, c, g, or t
tatgatagcactgaacccagccacataaacacaggtcggaatgcctccaggtgtgggccaacgggcagaaggaaccgagaatgtttgcttttaagcaaaaatggatgttgttttcataaattactaactctgaaacatttccaaaggtactgtacatagtgctgcttcccagtgaggaaaatttccttttcaacattggcacttgctgtctgatatttcattaataatttgaaaggttttcttagtcacttaagaagattttattctctcgattatccctctcccttgcctgtcttccatccattgtacccatctcactggctcttttcctgcttccttcactcaagtactatcaactcaaacaatttcacttgactgagttgcctcaacctgttagtcactctgcattcccctctccccacagcccctgacaacaactaatctttttctatctctagatttgcccattctggacatttcacacagtgcaatattataatacagggccttctgtgtctgacttctttcacatagcataatgtattcaagggtcatccacgtcatagaatgttactagcacttcatttcttttttatggctgaataatattccattgtatggatatacaacattttgtttatctgttcatcagttgatggacatttgggttgnttctgcttngntggctattataagtaatgctactt

SEQ ID NO: 690825 - DNA, 892 bp, Homo sapiens
ctgagctgactccgtgtgttattgcatcgtcaaaagaccggatatggactgtctctatggaatagacgctgcttcattgcactatctcaatgcgctcacactaaagctcaagtacccacggtagtatatgtctgtaactaattgagtgggactgtaacatgatgcatctggggacctgttttgcagaatctcttggaccatatcctgcttacagactaccaaacgtgactgtaataactgtatatgtatatctcgaaatgtcataatggtgcaatcagacttgcctcagagactactgtgcgaaatgactgttcaaagaacaaagagactcaaagcgacaactagtggaaacaaagactacaaatcagccagaaagaccatagcacagtggtcgttttcgtactagggactgtggagggagagtatagtataaagatcccgtagcgtagacttagcccttgctgtcatgcagcacagtcctcgggacgcagatgacataactgctggactgagccactttcctacccagcagtagctccacgcatcacacggtgttacaggatagcctacgaaacagaaccattctggccatcattagtaagtccgcatctgataaccacctgcataggacccgaaaaatttttgtagaaaaccctgagaatgctgggaatgaacgtcaaccattctccctttgtgctgaacaactacgtggcaatttcaccatgtcacttctcgatcatcgtagccttctgtctcgctcagattcggtacatccccctaagtagttcattgtccgtaggcggctacctgaccctaacgccaaatacccgaattacttcccctccaaacacctcacaatcggaccgcccagtccttcccacactccttattc

SEQ ID NO: 690826 - DNA, 518 bp, Homo sapiens
actattttagggttggaggtgcagatttcattgacaatcagaaagggcaagtttgatttgtcttttcatcctaaaagtagcaacaagtgtttgcaaaaggctggctctttgttcagtgcagatttgtatatgtccctcttgtgttttacaaaataaatgggcacctttaatgtcatcacaatgggaaatgatttaactacaatcacattgtgtctgttgaattttccactaaatgatctatatgccattgtgaagccccatgcaaacctttattccactgtagattttgtgttgcgtagtgttgagaaatatttttaatggtcttttaccccctttactttaaagcttgctatagaagcttgaatgtaggaaaattcctcttcagccagaactgtagagttgctagggccccaccattgtaactgacagcagaggttcagcaaagttagttctgaggtttgcattatcaaatctacccagattttccaatctacaaaacatctattcacgtacattta

SEQ ID NO: 690827 - DNA, 171 bp, Homo sapiens
ttcgttagatatcctatagtctccaaaaattgatggaaccagaacaccccgagatgagatggagaatgagcccagcacaacgaattgaagcggcggaggatgaacaagatcaacaactgtatcgtcagctttcgaaaatcattccagagtgtaacgcagaacgcgcctaat

SEQ ID NO: 690828 - DNA, 196 bp, Homo sapiens
caattaagaaagcgtcacgctcaacaccactcactcaaaaaagtcccaaacatataacatagaactcctcacacccacattggaccaatctctcaccctatagaagcactcatgatcgaataagtacacctgaaaacattctcctccgcctaagcctgcgtcctattaaaacactgaactgacaattaacagccca

SEQ ID NO: 690829 - DNA, 165 bp, Homo sapiens
  misc_feature (93)..(93): n is a, c, g, or t
  misc_feature (131)..(131): n is a, c, g, or t
gaggtatacgaccaagaggagaggagcggagtcatgctgcagaggggaatagtgggctaaagaagctgtcctcactccgggcagaagacaggngctggattggagtgactccaaccctgagggcttgtgcnctgaagccaggatgcagctacggtaacaccacag

SEQ ID NO: 690830 - DNA, 433 bp, Homo sapiens
  misc_feature (49)..(49): n is a, c, g, or t
  misc_feature (81)..(82): n is a, c, g, or t
  misc_feature (84)..(85): n is a, c, g, or t
  misc_feature (365)..(365): n is a, c, g, or t
  misc_feature (379)..(379): n is a, c, g, or t
atctatttttgattaccatttttggcaggtatatactaatttatagtgnggaaacataatttgaaatgactgattctgttnnanncatgttaaatttaagatttacatttttgctctttcactggaagctgagtttgtcataagcatgattattaaaaagtacaattttgaggtctagctaaaattaattatttctatgtttcagaatagtaaacatatttatggcattttttaaaagtatttatttatgaatgagagatggggtcttactctgttgcctaggctggaatagagcagtgtgataatagctcattgcagcctccaactcctgggctcaagcaatcctcccacctcagcctcttgantggctggtgccacnagttgcgccactgcctgggcaatatagcgagaccccgttctccagaaaaaggaa

SEQ ID NO: 690831 - DNA, 366 bp, Homo sapiens
aaaaatccgccctcatgattcaattacctcccacctggtccctctcatgacacatggggattattccaattcaaggtgagatttgggtggggacacagagccaaaccatattggctactatcatctgtgtttgttaaggcattataagaaagagatgagttccagagagaatgccaacttgtaagaggaaaacaaaagaaacagatactgtctagaaattcagagtcatgcaggactgataaagccatttgcttctagactccaaagagtatgatatgagactttgaaggctttgaaaaatgaaacgtgaatcttcccagtcctactagcctcagtgtagttgcctttaaattaaaaggcaataat

SEQ ID NO: 690832 - DNA, 292 bp, Homo sapiens; identical to SEQ ID NO: 662244

SEQ ID NO: 690833 - DNA, 259 bp, Homo sapiens
gggcttggctgggcgtggtgacttatgcctgtagttccggcagtttgggaggccgaggcggttggatcatgaggtcaggagatggagaccatcctggctaatacggtgaaaccccgtctttactaaaaatccaaaaaattagctggccgtggtggcggcctgaggcaggaaaatggcgtaaacccagaaggcgaaggttgcagtgagccgaaatttggcaatggaattcaacctgggcgaacagacaaggattttgttt

SEQ ID NO: 690834 - DNA, 107 bp, Homo sapiens
  misc_feature (54)..(54): n is a, c, g, or t
  misc_feature (84)..(84): n is a, c, g, or t
ccacttcatctaggccagaatacaaggtgctgttctgcagaccccagtcctccnggctaagcaggttgtcggtgaagaaacgcntcggtcagcaatctcgtctgaca

SEQ ID NO: 690835 - DNA, 469 bp, Homo sapiens
  misc_feature (289)..(289): n is a, c, g, or t
  misc_feature (306)..(306): n is a, c, g, or t
  misc_feature (374)..(374): n is a, c, g, or t
tcagctacaaagggcggggatgtagggtgagctacggcgccgggcctagtatccatggatattttcaatatcagcctttcttctgacttaatgagaatgaagtataataggatttttaaaataaggaatcaaaaggtatttaatagttattcctagattggtccccataattttcttggcggcttaagctaaatccaaatgtagtagtggaagtatccacaccaatatgaggttggtacaataaattagatttagtacttaaagccggtgtgtccttagcaaaagtatnagatctataattaggtntctcattcggtggcccaggctgaggtgcagggatgtcatcacagcccacggaaaccttgagctccggnactcaagttatcctccggcctcacatcccggagtagctataggtgcatgccaccatgccaaacttttttttttttgtggggcaaagaggaggacc

SEQ ID NO: 690836 - DNA, 701 bp, Homo sapiens
  misc_feature (2)..(2): n is a, c, g, or t
  misc_feature (66)..(66): n is a, c, g, or t
  misc_feature (76)..(76): n is a, c, g, or t
  misc_feature (84)..(85): n is a, c, g, or t
  misc_feature (121)..(121): n is a, c, g, or t
  misc_feature (128)..(128): n is a, c, g, or t
  misc_feature (132)..(132): n is a, c, g, or t
  misc_feature (135)..(135): n is a, c, g, or t
  misc_feature (144)..(145): n is a, c, g, or t
  misc_feature (147)..(147): n is a, c, g, or t
  misc_feature (176)..(176): n is a, c, g, or t
  misc_feature (302)..(303): n is a, c, g, or t
  misc_feature (307)..(307): n is a, c, g, or t
  misc_feature (317)..(318): n is a, c, g, or t
  misc_feature (321)..(321): n is a, c, g, or t
  misc_feature (325)..(325): n is a, c, g, or t
  misc_feature (336)..(336): n is a, c, g, or t
  misc_feature (344)..(344): n is a, c, g, or t
  misc_feature (346)..(347): n is a, c, g, or t
  misc_feature (352)..(352): n is a, c, g, or t
  misc_feature (357)..(359): n is a, c, g, or t
  misc_feature (366)..(366): n is a, c, g, or t
  misc_feature (370)..(370): n is a, c, g, or t
  misc_feature (373)..(373): n is a, c, g, or t
  misc_feature (388)..(388): n is a, c, g, or t
  misc_feature (399)..(399): n is a, c, g, or t
  misc_feature (403)..(403): n is a, c, g, or t
  misc_feature (407)..(407): n is a, c, g, or t
  misc_feature (414)..(416): n is a, c, g, or t
  misc_feature (419)..(419): n is a, c, g, or t
  misc_feature (572)..(572): n is a, c, g, or t
  misc_feature (601)..(601): n is a, c, g, or t
  misc_feature (651)..(651): n is a, c, g, or t
tntcattctttattaaccctccttggaattttgaaaacctcgattaaagtagccaaattgattacnggatccagancacaattnncccctcagaccagatagacagactgacgccactganctctgcnaggngtnaacatgggnntncttttgctggatttggagaaatgataggnaaaaaaccaatggtgaaatttcaagtttcaaaaaccaacctttcattaccaatcccaggcaacaaacatgtccctgagtgttctttaagaacatttgggatttatgtacaatttaatactggggtnngggntttttccttnngantgcnaaccttatgangggtgtgngnntctangggcnnntgctttngggngcncctttctatattgcncagtgggcaantggnttangtgaggnnnganactagaggggtaaatttccagatcaacatggctatggtatttagtaatggcccagcttagagacttcagctactgatctcatcacttattagacaaattgctgctgaccttacgcctgtatattaagcctccgcaggtgccgggcaatggtgnagaaactccagatatcaaggaattggganatcctggccaaaccaccccaagatgattacactgaaatgtagtattagtnctgctgccagatctctttttaacatcatgtgcgtctcttgggatccagca

SEQ ID NO: 690837 - DNA, 303 bp, Homo sapiens
ggcggggattacagggctggggccacggcgcccagccttaaccacttaaaacagtacaatccagtaaggtgtagtggtgtccacaatggtggtgaaaccatataccactaaattccagaaacatttccatttacctttccccaagaacagcccaagtacctccaaactctcccctggacaaccactaaatcttctaatctgctatgggatttggcctttatgggatttcaatatgcagtgggaatcgatatagaggtggtgggccagttcgtggtctgggctttctttcaggttagcggtaat

SEQ ID NO: 690838 - DNA, 594 bp, Homo sapiens
taatctagaggatcccatatggcgaatcatggtatattccatggtgttttctttagggacaggagctaagggaagtgacagtcatgtcaaaggaagcatttctagaaaaaaaggagataaggtttttaaatttcattatcaaactggggcaattcggttggtgtaactccccgactaggggatgggagagtcccatggctaaaattcagctactcagataaattcagaaggggtcagggcaccggccggttttggtgggtgcacagagatggactggattcagagagacaattcactccatccctatggcagaggaaggggttagccctaaggtagaaggtcatggtttttaaaacggttttatatcttaagagtgcctcatcaaagtatagatgtatgtcttaaaatgtggggtgatgggaattttaaagatttatatagtgcatcaaaggccttagaataggaaaggcttttttaaaatggcttaatctgtatatctgacctcttgaaacttatagctaaaacactaggatttatctgcagtgtggcggggagataattctggcttaaattgtctaaaacaaaaacaaacca

SEQ ID NO: 690839 - DNA, 436 bp, Homo sapiens
agagtctctgggctaccacatcttcactcttcctccactcccttcgacacattggattagagaaaagaaaacaaaggtgaaagatgagaccagaggcataatgaactgtttaaggggaatacaaggtaaagtgttcatagaagatgtcagcaactaattatgaaaactcgtcttaagagaggaacttgacaggctgtttttctttcatttcaagtctcttggcccgttgtcgagaataagcaaatacacagagtacctagcgtttatgtattttacacagagccatctaatgaaataacataagttacttgtaaaggtcactgtatacaaaatacagagatgttttataagttttaaacagtttttttttgaactagaacgtggatggtacgttgccctgtagtcacatgctacgtgaatctggcgaggcagcaga

SEQ ID NO: 690840 - DNA, 327 bp, Homo sapiens
ggcacgagcgccccaagtcttagtgtgttctaaacttttttttttacccagaccttttccgagcaataaactattaaaaaaaaaaaaaaaaaaccctgctacaaagaaggtctcccctcccagggggaccaaaagaaacctcccggccggttccagaggggccctttctcccccccaaccccccccattgtttcagaaaaacaactgaaaagaggctgggcgggggctcaccccagtaatctgctgacgcgggcttggggtcgggagttcaagactagcctggccatcatggggaaagcctgtctttactaaaaatacaaaaattag

SEQ ID NO: 690841 - DNA, 1035 bp, Homo sapiens
  misc_feature (170)..(170): n is a, c, g, or t
atctgtttggtaatctaatttatgtggtcattggtctgaccaaagatatccttactgcatcactgaggccagatataggacaactgttcaccatttgtgtttggcttgcaaattatgcacgagtgctaggtaattatttggtatcactattgcctattctaccgcagagncaagagatactatcatatggaaaatggactgactagttgaaggacctgaagatctactggagcatacacaagaagttgtacctcatgagcgccaattgtcattgtagtgttggcttatccatcatgctacatggttcccaaaatggtaccatttgaacatttctcacgcacaaggaatttcactataaataaaggggactagaagcgctttgttgtcaaacctggttcgcaggtgtatttacaatatagtgtgtgtttcactcttaaaaaatgtgcacaattaaagaaccgtggcttcaccttagaaggggggtggctccattaccacaaggaaaaacacacaacaacacacaacacaacacaaagacaaggagagaaaacaaaacaaaaaaaaagaacaaagagaagacaagagacagaagacaagaagacaacacagaacacagacaaaaacaaagaaaaaacaaaagacaacaacacagaacaagacaagaaaacgagaggggagggcgaggacataacaaaaacaacactccccccggaggagacgagcaaaagcaaaagagagcgacacgcaaaaccacgagagctcaacagaaacaaagagggagagcggcgaacgctaataacaaggaggcagccacagatacataaacaaaaagaagcgaaagaagacgaggcaggaagcgccaacaacaaaacacacgaaggcaagcggagtgagtgagagaaaaacaaacatacgaagcaaaacgagcgaaaacaacctaaataaaaaaagaagaggaccaccactaactaagacctcgaggggggggaggaacgaccatagcaatggtggacaagacacaacacacagcgaaca

SEQ ID NO: 690842 - DNA, 680 bp, Homo sapiens
taggctgggtgataatcagggctggtcctgagtagtgtggtcgtttagaagaagaaataatgaagctgtatagtatggcagtagtgatgaatgaatgaatgagtgtagagtggcagttagtggagccagaataagtattgcagtggtatataaagtaggtgtcgaggaatgtagtgtactgaagttaggtgctcgtgagttggcaccccgaagtgtctggaatcacgactatgattgaccttaaagacgtaagcacattcaaggatatagtaatatggagtctagcgtatttgcttggaagagaatactctatgaaatggaagactcgaggttatctccccattccattgaaacgtgcatacggttttatgatggtgggcagcataaagagtatggaaagataattctttgaaggtatctggaagcacagaatcgctatgtcaaacacggatgtgggtaattaatgcactgaccggaatgagtatactgtatgaagcggtctgagggtgcgttaaagaaaggttataccaattgtgaacaaggcggatctcgtgtataagttgtatggcggaattggaggctttatggctctgtgccacatggcgttcggtaaggttaacaatcctatgtacggacacggcaatatgcatttggtggaatgtcaaagagtagatggtggg

SEQ ID NO: 690843 - DNA, 435 bp, Homo sapiens
  misc_feature (241)..(241): n is a, c, g, or t
  misc_feature (254)..(254): n is a, c, g, or t
  misc_feature (309)..(309): n is a, c, g, or t
  misc_feature (318)..(318): n is a, c, g, or t
  misc_feature (339)..(339): n is a, c, g, or t
  misc_feature (370)..(370): n is a, c, g, or t
  misc_feature (415)..(415): n is a, c, g, or t
atctctcccctcaagtttagtcttgcggtagaactttgaagagaacacctgggtttatttcctggtgttggagaggtgaataaacatcaacagttgaaccttgatttcagtggatttcaacatgagggggtaggactttgaagtattattctttttcagaattcgtaagtgccaggcactgtgcttaggtcattagatggagatgaaaagatattttctataggaagagaccgttgattgnacccatgctgtanaaagatagctcaagattttttttgggttaatttggtttttgtaagcttggccggntggggaaangaatgaagtccttttgatggngtgagtttgagatgtcagtagcagtagaaanttggaaggccgtgactcatagctagtttggcgttttggtaaggangggttaggtacccggggccc

SEQ ID NO: 690844 - DNA, 170 bp, Homo sapiens
aattgctaaattctcacgataaaacttgaatgatgagttgcttctcattcaactttatcatgctcacacctttggctcatgaatgaggcaagaaactggggttcttcaggactggaatttactccctttttgaaggattgctgcaggccttcaggtgccttgaggggtac

SEQ ID NO: 690845 - DNA, 142 bp, Homo sapiens
gtagatcttgaagcacacagtgtgggatgggcacacaggttgggatgagcacacaggtagagatgatacacacagtatcgagactcaacacccatagatcgtgatcggacccaggtgcgtggatagacacacaggtggggat

SEQ ID NO: 690846 - DNA, 163 bp, Homo sapiens
  misc_feature (65)..(65): n is a, c, g, or t
  misc_feature (79)..(79): n is a, c, g, or t
  misc_feature (132)..(132): n is a, c, g, or t
ggaaaagccatctttgcattgttcctacatccgcgctccttggcccgcgcgcaaagtcgcctcancgccgcgcgcgctnctctccgcctgccgctggacttccggcagcgtttatttcgccacgatgtcccntagaacgtctcgcttctgcttgtttaatttc

SEQ ID NO: 690847 - DNA, 152 bp, Homo sapiens
tagaggatccgtgaacacccgctacggggctggccgcattggggtgctggatgagggcaatgatgaagctggattacatcctgggcctgaatgatagaggatttcttagagatgactgcctgcatgacccagtgtcttcaatgctgggcttt

SEQ ID NO: 690848 - DNA, 356 bp, Homo sapiens
tgccgaagcaggcatcaagtgcgcacaggctgtgggggggatacatcagttacctgccacactggtctctccatagggcagctggcttccgctggaccaagtgatccaagagagagcaggagagagcaagagagacccacaagatggaagccatacataggtcgtagtttgtgttatttttctcgggggaggggatctcactcggtcgctcaggtgggggggtatgggcgtaactcctcggctcacgtgaaacctcggtctcgcggggattcaagaagagtctccgtgcctcagttttctgagttagctgggaattacgaggcgcccaccaccaggccggggataattagggatat

SEQ ID NO: 690849 - DNA, 87 bp, Homo sapiens
tttttggtgtatggatggtctggtgggggaaagcgggctggtgcagacattcaattggtgtattattatggtcttacaagcattaac

SEQ ID NO: 690850 - DNA, 431 bp, Homo sapiens
ggtttggatcaggtgtgttagcgagtggaatgggccaaagttccaggaacgtgagaggaagaaggaagaagaggagaaggagaaggagcgggtgggctatgcgtcagatcgacgtggcatgatttggtggtaggtggaaacagtggacttccaactccaatgagcaagggaacttccctccactcccaacacgaccagaggagctggtggtgcccgagatcctcagttcagggatgcgcatgatgaaacacgttacgggggacgacgtgagggaaggttggagatgtgatggttcgacgttctgactgagggacggatgaccaagacagggagaaggcggagtgagccatcgattccacagactggaccaggacacctcaagtacaatgatatggatgatgggttcagactgatgaagaagaagggcagaa

SEQ ID NO: 690851 - DNA, 108 bp, Homo sapiens
gcggggtgatctagaggatctattatatgctgtctcattgaaaactcagtgtatggtgcttggtatataggcagacagtcaacagtttagaatagataaattaataag

SEQ ID NO: 690852 - DNA, 331 bp, Homo sapiens
gcttgtttgttcctttggggggcccgggcgggttgtgggaatcagttttcccagacaaacgtgagccaggcggaggactcgttccttgcagaggtcagtcctcccctgcaggtgtcggggtgggggggggcaaggaggggcaggccccccccatgtttgccctgaacccgattttggggggcattttcccgctccggccccccgccccccccagggttccattgtaatatatatgccccagctaacctgtttgatgggggcattttcctgcagccatttcaaacatgtaacttttatatgaaaaaaaataaacccaaatgaaagctgccca

SEQ ID NO: 690853 - DNA, 605 bp, Homo sapiens
  misc_feature (185)..(185): n is a, c, g, or t
  misc_feature (192)..(192): n is a, c, g, or t
ggatggccacaagttctttcccagccctcttccattcacctttcttttcatgcccatcccgatgaacctgcatcattccccgacactgcccaagccaacctggaaaaggagttcgcggccattggctagaataaggggggggggggggtttttgggggggaaaaaaggaaaaaaaagggtttttnccccccnccttttgggaaaaaaaaaacccccccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaa

SEQ ID NO: 690854 - DNA, 391 bp, Homo sapiens
  misc_feature (39)..(39): n is a, c, g, or t
  misc_feature (158)..(158): n is a, c, g, or t
  misc_feature (235)..(235): n is a, c, g, or t
  misc_feature (314)..(314): n is a, c, g, or t
ccgatcatcctacaactcatcccagggcctcgaggcccncttgccgtattaccctgctgggtagtgtgccgaaacgccagaggcggcttaggtaaagcattttggtagggcattgtaatgatagcccgggatagcgattaaggagcatggttatttangcccaaacggttaccctattcggtaacctgcacaatcccaactggcagtaggtagtgccaaagtttaggtattactnggttaccactcaccagtttgttaaaagtaacaccgctcaggctgcctctgcactgatccgtcgccactgttatgccacngtggtagtattagccacaacctgccccctgtaggggctacccccccactttaaaaccccgtagtagtgtgctttttg

SEQ ID NO: 690855 - DNA, 226 bp, Homo sapiens
cttcatgaccacaaataaatagagtgaactacgctgcattgtgtgttttgaaccggctattatacttcttaacaattctttttttaaggtacttttctagctgtatgactgttacttgaccttctttgaaaagcattcctaaactgctctattttagatagattaacattatctaacatagtttgatttacatcgagtacagaataaatttctaagtcagcctcta

SEQ ID NO: 690856 - DNA, 277 bp, Homo sapiens
cgatactagaggatcccggctcattacagttcacctgccgtgagagaagctgtctgacatggtcttaatgaacctggatgagtgggcaggtaaagggatgtaagccaggatcttgaacgacgtgggaagaagtagcccgaggcaaggaaaccaaactttgcacagggaacacttagtgtgtgacagctcttctcagtcatccttgctgactcattgagcaggtagtaacttatctagtgactaaatcagcaccagcttagagacacagggaaatgag

SEQ ID NO: 690857 - DNA, 882 bp, Homo sapiens
  misc_feature (104)..(104): n is a, c, g, or t
  misc_feature (112)..(113): n is a, c, g, or t
  misc_feature (140)..(140): n is a, c, g, or t
  misc_feature (144)..(145): n is a, c, g, or t
  misc_feature (147)..(147): n is a, c, g, or t
  misc_feature (288)..(288): n is a, c, g, or t
  misc_feature (315)..(315): n is a, c, g, or t
gaacgtgaaggggtgggtgcggaagaaggaggaagggggtcagactacttacctgggcgagctgcgccgcgagctgccacccgaccaggctgagtactgcatcncccggatnncccggtacaggggggcccaactccatnccanntnctctagactacatgtgcttctccacggggctgtacggggagagtacctctaatccaccccggccgggcggcctcgtcttgtgcgccgtgccctgccctgcacctccggcgtcgcccatctcctggcggggggggggttcanctcccagcctccacccagagggagccngggggccacggtgggatcgatcctccctgccccggaagggacaggttacaaaatgattttctggaaaaaagagaaaaaaggtacggtaaaaaccaaaaaactacatattttattataggaaaaggattgtttctccaccagaccaagggaagaaaagagggaagaataactgtttgccccgaaatggctggttttggtgggacaagggaaaagacccaggcccaagggtatattccatcctttttgacggatgtgtggtttttgtttgatcgggggcacggtggcgggatggagttgctccagacccagggccatttttggggtgggaggcggggtgggggggactctccggaaaaaggcccattggggacagggggggtgagtcggctaacctgggccaggagaatattgtactggatttagagagaacgggtgcgaaaaagaaaaaagaaaaggggctccgttgggctaagaggtggagggtctgggggccgctcccttttaagagaggggagatggtggtgctctggtactgactgggtgggggtggtagggcaggagcggggg

SEQ ID NO: 690858 - DNA, 220 bp, Homo sapiens
ggttttcccgggttttttttccccccccgggcggggggggccccccccccttttctctttttggtttggggggggttcccaaacctttggccccttttgggggaaaaaggggggggggggcccccccccccctttttttaagggggggggggggccggggcccccccccccccggggaaattttttggggggggggggggatttttttttttttttttta

SEQ ID NO: 690859 - DNA, 398 bp, Homo sapiens
cgggggacaccaggcagacatgcatggtttgaatgtagtcccctccaaaactcatgtagaaacttaacctatcaatgtggacagtattgacagagtggggcctttaagagatgttcatggattaatgggttatcatagggcgttagactagtggctttataagaggaaaagaggcttcagctagcatgctctgctcctttgccatgtgatgccccataccacctcaggattctgcagagttcccatgagaggtccaatctccggaagattggacctcttaccttgtgactagaagtcctagttatggtatattgaaatatatgatccataatccttgccagaaatcctgcagcgaatcatggcatggcatcatcctagtcattgatttcaatcttttg

SEQ ID NO: 690860 - DNA, 344 bp, Homo sapiens
  misc_feature (50)..(50): n is a, c, g, or t
  misc_feature (304)..(304): n is a, c, g, or t
aaagtccaaggtcaaggggctagccaggttgatttctcctgaggcctctntcctggacttgtagatggctgcctcctccctgtgtcttcacatggtctttcccctatactagtctgtgttctaatctcctcttataaggatactagtcatattggattaagacctacccaaatggcctcattttaacttagttacctctataaaggccttatctctaaatatggtgctgtcaattctgaggtgtacgcggggttaggacttcaacctaggaattttgggaggatgctgttcaacccctaacagnctcagtaaagcttgtttcaatcatgttacaggatgtgagg

SEQ ID NO: 690861 - DNA, 198 bp, Homo sapiens
aagcttttaccgcccagcctgagtaacagagtaataccctgtttcaaaaaagggaaaaaagaaagaaagaaagaacaatcaaagaaaaaatacaaaacggaaaaggaaaaagaaagagagagagagagagagagataatccatgacttttttttgaagggacagggaaacaggactgtctgacacgcggtaaaagctt

SEQ ID NO: 690862 - DNA, 570 bp, Homo sapiens
tggactggtttctccaaggagcttatgggctgtcctcaaggtgggcacaccgccacctcattgcccagtccctggtaaaggggaccccgtgttaacagctggtcctgcctatttcctcgtcgagactgggaccaacctggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaagatgtcagcccaggtcattacactgacggacaaccaaaggaagctcttctttcgccgccattatccagtgaacagcatcaccttctccaggaatgaacctcaagaccggac

SEQ ID NO: 690863 - DNA, 423 bp, Homo sapiens
tttttttttagagacaaggtctcactgtgttgcatcacccaggctgaagtgcagtggtgtgaccacagttctctgcagcctctaactcttgggttcaagtagtcctccagccctccagactttgtgtgtgtatgaaacagagtctcgctctgtcaccaggctggactacagtggtgtgatttcggctcactgcaacctccgcctccctggttcaagagattctcctgcctcagcctcccgagtagctgggactacaggcacatgcaccacactcagctaatttttatgtttttagtagagacagggttttcacatgttggccaggatggtatcgatctcttgaccttgtgatttgcctgacttggcctcccaaagggctgggattataggcgtgcagaccacgccccgaccctaactttttac

SEQ ID NO: 690864 - DNA, 153 bp, Homo sapiens
atcttatcaggaagcgtgttgtcagcagtggcttatggtcaggcagaacctggctgcactgcccaagctggtggaggggctgaagctggctggccaagtcctgaccccatggtgcagtgcatcatcgaggagtcgggagagcatatcatcgcg

SEQ ID NO: 690865 - DNA, 97 bp, Homo sapiens
tagcattcagcgcgcacgatcgactgtacatttagcaatcaacagcatggggtgcaaaaaaaaaaaatctaacattaaaaacccctttggtggaaat

SEQ ID NO: 690866 - DNA, 118 bp, Homo sapiens
ttgggcattggcccttgccttcggggaccttcttgggtgttaaggcaaaaggaaggtttccattaaggaactttggattttcaatggaataaattaaacataaagtctatacttggga

SEQ ID NO: 690867 - DNA, 1655 bp, Homo sapiens
ggacataatcttagctgggcggtcgctacccgtgctctggatcgagaatagttattgtgggctggctgctcgcattcctattcacatcctaacaggggatggggaagtcaactactttcgagcgcataatgacagccctccgcccgcccggctcgtcttatttattaattgacgggaagaagctagaataccttcgtttggttagatatatgattttctggagtgcgcgtctgtttccgtaaggaagactaacggagtagatatatttgtttgtgggagaataatattcacatcaacgtggcgggcggccgtggctattattgtctctctgttgattctcctctgtgtttcgttcgacccaaccagcctgtttgtttagatcccccccccctcctgtcggatataataaatcatttgtggttgccacccaccacccgctgctgttgaataaaaaacttttttttgcggggggagaaactatatacacatacattgtggaacaaccacggggggtgttcaatctatgggtaaattatattggtgagtgggtgccccccccctccagagatgaggttcttcttttctcgggggatatatctgctgcagcttttattatattggaaattgtaaacataaattgttttctcatcatcggtgaggaggagaaagataaaagggcccccctttcttgaagactatctactccgggtagagggcgggtgttgtcaccacacgacggggtattttctccccccctctctggtgttggtacacgacaccaccacagcgatgttctggggtagaattatgttttaagatgggggcgccgccagctattattctctcgcgggggtgttctactctgggccacaatcatctctctcaccacacaaatacttgggggggtctcacacaacagagagagttctctccttctctctcaccccttctcacgggctcttctctcctctggagagacacagcatcttgggggaggagaacaacaacaacagcgcgtgtgagtatgacaccacactattctctctgctgcggagaggggtgttgtggagagagaagattaatatacacactctctctctctactctacactagttttctactcgccacacaccacagcagagagaaatattaaaagtatatagtgtgggcacagagagatatagagaggggtgacactcttgagagagatttctctcctgtgtgagaagcgcgagagggagatcttccctcgttataaatactcctctctgtgagaaatatacacacctcgcgcacggtgatatataagagacacacacaagacataatactctctcaacacctctataacacagagctcgagaagagaagagatatgtctcaacagtggggggagaagtgggctctctgtgtgtgttctcacagtgtttgtggggtgttttgagaatccacacaccacaaagacacacggagttgctttcttgtaaaacctgagaattaaattatttggtccttataccccacaataaagagacacacaaaaatataagagaatcacaaaatcgttatggatttaccacgtcacccagatatcccccagaattagttttgtttgttaaagaccaaatccgtgggactttttttgtggagctta

SEQ ID NO: 690868 - DNA, 703 bp, Homo sapiens
  misc_feature (18)..(18): n is a, c, g, or t
cacaagcaggctgtactncccgggaattatgggatcccgcgggaccgcgctcggggctctaagtacaaaaaggagttggattacatgaatgcccatccttgccaggatgaaagaccactgcaggtcagaagagcacggtctcaggacagcagggcagctgcctctctctctgaagcatggctcaggtgtggagaaggtgtttctgaacacttctgggaatccgtcattacacagctgaagagaagacgattcacagagacaatgctaccttgaattatgccctaggaccgcaagcaagaaaccaccagatctaaaagcaccagtgggcttacagacataacatgtgagctcctgtggaagtgactttgtcgtgatgaagataatacacctttctcagtttacagagagccaagttctactagaacacttttagagtattcagtcagcatagtgaaacagaagatgatacggaaaatgtcctactcattgattcagaagtcccctcacaatataccacgtgcagttttgcactcggatgcaagacagattatggacgagacctgatagatccaacggacagaaatcatacagagaccagttttgtcatacatcctcagaaacccagcagactagaggtttcccaggactcccagaatattcagcaaagaagaagcttttaagaggtggactagcagaaagacta

SEQ ID NO: 690869 - DNA, 273 bp, Homo sapiens
  misc_feature (137)..(137): n is a, c, g, or t
agaggatcgtcgtacgttatgtaccactaaacaaagaaaaacaaaacaaacagtacatactgctggccaggcatggtggttcatgcctgtaatcccagcatttggggaggctgaggcaggcacatgcttgagtccangggtttgagaccagcccaggcaacatagtgaaaccccgactccacaaaaaatacaaaaatgagctgggcatgctggtgcacacctgtagtccctacttgggaggctgaggtgggaggatcccttgaaccggggagg

SEQ ID NO: 690870 - DNA, 674 bp, Homo sapiens
  misc_feature (478)..(478): n is a, c, g, or t
  misc_feature (487)..(487): n is a, c, g, or t
  misc_feature (524)..(524): n is a, c, g, or t
tggcacctatgtcgcactctctcttgctactgtttttgccacgtgatgcacctacttcctttttgccttctgccataattggaagcctcctgaggcttctccagaagctgaacaggtgctggtgccatgcttgtacagcctgtagaaccatgagccagttaaacctcttttcttattaataaccccatctcagcaagaatagccaaacacacaggtttgctgagcagagccatacgggcagaagataagcgggggtcccaagcccaaatgggggatagtccatcctcagagctgggcttgctgcacccgttctgctaccgggccgggatgcatcgctggccctggcccctctgcagctcatgagggagccccatgcccttccacgtgtggagagcagcctgcgtgtcactcgatgccgtcagatgttacagaagactccagaggacaactaacgtcgcctgcgctgactattggcttnctgcatgcngagagtagggaggggggagctttgggtgaaatccaanagggcttcactcccatcctgaaccccataggaccaacaccctccttgtcctgggtatggaaggattaccctgtttggggttcgggattacaatctcttgcccccaaggatctgaatccaagggtgggttagcaccccaaggttgtggggc

SEQ ID NO: 690871 - DNA, 221 bp, Homo sapiens
aggtagaatgggtgcgggtgggtaaaaaagtatgagggggtgggggtggtggtaaacttaattagtgtaggaagctgattaataataaaggagaggggtcaggttggatccggaaggatccaatgggtgcgggggcttggtatgataatgggcgtggataagtaagtaagttcacgggtggacacatggttggtgggcctaaatggtgcggaagggtcccg

SEQ ID NO: 690872 - DNA, 309 bp, Homo sapiens
cagacggatcctgatgtgaataggacagtttctattgcttatccttacttccatcccttccctaccatcaaaagcatacctgctctaattcaaaaaaaaaaaacatcaaggtacagctaatttgtgggacagccgcactagaagggtatacttcgtaatgtatatatttttacatactgaagtcctaaatttattttacgacaacacatgtacactactcgggggtacacaccattttctgacgacttactcctatttggatatcggctggacgcgtgccagggggactcctctagacgtcgaccctgc

SEQ ID NO: 690873 - DNA, 1517 bp, Homo sapiens
gcgatgggtcggccccgcatgtatgcccccggccggggatgaatgtagtttagtcggcctgctccaccagagatggttgtaggcaacaccacgccgggtgtgtagtcctcgcccctcactcacgggtggttgtgcaccgctcccccatgtggttctccccctctgttgatgatcgcgtcggcgcccccggtgtgtgtgtgggggccccgcaccgcgcggaagtttttgttttgtggtccccgcgggggtgtcgtttccgcgctacctgacagtgagctggcgttatgctattagtaatacagccgtgtttgttgttggtggcgtccctggctcggcgagccacttttcttgttgtgtgtgtgttatggggggatgcgtgccgccgccactgtggtggtgtgttggttagtatgtgtggccgcgccctcccccgcgcggtgttgttgtgctgagagcgcccccttttgtggtgccaacgcgtgtcgccgcagtgctgcgtgtgtgtgtagttaagaaggtgttgttggtttgcgcgccgcccccggtgtgttttatggaggccccaacgttctgatttgggagggcgcaccgtctcttgtgtttggggagccccgcccccggggggtttgttgtttcctcgggtggttgcgccgccccgcggtgtggttattggtgtggagggcgtccttctctgtgggggtgtatgtttttggggggccctttcccccccacaaataggttgggggtgtgtgcgcccacacgtttttgtgctccacgcgccgcgggggctctctctcgccagagatgtatatagtgggggagatcccgcgcggagcacactggtgttataaacaccctgggtgacccccgcggggtgttattgttgtgtggtgttgggagagaccccctgtgtctcccacgcgtgtgcgcctgttatatgagagaaatggtgtcgcacccacgctccccccgcgggacccaacacacgggtgggaacacaccccactctcttgtgtctcgaacacacaagaagaaagaaatataccctccgccacacgcggggggggaaaccccccgcggagattccccccgcgagacatctgggagagaggctcgaaggcccgcgagagagaattccctctgagaacccgcgcgagaggcgcgcgagagggtgccacaacgcgagaggcaaagagagtcgcgccccctcggagacacccacccccggggccacacacaccgcgagagaacccacactctccccacaaaaaaagagagaaaatggggtcacacagaacccgggtattcccccggggattttttttatattccggaactcctccccccggtgtaataataaagaagaaggtggggcttttaaaaagtttcgccacaaaatgttttttttttttataaaactggagaaaaaaaaaatttcttttttgttttcacacacacaccggcttatggagagttttttccccgcaggcttttttaaaaaaatgagaacaccctta

SEQ ID NO: 690874 - DNA, 347 bp, Homo sapiens
ggcgagtcttttactatacgtcgacgcccgcctgggtcaggcgaggtccagcacggtagtttgtcatcctcacgggtgcctactgctgccccacagagcagctgcttctgggattccttggaggccagagggtagtctcggttcttcttcaggctcggtgcgggcgatgatggccaccagctcatcgcaatcatatgacgataggcagcttccctattcttggctacgcgtgcagggatctacatttgcctctttcaacggtcacacctagctaggagccatccaccagtatcaataccttaggcgtcatcacctagtaggggccaggaacatttggcctcactgag

SEQ ID NO: 690875 - DNA, 1058 bp, Homo sapiens
  misc_feature (496)..(496): n is a, c, g, or t
gcagcatgcgcctaggtggtatgcccgatcctatagtcgcatacgaatctacgtactcgtattgagctgcgtctggtcatattgtacccacatactcattcatcaagcattcttcatccacaacgttcgccctatgtcctcttcagatggaatacatgctttaggactaatggcgcctggagtgtcccatatacgcgcagggccattgctccacttggaccgaacgtcacgggacttaactcattgatctactctcgctactacatgaatggtggcagcgctctgaggcgcataggcgtatacattagctcctataaaacatgctcactcacttgtgcagactcactgaatcagccccaagcatatcctgaccacagcactctctagtttcgataggagtgcatcctggacatatatggcttggactctccccgagtcaccgtccacatagcatctttggtctcagtacagggccttcgatgatagtattgtagtnatagcaaacccgatggagtagttctactatgagtggcctacgactcacaagctactaatagagggacctctccccataaacgcggcaattattgaggactccaactacgattggtgcctgaggtcatctgtgcccttgttccatccctaaggcactatgcactccgtggaacttatccactagagcactggtctccaggtaccaagtacaattccgccggtttggaggacgcagtgtagtgcacaaaaggtcagtcaacctagtattttgactttcaatcagttaacgcttgagatatcaaggatacacttatagtgacccagagaaccacatagcatttggggaaccggagtgcccgcacaaggaaggagatggccgtagatacttaatcgccagaaggatattagcccaacctatttaagcaagtcttaatagacccagcccatcccaattgtgaatcctgatagtcccggggcaaacggtccattggtgcaacctcagcaccgtatacggaacacacacccgcacagaagtgaatctccctttgggggtcccccttctg

SEQ ID NO: 690876 - DNA, 164 bp, Homo sapiens
  misc_feature (102)..(103): n is a, c, g, or t
  misc_feature (151)..(151): n is a, c, g, or t
gccacatcgctcagaacaccatggggaaggtgaaggtcggagtcaacggatttggtcgtattgggcgcctggtcaccagggctgcttttaacctcctggtannaagtggataattgttgggccccccaatccaccactggagaaccccccnttcttccaaattt

SEQ ID NO: 690877 - DNA, 414 bp, Homo sapiens
  misc_feature (4)..(4): n is a, c, g, or t
aaanacaaaggcttttataaaaaaaaaatggatcacccacccccctcctggagaatttaatgaggtttttaatgatgttcggttactgcttaaaaatgacaatcttctcagggaaggagcagcccatgcatttgcacagtataacttggaccaatttactccagtaaaaattgaagggtatgaagatcaggcattgataacaaaacatggcgacttgggaaacggaaagtttttggatccaaaaaacaaaatctgttttaaatttgatcacttaaggaaagaagcaactgatccaagaccctgtgaaagaaaaaatgcagctgaaacaaggaaaacttcaatagaaactgctctgagagcctacctaaaagaacattacccgaaaggaatctgcactgggaatggcaaaaaaat

SEQ ID NO: 690878 - DNA, 165 bp, Homo sapiens
ctgtcagcacagaggaggggaagggagaaggaaatcccagcaattcaatagaagagggtaaaacgactccaaacatcactaaggatgcggcatgacacttagcaggcactgagcaagcaggcccccgccccctctgatctgtccacctcctctgtttctgtccag

SEQ ID NO: 690879 - DNA, 361 bp, Homo sapiens
ctggggtgtatgcatgcgcgagaacggcgggtaccactgcgagtgttgggggaagccttgacagggccttctaagaggctcctccgccgcaaaggctgtccctagcttcttgggtgtgttgagaatgctgaatgccatcgactggcgccggtcagcctgtatagtagaagctggagctgctttcttctgggcctcagtactgctctgtttgcgcccttcatgtcggtctcgggtagtcatggggcgtgtgaaacagcttgtggccttcttagactcaggagttccaggcccccggtggggctctagggagacccgtttgcgctgctgccgggtggtgatgcccgtgccctcggctatctag

SEQ ID NO: 690880 - DNA, 109 bp, Homo sapiens
atcttacctctctcacggcttcttggtttcttgcaatttaagatctttccaccttgatggtcttcataaaacatgttctttctactctgtttcccgccttgtgaagttc

SEQ ID NO: 690881 - DNA, 277 bp, Homo sapiens
  misc_feature (36)..(36): n is a, c, g, or t
ccccaagaactgagtttctttttatagctccctttnagatattaaatgtaacatccccaatttgaggtatgtgtctgaatataataattcccttttgtatgaaattttcattttggaaatgtatgactaatccattgctccaggtatagcttttatattgtactctattcctgattctattttatttgtattacacatccctttatgagcttatttattcatgtttttacttgtttgctgtctccaacactataaattaagtttatgaggccaagca

SEQ ID NO: 690882 - DNA, 570 bp, Homo sapiens
agtgaaagggaataatccagcaagtacaaatgcaggtgtatgtgctgatacacagcacagcccaaaatgtggtagaatcaagaagaaatttgcataggcatttctttctttttttttaagagtctgggtctcactctgctgcccaggctggagtgcagacggggtttcaccgtgtaagccaggatggtctcgatctcctgacctcatgatccacctgcctcggactccccaaagtgctgggattacaggtgtgagccaccgcacccagcccagtttttactcttaagtctaggttattgatccatttgggattaatatttgcatatagtgtaaggaatgggtccagcttctttcttttgaatatagatattgagattttccaccaccatttgtcgaaaagactatcttgaagatggtttgatcttatatgtatgggcttatttcctggtcccgtatctgtatcatcagtgtacatgtctgtccttggcccaggaatcatatagtattaattactatagcttttcggtaagttctgaagtcaggacaagtgccttaccattttcagtaggg

SEQ ID NO: 690883 - DNA, 214 bp, Homo sapiens
cccccgactagccgacgtggtgtggcagttgggggtcagtggaacgacctttggggaaaaacgggatcatgagtcctgagccgtggtggtgagggagagctctgtctggggacccggctggccgaagagcgcgggatgatttggggcactctaggtgaccatggatgggagctgagcttggaggaggacgcacagttgtcgggctagtcggggg

SEQ ID NO: 690884 - DNA, 536 bp, Homo sapiens
gacgtcgaccaggttgcaaaaatccacaaggctgtggttgagatggcaaacagctttaacctgggtgtgaatgaggatgacattgaggagctcctagcggtggttcccgaggaattgactaatgagttgttggaaatagaacaggcacacagctgaagaagaggcaagagaaaacaaaactgcagaaaaccaccatcaagaaaatttgcagtagggagtttagcagaagcttttgcagacctcaagaaactccttaaaaagtttgggccgggcgcggtggctcactcctgtaatcccagcactttgggaggctatggtgggaagatcacgagatcaggagttcaagaccagccagaccgacatggtgaaactccatctctactaaaaatacaaaaaaaaaaaaaaaaaggcctggttttggtggcacgcacctttaatcccggctactagggaggctgaggcaggaaaatcacttgaacctgggaggccaaagtttgcagtgagccgagatcgtcgcattgaattccaacctggtc

SEQ ID NO: 690885 - DNA, 261 bp, Homo sapiens
  misc_feature (214)..(214): n is a, c, g, or t
cagaggaccccttggatagcggatgagggttgatggttgcacaacctgaatatataaacagcattgaattgcacgctttaaataggtaatggtatggcatgtgaacgagagtctcaatgaatctgttatttgaaaaattgtagaggagtatgtcttcagtttcgctgtggctacagtgacaagatacccacacacttcctggcttacaacaagnaagagaaacttattctttccccattcttgcgggatcctagaaataag

SEQ ID NO: 690886 - DNA, 489 bp, Homo sapiens
  misc_feature (20)..(20): n is a, c, g, or t
  misc_feature (94)..(94): n is a, c, g, or t
  misc_feature (102)..(102): n is a, c, g, or t
  misc_feature (110)..(110): n is a, c, g, or t
  misc_feature (115)..(116): n is a, c, g, or t
  misc_feature (123)..(123): n is a, c, g, or t
  misc_feature (133)..(133): n is a, c, g, or t
  misc_feature (176)..(176): n is a, c, g, or t
  misc_feature (194)..(194): n is a, c, g, or t
  misc_feature (241)..(241): n is a, c, g, or t
  misc_feature (243)..(243): n is a, c, g, or t
  misc_feature (265)..(265): n is a, c, g, or t
  misc_feature (338)..(339): n is a, c, g, or t
  misc_feature (341)..(342): n is a, c, g, or t
  misc_feature (392)..(392): n is a, c, g, or t
  misc_feature (396)..(396): n is a, c, g, or t
  misc_feature (398)..(398): n is a, c, g, or t
  misc_feature (408)..(408): n is a, c, g, or t
  misc_feature (412)..(412): n is a, c, g, or t
  misc_feature (416)..(416): n is a, c, g, or t
  misc_feature (432)..(432): n is a, c, g, or t
  misc_feature (441)..(441): n is a, c, g, or t
  misc_feature (458)..(458): n is a, c, g, or t
  misc_feature (473)..(473): n is a, c, g, or t
  misc_feature (479)..(479): n is a, c, g, or t
  misc_feature (481)..(481): n is a, c, g, or t
  misc_feature (484)..(484): n is a, c, g, or t
actttcattaaacataaganatatagatggctgtcaaataatttaaagctagcccacattttatactcaaaaatcacatttacccatgattagncataagtntatatctntcccnngcctaangacaaaaganaaatctatactggccaatcatggtacatcatgggacaattaantcgttgttaataacaganaatcagtatagtaaaaaatagtttgatcactgaggtctttgcaaaangnttatcatttaagtctgccagcnggcttttattatccagctggtcactaagtttatagccttaaaaaataagacaactcaagtagagataaaaaanntnnatcatgccacaaaggacaggagctctcctgagtagatctcacctctttantttnanagcctttgtntgcntccnaccaccacttctcaangcaaatgtnttctttgggtacatggntgtattcccgttgcntggagnanaantctgt

SEQ ID NO: 690887 - DNA, 425 bp, Homo sapiens
  misc_feature (4)..(4): n is a, c, g, or t
  misc_feature (51)..(51): n is a, c, g, or t
  misc_feature (103)..(103): n is a, c, g, or t
  misc_feature (109)..(109): n is a, c, g, or t
  misc_feature (113)..(113): n is a, c, g, or t
  misc_feature (165)..(165): n is a, c, g, or t
aagngaaatcgagggttggtgctagaagacagactctgtggatgattcacnccccccaagttaggaggatggagcctgcttcattaagaagctgggggtaggntggggntggncgaacactaacaactggggaccagtcgggggatcccttatttctggcattgnggaacctagagcagccggtgaggctctctagtttataaaatcatggaagactcttatgcagactcttcttaagtgttaatagggattttttcagcttattttggttgcagtttccaatttttaaaaatgttgaggtaatctttcccaccttcccaaacctaattcttgtagatgcattagtgttgaaccaatgccttctcatgtctcaattctttgtatatgcattcttttcagatgtattaaacaaacaaaaaccctcc

SEQ ID NO: 690888 - DNA, 244 bp, Homo sapiens
aattttcccccggggggttaaaattttttcccctttttttggggggggggggggccaaaactaaacccctgggccgcccggggaaaaattgtaaaagggaaattttttttaaaaataaaaaagcgggtttttcccggttccggggggtttaaccccccgggcccttttggggtttttttttttaaaaaggggacaaaaccgggcccaatttttttttaaaaaaaaaaaaccctttgccttttta

SEQ ID NO: 690889 - DNA, 1206 bp, Homo sapiens
  misc_feature (143)..(143): n is a, c, g, or t
  misc_feature (1206)..(1206): n is a, c, g, or t
gatatacccaccagcatttccgtgggatggtcttgattcatgggaagctctacaccttggtcctgactagacccgcgtatgctgcccatgacaaggaaggaattcccgaaatacgatggatgaatggcgaatcagtatatccntcggtggttcaaacaatgaaagggtctatgactcatctagcgagatggcgactagctcctctcttccagcattcattggtgcggctcccggggcctgtcctctacacgggcgactaggcgctccaacgcgcgtcatggtcctggcttggattctatcggagggtcaggacgagcgctctgcgtcaatatagtgctagacagaagctcccaattcccttcgagcgataccagagctcgtggggagtaccaacgcgtctgcgctgataatctctatatgggctggcttgtcccttctccgttaatcataacgtatgtcagctcgaaggggtccgcctgggctggtcctggccacgttgatttcaccaagagcccggtaggcttgggggacttgtagctaaatgattgtcctctaaataacctcgttaaccgaccgcaggacttgctcctcgtgggcatagcgtagagtgcgagttctacgcctcctgggagcgaacccttgtataccatggatcgccttgggccgggggctcgcccctatacaggcgctaatattgtgttcccccccgctagtggtgttccattcgatggttctagccgaggtgggctacttcggatctaatgaacctttctccgttcgcggttcctataatcgcggttggcgcgcccccccttttggggtgcccgtgtggtggctttgaaggacccctttgtagtccctttgtgtccaggcgacacttggtggtgacagtgtgcttccgatgcgggagaggtttggccgccttctcctctgcgccccatttcgcccttttcggcccccttgagagcaccccgtatttgttgttagaactccctccttgtaacccgtaccaacggtttccagggcatttcctttcgcgcactttttgtaatccttccggttctcttcgctggcattttcctaagggactttttttggacctctcggttttgccagagtgtttgctcaggggcgcgggcgggggtcatgttgtgtctcgggggcgttctagcctttgggttcgacactcgggggggggggggtccn

SEQ ID NO: 690890 - DNA, 179 bp, Homo sapiens
tatcgaggctactaccgatctttcaagcttacatacgttgccacatagtgcatctcttctgagtttaccagtggagggaacaaacaaaggtctcatattttctgtgcatctggtgattgcttgtcatggcgagcattctttcttttcaaataatcttgctggggggaccttgtgaatag

SEQ ID NO: 690891 - DNA, 221 bp, Homo sapiens
  misc_feature (135)..(135): n is a, c, g, or t
  misc_feature (165)..(165): n is a, c, g, or t
  misc_feature (200)..(200): n is a, c, g, or t
tggagacagggtctccctctgtcacccaggctggagtacagtggtatgatcatagctcactgcaacctcgaactcctgggctcaagctataccttccaccttagccttctgagccagcagggactacaggcacantgccaccatgtcccggctgatttatttatntttatttgggaagatgggggtctcacatatgtcgnccaggctggtcatgtcgagcg

SEQ ID NO: 690892 - DNA, 136 bp, Homo sapiens
gcgcactgcctccacacccacccctccccagacgggaggcggtctggagcctcaagctaatggggagacgccccaggttgctgtcattgtccggccagatgaccggtcacagggagcaatcattgctgaccggcca

SEQ ID NO: 690893 - DNA, 811 bp, Homo sapiens
caggagagcaatgcaaaaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaactaaacggcatcggaatgggaaacataggtcccgcaggaatgcggaatggacacggcctaggactttggaataaactaaaatgggacggaatggaggggccctttggtggtggatatggaaaacatgggatcgatatggatctggggatgaacatgggcaggatcaaatgaaatcctcaagtaatgcactgcaagagaggagagatcattgaaaagcagggaggcaggtggaggtgagaaggaaagcgaccccgggaatcgagaaggactggggccctgggcacttgaccgacctcaagggcgtggacaggcaactggacgcgccataggagcgcgggccaaggggccacgggcatgggatcgacgtgaagcatcaggaagactcgagcgccatgcggaccagggccaccaggaaccggcaaag

SEQ ID NO: 690894 - DNA, 198 bp, Homo sapiens
atacagtatggggataggggtagtggtgtcgtggtaagaagtgggctagggcattttaatcttagagcgacagcctatatcactgcgcccgctcataaggggatggccatggctcagggtctatagattgttgggtggttgcgtgtacatgagtgaggcaggagtccgaggaggttagttgtggcaatcaaaatgatt

SEQ ID NO: 690895 - DNA, 392 bp, Homo sapiens
tccttctgtgctcaggtagctctggggtgggtactgtgatgtacctagattcccgcttcaggactgaaggttgcatttccttggcagggctggtgagcccacctcggggactgtctgcattgaagaggggcctagagcccaaggccgagctccctccccaggggtctgcattcagtgtgtgtgtgtgggaggtatagacccagactcactgggcagctgtgatgggccttccagccccagagctctcatggtggtatccctgaggccactcaaactgggcgtctttgcccaccccacccccccccctccttgctcctggtgttgtcttcaggacgcccattcataaacctcctgcatgctgctgcctgctatagaggcggcttccccgccca

SEQ ID NO: 690896 - DNA, 1628 bp, Homo sapiens
agtagaagtggcgcgccgctatattgtgttctgcgcaggtcgctgagttatatgggggggcatttctctcgtgtgggagtaagtcgcgccaaaaggtcttctagatgaggggctttaggggtgtattattctcgtcgggactactctggtaatatcgtatggggcgccgataaggcgcgccgttggtaaacaagcaggtttgcgcgtgcttcgccttaatgtgtcttcctcggtcttgtgttgggttataccttcctcaaattgtagccgttctcggtgcgacgaaagccaccgctctggggttctgcggggtcgtgccgctatgtttgccgctagtgctgactcaggggaaacgctataacgggggttggaacgactgcaatgtatgaagctgtggaggctctctcggatgcagaatagttttcagggggaatagtgtggccactcacggtaacataatacgtcgtttcggatgtgctcgccgggctatttcgacccgaccgcctgtgtgtcagcgctgggatatgatgattgttccctgtcctaaatgggcccgtacactcggtgtacggggcatcctctatcagtgttttatcgctgtagtgtgttgcgcaggctagatgagcggtccctataaggactagggtagcccgtagcaggggggttattaccaaatcgtgccgggttgtattaaggcctttcagggtaggataagctgcgcggctttagtcccgcccaatgtctcaccaggctgtgtgcgactgtcctccgggaagcgcgtccgggtagagacaccgtacattaatgatgggggacccaccaagcggggtgcgcctcgttacatgatgaactgcgggtaactaacgccctccgggggaaatttggggaaaccaggtggcaattcaaatcccgccttgggggacgcctgcggcgccatctgggaaaggtgcgtttgccgctgcagcgtctggagctccacggcgcagacaggtgccgcccctgtcgaggctgtggtctcttgtaacccgcactaagggcctcttttggtgtgttctgtacaggggttttgcttggggaaatggccaagattctgtgcgtacgtttggggcgttaacttctttgagggggtcttgtaggtgtgtctctagatacagatgtatgtagactatttggggagtatattcatttatgtattggctggtcgagtatgtaagaggagcagcttgtgtgtggcgagctggcagaacagtgtgaacagtctgtttggatatggtaggtgaacgtagagatgtaagggcagacagagagagtctaccaagcttacttagatttgtgtaacgtagacaggctgctgcactgtgttagtctaggactcttatactgttcgttaaagatcttgttgtaatatgttgccgctcggctcggggctagtgccgcgtcctgacccgaccaggggttcgaagggtgactcaagtgtgggcaacaggtggtatctgaggggtgcggccagggacagcccgacacacatccagagcgtgggagacggtgggaccttgtactcctgaccatgtgcctgacctgggagttttgtattcatcttttgtatagttgtaatcacttaagacagt

SEQ ID NO: 690897 - DNA, 1009 bp, Homo sapiens
  misc_feature (482)..(482): n is a, c, g, or t
tccaacatgttcaaacttttaaactgcaaggaaaaagtcttacaattcttttcccaacgagttgtgaccaacccatgtgcaacttctcaacagtgtgacttctcccggcaaggaacagccgcccgcaattccactcctctcaccataaatacgtggtatgtggagtgtgacgggcatagagtaaaacaaggccagtttcctgtgcaaacctccgagccagcgcgtggggaaaagcctccctgtgagagaacccccggggaaaaagccgtgggggaaagcccagactgtgtgtggtggacaccggggtgcctccacctgtgcctggggtgccactcacagcccggaacgaggtggccacgggcactggaaaaacccgccgcccgtggtgccctggtgacgcgttgggcgcttcaattggcgcccacatgggcacagaagagatcgggtgagatagtgaggcgccttagaacactggcgccagnggagcacacttgggtgcgccgcgaaaaggggtctcctggagtctaacataaatagtgcgcgcacaaacccccgtggggggcgcccaccggggcccagtatgagaaaagagagaccaattccacaaaagtgtagaccgacagtgcccctcatcacataagtgactaaacacacaacacaacgccgaggagacaggagaaaggagaaacagaggacaaatagatacaggggggagaaattacaccaaaaagaaggggggaagaccgctggcgagactatcaacacccagcggtgatgactccccccacaggagaggtgtgacatgtgaaggacccacgacggaaagaaacgccacacatatcccacgaaaaaaaaacacgacgcggggggaaaatcacccaaactactatatacccaacaacaggaccaccaacaaagaaacgtgcctcactacagtcagacgagcgtccccccacgaacaacacacacgcagagacaaccaccgccaacacaaaacacccaaaccacc

SEQ ID NO: 690898 - DNA, 800 bp, Homo sapiens
atgtactctaattgattatgtatattttatggtctatcgttatggtttcctatcttgtataattatcgttatggttactatcgttatggtgatcgttatggttattgattgttatggtcatcgttatggtgattcttatttgttatggttcacattgatgttatctataaatcttttatggttatctttattggttatctatcattttatggtcatcgtctatgccatcctagatggtcgttatatctatcgttgcatatgtatgtattattcatccttcaggctgggcattatatcctgcatgtgttggttggcatgcatcgcaggcttatcttgcattttgattttatgattctgatattcatgttgatgtcatgctgtatgattctattgctttgctattagctgtctcctctctcagtatccgggtggattggtattatcttaacatttttggtgtatttcctttaatctctatttggcagccgtatccctaatctggggtttgctttcgatcgcatttttgatccgagaatgaggtgctaaggtgttacgctctgggcggtgattcttggattcatatcaggtaggtgattatccggttttgaatttgaatttttgtttatcaatttttggttccattttgttgtgattgccggattccatatgtcatgtttgggcaaccttgaggttggtttaacttatctttgggggatcctggtgcagcggttattcgatataccaaggatccttctgtatgattccagagttgttcatagtgtttcctgttttgatgatgt

SEQ ID NO: 690899 - DNA, 206 bp, Homo sapiens
caagactatcaagaacgcaatgctctattgaagcctaaaatttagaaatggttaaatgataagggggcctgggcattaggtgttcaatatctacttcaatctggcagaagcaggaagcaaatggaaaatacaatgatactaagggtatttggttttattaaatatagaccctggggcagaagcaggaagcaggcagaagcaggaag

SEQ ID NO: 690900 - DNA, 545 bp, Homo sapiens
cgtcgatggagtgaagcaagctttgtcacccatcaatgaaatataacttcatggcgtcacgagccctgatgagatccaacaagatttgagtgttaaatacagaagatatttcaaacagagacccgtcagagtgcggatatctgcaatggaattgattgctgaaggcagagagtataaagaatctcaagaaactaattagtgccatttgcatttaataagccattggtatagcaaggctaaaaaccttggctgtgatgacaccaggatgtgtttatggaattgctgcaggaaaacacacattggcagcgtgacatacctctgggctcacaggaccaaattctccaagagacttaaggctggggtgtgtagcggaggtatttcttgccagatgggagctctttggtgaagactcctttcgggaaaagtttttttggcttcttcttcagggatggttggaaggaccatcacactatccccatccttccaatcaactggggtggcaacccttttttctgctgtcgcagcttcaaggggggacctctaga

SEQ ID NO: 690901 - DNA, 832 bp, Homo sapiens
ggggacatgctctctgggcttgggttgggggcgcctctctgctccttaccactgtccctctggcttcccatagtggggcctgggagggttccctggcttaaaaggggccaagccactatctcatcctggcacgccctactccactgccctggcagacaagcaggtgtggccaatggaggggggtggtgcccccaggattcccccagccaaactgtctttgtcaccacgtggggctcactttcatccttcaccaaattctctagtcacgtactaggtggacagccccttcggctacaggacggccggagggggtgacgtcccctatccctcttcattgtggggcagagccccccttgtgccctctgcgtgggaatcttgagtacaatattgtggtggataggcagatgacaggccactttatgtgtccaggttgagggcccaaaggagccctgtgggcgccacctgaggtggcactggggttgtccccataagccatactttgttccgacatacagccatttccccctcctcagatggggcaaccaataacaaggaagctcaacccgtggccagggtcccgacaacaaccctcaatgcgcttccaggacgcccaagggtagcggaccactatagccctccgtagccacacaactcggaaagggggggacacggctagtccagctcgacacgggaatagcagtgaacagagcaatggtagtaaggcactggttggcaagaccctccaagaactagtggacaggctgaaggacggagacgcaccacagagggacccaagcgaacagggaagcatacaagaggcgccgccggagac

SEQ ID NO: 690902 - DNA, 868 bp, Homo sapiens
acaccttcgtgtcggtgggtgcggacgcggctgcgcgtacccggtgggggcggctgccccctctcgtggtaccccccccgaggtttttaccgccccttatgccggtatttctcccccccggcgtcctggcccccggttcctttgtgccgggggagccgccccccgatatttttgtttgcacgccctctataccgggctctccccttgcccggctcccggcaaaaattccccgcggttctctcccctttctcgctccgcggcccggggttctacccccgcggacacccccccaaagtggggcacacccatggggaggcccccagcaacctgggtgggctcttaggccacgccaaatagcgccgtaaactgtggaaccgcagacctcctcccactgccgccgggtcttcgccgcccattccacatccccccctggccgcaccaccaagggggggcgaccccccctctcctcgacatcagaagaggacaaagggaacatattcagcctctcttctaggatcctgtagtgaagtcgatcccgcccgccccccgcagtatagcagctctactcggcacgggcgccccgtggctgagtgtgggtgaaccacgcccacttgagaggctgtaagccggcgcggatctcacacttgggccccacaaatttgagaccccgcctgggcgccaccacatgtggaccccgccccaaatgtggaaaccccagaacatagcccacgctgcgtgccgcacagcaaaccctagatctccaccaccacgtcatcgggggacattcaagtgcgggggctcacaccggaacccccattccccgggatagagatgggcccccagagggggtcccctttcccaccaaaac

SEQ ID NO: 690903 - DNA, 236 bp, Homo sapiens
ggacgcgtgcgcttatgtcacagactgggcacgatgcagaagtaaaggtcaatgacttggaagtccctgatgctaggccttgattcttggatagcatttctggacctgccctgagccagataggagcccacagacataaagggtaggttctagtgcctggcagcattcgtgactagctgaccacacaggccctgtgccttaaacaaaaatcagtggtagtcgggcagtgagttcca

SEQ ID NO: 690904 - DNA, 103 bp, Homo sapiens
tacaagcagtcacagcacattgacggaggtagtgaggcgctgcccccaccaatgagcgcttgtcaaatagcgatggtcttggcccctcctcagcatcttattc

SEQ ID NO: 690905 - DNA, 284 bp, Homo sapiens
gcgtcgacttctaccttcctccctctggaatccagacacaactgaccagcattaacattaaaacagagatcttaagctgggcacggtggctcgtgcctgtgatcccagcactttgggaggccaaggtgggatcgcctgaggtcggaggttcgagaccagcctggccagtatggtgaggccatgtctctgctagaaatgcaaaattggccggacattgtggtgcacgtctgtcatcccagcaaggcaggcgaatcgcttgaacccgggaagcggaggttgcggtg

SEQ ID NO: 690906 - DNA, 405 bp, Homo sapiens
agatgaaattgccatttcaaattttcctcatttcattcactccagtcctttcctgttgctggagctgccaaaatcaaatatgtttatgcaaatgttccaaatgcatctgaagtgagttcactcaggtttcctcagcagtaaccccaaaattatataaatgacttcctcttttcccacattcctgcctcacaatccgtcttcattcagaaaataattgctacatcaggggtctcctcagttctccttctacagtgtctatgggttattatgaacagttttctgtctgtttttagcactacgatgtgacgtcgtgtaaaatctgtacttcctctctttctccgtacacccttaatgacaagatgctaccgaattatagcagaattatgctggagaaatgggctttcg

SEQ ID NO: 690907 - DNA, 294 bp, Homo sapiens
gtgagccgggccccagtttattagaaaaaaataaggacagactaatttggtctaattcagaagttatctaaaagttagttcaagttacagttttgaaaaggttatttatgaaacaatgtagtaaggaaccattaagtaggggagaaagatgaggtacagtttaaataataaaatattctttaaaacctgataaagaattggaaacatttggctaattaacatttttatagttaaagctcttagtcttgattaaagtaagaagtattgtaaaaatgcattggcagtttggcaact

SEQ ID NO: 690908 - DNA, 392 bp, Homo sapiens
  misc_feature (303)..(303): n is a, c, g, or t
  misc_feature (365)..(366): n is a, c, g, or t
ggggctttctaagtccaccccacaccttaacaaacattcattacaggaggaaaataaaggacttttgtctccaatctttgtgacatggtttggctctgtgttcctacccaaatctcatcttgaattgtactccgataattcccgtgtatggtgggagggacctggtgggaaatgggtgaatggtgggggagcagggggttggtttccccaaggtgttcttgggtaaggaatatagtttccccaggtttgaagggttgaataggggaaacctggttcacctgggtttcaatttctcttggccanggctatgagaggtgcccttttcccttcccccaatgtgtgtgggccctccccacccaaatgannggggcccaataccccttttttttgtg

SEQ ID NO: 690909 - DNA, 213 bp, Homo sapiens
gatctcatacacggatcccgtccaacgcaccgtctagctactatagtctcaggttattgacaggcagccattgttcaccatcacctgagatttacggtaacacgcgctcagtgttctcatcattggggtaggtttccaggaagattgctaagccgttgtaagttatctttgcttccaaacacaggccctggcacggtgcgttggctccaaccg

SEQ ID NO: 690910 - DNA, 308 bp, Homo sapiens
  misc_feature (25)..(25): n is a, c, g, or t
  misc_feature (78)..(78): n is a, c, g, or t
  misc_feature (178)..(178): n is a, c, g, or t
  misc_feature (200)..(200): n is a, c, g, or t
  misc_feature (219)..(219): n is a, c, g, or t
  misc_feature (291)..(291): n is a, c, g, or t
tagagacggggtttcgccatgttgncatactggtgttgaattcctgatgtcaggtgatccacccgcctcagccgcccnaagtgctgggattacaggcatgagcagcacacctggcctcaagccatcattttgaagtgtacaattcagtggcatttacgtacattcacagtgttatacngaccaccacagacctgtttatnctattaattaattaattanttttgagggtgagtctgggtgacagagcgagactccgtctcaatatagatagatagatagatagatagatangatagatagatacgaga

SEQ ID NO: 690911 - DNA, 170 bp, Homo sapiens
  misc_feature (8)..(8): n is a, c, g, or t
atggaccncccccaccctaccacacattcgaggaacaccataatagctattggaacaccgtaatagctagaggaacaccgtaatagctagaggaacaccgtaatagctagaggaacaccgtaatagctagaggaacaccgtaatagctagaggaacaccgtaatagctag

SEQ ID NO: 690912 - DNA, 806 bp, Homo sapiens
ttttgtttcttctcgtgttttggttttgtttttatttcttctcttttgtcttttcttcttttctgtgtttggttcttttttctttttgcatttgtgtgtttctctctcttttttctggtgttttttcattgtgccaatgtttagttattttgctcttgtttttttgatttgcgtcttgttttcatgtgttttggtttccctttcttcttttgtttctgttttcatgtctgttttagtttttttctttgctttctttttttttcattgtctcttgttgtagtgtttttttttttgtttgtgttttcttttccttttttctttgtatttgttttgttttgttcttttttgtggtttttgttttttcttgtgtttttttttttttgtttgttttttgcatcttttgtctattgttctcttttttttctctttttcttccttctttctattggggggccgctctttcctcccgcgcgcgagaatattgttgttttctccagggctcctcccatatataagttcctttggaccacatacccacacagagcgcccaccccgggagacacaaagacctctcagagagaggtggcgtgtgttcccagagagagatatatttttatccctccccccgtcccttattggggtcctcccccccgagacagttttttttcacagagagtttgtcactctgggttctctccccccccctcctcccccccgggggcgcccctttttgcgcccccccccacccctctgccccccccccccaatttgtgggaacacggggtttgggaaaaaaaattttttga

SEQ ID NO: 690913 - DNA, 760 bp, Homo sapiens
gccccgtggtggtaggaggacacgagagacagggagagtcagcctccacattcagaggcatcacaagtaatggcacaattcttcggatgactgcagaaaatagtctgttcgtagtgtccacaacctcaagacgacacgcgttactttgcctgaggattaagctctcctaaaggctaagcttgtatgatcatctctcactctctcttgtcctccttcagcagcacatgtaaaagaagaagtacgtcaatagtcagaacaggcacaggaggaagtggcttcgctgccggagccccatccacggatcacctgggagcacatacgaagattcacccatcgttatgttgaactttacgagtcacttctcatgcttttcatctataattcacacatatatgcagacgaagatatgtttcttttctcaacacttgtatacaagcactatgccccaaatactatgtaatgatctatactacgataactcctagatgataatcttagagatcgctatatgatacaagctgtggccatgcactgaggacaaggagctcacgcccagagactgggctgctctcccggaggccaaacgccaagaaggtactggcaaagtcaggactccagggagaatctgcccggctgcagacctcggtgtggacacacgctgcatagagctctccttgaacacagaggggtctctagacattccgcctacctattagcttttctttattttactaacttttttacgggcaaggtattttga

SEQ ID NO: 690914 - DNA, 271 bp, Homo sapiens
ttcagggagtcatctgctgtgtgggggatgataagagagatgggtggctggcgcggtggctcacgcctgtaatcccagacttaggaggctgaagtgggaggagaacctgtggggtcaggagttcaagatcagcctggtgaacattttagtagagacaagtagaaaccttgtctctactaaaaatacaaaaatttaccaggcgtggtggcacgtgcctgtaatcccagctacttgagaggctgaggtaggagaatcgcttgaacccaggagg

SEQ ID NO: 690915 - DNA, 237 bp, Homo sapiens
tcgatcgtgatgacacaggcaggttactgactgagagtcaggccaaagccaggcaagtggccatgaaagaagcagtgacccaaactgatgcggagcgtggcaaaatagttaagaaagaagcagtgacacagaccaaggctaaagcttgggagctggttgccaagacagaggccaagagagaagcactgacccagaacaaagcggaaactcatatattggctgaaaaagagacagaga

SEQ ID NO: 690916 - DNA, 660 bp, Homo sapiens
  misc_feature (1)..(1): n is a, c, g, or t
  misc_feature (98)..(98): n is a, c, g, or t
  misc_feature (114)..(114): n is a, c, g, or t
  misc_feature (116)..(116): n is a, c, g, or t
  misc_feature (119)..(119): n is a, c, g, or t
  misc_feature (122)..(122): n is a, c, g, or t
  misc_feature (208)..(208): n is a, c, g, or t
  misc_feature (212)..(212): n is a, c, g, or t
  misc_feature (226)..(226): n is a, c, g, or t
  misc_feature (232)..(232): n is a, c, g, or t
  misc_feature (241)..(241): n is a, c, g, or t
  misc_feature (262)..(262): n is a, c, g, or t
  misc_feature (269)..(269): n is a, c, g, or t
  misc_feature (294)..(294): n is a, c, g, or t
  misc_feature (321)..(321): n is a, c, g, or t
  misc_feature (327)..(327): n is a, c, g, or t
  misc_feature (329)..(329): n is a, c, g, or t
  misc_feature (392)..(392): n is a, c, g, or t
  misc_feature (397)..(397): n is a, c, g, or t
  misc_feature (399)..(399): n is a, c, g, or t
  misc_feature (436)..(436): n is a, c, g, or t
  misc_feature (471)..(471): n is a, c, g, or t
  misc_feature (476)..(476): n is a, c, g, or t
  misc_feature (485)..(485): n is a, c, g, or t
  misc_feature (529)..(529): n is a, c, g, or t
  misc_feature (547)..(547): n is a, c, g, or t
  misc_feature (560)..(560): n is a, c, g, or t
  misc_feature (565)..(565): n is a, c, g, or t
  misc_feature (579)..(579): n is a, c, g, or t
  misc_feature (658)..(658): n is a, c, g, or t
naaattatgctaactctgagcattgatgtttactctgggttttagatttagtctttgaaaataatgtgttctaaacctttgccatcaccatctatgtntccaacatcaacactntnatnaanttgttcctgtttaggcttttattccgatttctctcgaacagccattaacacgcatgtgtatctttttgtttactcccactcaactntatnttctatgtagggcntgatanagatgttanttgatgttatttaatagctantgaggtnagacaatccaagaccatcattatantaaaattaaagttatttatggaagttnatagananttccagaattggttttacctcctacatgggaacatgttcaaggaacccaggacgggcttactngtctnantcaactcttcccattcatcaatccctattcaccagtngcacggaaagggggttctttaacaaagcattatanataanacctctacnaaactaaacataaactttttttgtagttaaatgcataaattctntttttttccacccctttnctccttttacacntcaantaaatctcactttncttttattttcctctatcttccaacctttttccatttaatattatacatataaaataatacaaccatcaatcataaaantt

SEQ ID NO: 690917 - DNA, 106 bp, Homo sapiens
cgctcttagagttcccggcagtcagtcgctcagtacataacatatatttatacacaacatgggttatatccgcagtcattcagttctccttttctacaccaaacag

SEQ ID NO: 690918 - DNA, 1725 bp, Homo sapiens
  misc_feature (125)..(125): n is a, c, g, or t
  misc_feature (473)..(473): n is a, c, g, or t
  misc_feature (1457)..(1457): n is a, c, g, or t
cgatgagcaagatattcagaaagaataggagtgattatcgtcataaacccatgactctctacactttcgaagcctccacttacagcccacttgtgacgagctcgtagttcgcgtatacgtacagngaaagtaactttatgtacctcagccaggtgtatcggtacttgcgcaagagtatcacattctagtcgatacacgtcgtcagatcggtaatctaatgacacaacatcgaccgtgaggcctctactcgtgattgacgcgtgctcgatcgtcgtgaaccgtcagctcatgcgacaaggacgtcgcataatagcagcttcggaaacttaactgtgcagtatactctagcccttaaagcagggtatacacagcgtcgtctatccacttagcccccttacgtgagaacgacttgaaacggaagagattatactgcacactcgctaatcgtagagaacgcgcacagtgaagaaaancgtcacgtgggatgagatgccgcgaaaagtcccgtgaattttccgcatggggatacttgcgtgcaatttaatattaaagcacaaccaaattgtttccgcgccggggaattctcctcacgttttccgctctaactaatgaacttccactctcatacccgagcgtaaaggtccctttcgaccaggtccacgtactgtattacttctatcatttttcccgtaaagggtactttttcttcaaatcgagtcacccgttagcgagccttctacacataagcccttataactcgaaacgaataagcttcacttctacttatgaagataacgctcgagacttcattcgccgaaccaatcttttataaggttatggtgcatcgcgaagagcgattaagctccggggggatttctctatagccccacctgtaagggctgcattcaagagaacaaagtccaggcgacagtagaaattcccccccgcggtaattcttataatgagcgcccttcagtttaagcggggagggcccaaaataaaatcgcgtgagggcgccctttatagtacccccatccccgttatggaataccctagaagcccttggaagcttaagtaaacataacggccgtagttataagcgcctaaaagagagacagagatataatccaactaggataacgcaaaaaggtggtacccaataacgtgccaagatccagttgtaagccgtttaaattcccccacaaagaaggggcaataactaggtgtaagagctcttgttatagcatatcccaccctccagtttgttataccaatttcccaaagacactcccataagaccgctaatgtcgcgaaaaattcgaccccttagttcgttattatttgcgcccggggagataacccaagtaaggctagtatatatattctctccgacgacacagctgtgttgtagtccagggggaaggaaaacacccaatagaaacagagcgcctaacagntcagagaagatcgacgagcagacagcgaagagagacgctacccaccaaaaacgagacgaggcaccacctcagtaagagaaaaagaggccacaccaaaaatgtgggtacaggcacctatctattgaccggagcaagagagaaacgctagcacgacagcaagaatagaacactacacctcgcgcaggataacgatgcgagtaagtgagagacaaaaagtatagttgcattcaccggcgtccgcgcaaaaacaacgacacagacaaggcgg

SEQ ID NO: 690919 - DNA, 413 bp, Homo sapiens
ttgatgctgctggtcagatctagagtatccccgacgatcaacgggcgactccttgcaaactgctcccagtccctaattatttccataaagagctttatcaattgcgcaggtgtatgtgtacatgtcatctcagctctatcaatcccagttcttctttcaattctcctttctcccttcatacgattaagatgtttgtcctttgcactttccccatgatagcaaaggttataccatattttgtcaagaggggggagtcgcccttcttgtcttacgactaggtctaccccttggctattttaacaaaaaatgatatcctccggcatatggcccatatggcgaaccaagaccccgtttcaataatattcaacttaatctcacatataatgacagagaacatacgcatgaggaagtta

SEQ ID NO: 690920 - DNA, 1147 bp, Homo sapiens
atcaccaccttctctaacgcatcctccccatcattctcgtataggatgccgcagaaatgtaaccagctgtccggcaaaagcatagtagtaccggaacatgttaccaggatacacacaattgatccaccagctgctattaatcatagtcagagttgctgatattcccgtgatccctgttcgttgcacatactcattgacttgtagatcttcacgcaatcatttcatttgctgactccagcgcacgcattgctcaacaatgcattaatgaggcctccctggacaaggctatccaccttcacgttgaacatcatagaacccaaagtctccaaaatgcagctcgcatgctcttgtcgtgattgtcatgcgaacacatccgcagagtgcaacgcatgtatatcagcgtatgacattggaccgcacatacactcataacctgcaatccgtggctcgttataatccttgcgtctgatcccatgaggatatcagcatatacttatacatttccgagaccgtcttacacattgtcgtccccaagtatcatcgccttcgcttacgatcaccgcttgttggcttacacatatattgtacgttgtatagggtgccgtgcaaggcaagtgtctaccgaagaggtcttactcggaaccatccatcttacaatggtatagaccacgctcctttgtctctcgatgacagataggtattcacacgtaagttgatacctttaccccgctcgataatagagatgcggagcttagtcatacgggcactcgcgagaccatcatctataaggtaagaccgcaggtatgcacggtctagaaactacttcgcagctaagcgcctatggaaatactttccccattgatcacaaattagacgtgtaagcatcgcgtcgaccatccacgagaggatggaaagcccacgttcgcatttacccacgtcattcatacacgaaagcctaacctggatccacggtgttggttcctcacccagtgaacaggagcattatacctctcgcgtgattaaaccgtgtccctacagacatataccaccaggtgtgtttacccccatcagttcctagagtctcctgtagcgccacacagctcatagttaggcgctcatgttggactcccggagattgccacacacg

SEQ ID NO: 690921 - DNA, 938 bp, Homo sapiens
gagagagcccagagacaggagagtgagctcaccaggcgcagcgccatgaccagtaagggtcccgaggaggagcacgcatcggtgacgctcttcctgccagtacctgcgtattcggcacgtgtccaggatccaagcctgacgtatggagctgctgtggcttgcgtttgaggagacagacacgcctagcgtgggcactgggctgtcagaaagtagatggtggctagccatggcatatgtggtgaccgtagttgaccgtggcctaggcaccaaaccatacactcgtccgtccatctggtctcaatcgtcccacacggagtgtggtgcctgtcttcaaggaacatcggagtcacgaccctttgaggccttcaaggattctgagggctacatctatgccaggggtgcccaggacatgaagtgcgtcagcatccaggtacctggaacgctgtgaggaggctgaaggtggcgggtcaccggttccccagtaagcatccactatgacgcattagtcgcctgcatgaggaggttcggggggtcaacaacggtcgatggagtctcgtgcgtgtcacgcgggctcgaggttccatgctcctgagggcagggctcttgtccctgcgatgagaggcatgagcctagatgccccactcgtatgtcctatcattcgctcattgtacatgagtagagaccggtagtcaccgtgtgttggggtgtcgaggttacccagacattaggggaaggcctaaggtctatgactacaacgcttacatggagggaccacagacagcagagaaggctgcacaagggttgtaaaatacattcctggcattccgggagaaaggaatggcagagggctgaagtcaaaagcgcacacctggaaaggaggggttcgtgacctccgtggaactgaataggctagagggtgcgtggctaataaggtgata

SEQ ID NO: 690922 - DNA, 326 bp, Homo sapiens
aggaggttggaaaaaaaaagggttaaaccaaagcccagtccagggctgtttacagggttgcaggcgaaaaactggggggttgggctcccctaaactaggactccagggcccccctctcccaaaagacaaaggcccttgcattgaaggaggtgggaaatgattagattttgaacaaacggaattatttttcagtctttttcaaaaaaccaaaaatttccatagttttaatcatgtaatataacccatttaatgtcccagggttttacttaaaaggggatcatgttttccccgttggtatgtagcctggataaatgctttttttttta

SEQ ID NO: 690923 - DNA, 248 bp, Homo sapiens
cggcccggctttccccccccccccggggggggccaggggggggtacccccaaattttttgggggggggccgggaaaaaaggggggcccgggggggagggggggggcaaaaccccccctttcccccccccccccccccccccccttttcccctttttgggcccccttccttcaagggggggccccttgggggccgggcgggttttttgtttttggggctaaaaaagaaaataaattttttttttagcca

SEQ ID NO: 690924 - DNA, 836 bp, Homo sapiens
  misc_feature (150)..(150): n is a, c, g, or t
  misc_feature (210)..(210): n is a, c, g, or t
  misc_feature (238)..(238): n is a, c, g, or t
  misc_feature (256)..(256): n is a, c, g, or t
  misc_feature (262)..(262): n is a, c, g, or t
  misc_feature (305)..(306): n is a, c, g, or t
  misc_feature (322)..(322): n is a, c, g, or t
  misc_feature (333)..(333): n is a, c, g, or t
  misc_feature (405)..(405): n is a, c, g, or t
  misc_feature (432)..(432): n is a, c, g, or t
ggacgaacacgtgacgcggtcgggcggaccactgcagactgagcggtggaccgaatggggaccgctgcttataagcgatcatgtttctccagtattacctcaacgagcagggagatcgagtctatacgctgaagaaatttgacccgatgngacaacagacctgctcagcccatcctgctcggttctccccagatgacagatactctcganaccgaatcaccatcaaggaaacgcttcnaggtgctcatgacccagnaaccgngccctgtcctctgagggtcccttaaatgatgtcttttctgccnnctgttacccctcgagnatcgtaaccanaatcttcggactgtgagccctgatgcctttggccagcatactcttgtgcatcagtctctcgtgggattgatnatgctgtgtgtgaggcaatcatgggtnggcatcacccataaagggaacacatttgactttttttctcatattttaaattactacaagattattaaggatagactgattccaaggaaaaaaagtgaaaaacacaaaggtgggggggggcttcgcgcccatgagaaaatgtttaataggcccattgcgtgggggcagcagccacaggggttaaaggaagctggccataggtgggtcgaagggaccccgggcaggacctagggctggttctcgcaatgaaaagcgcgggggcgagcggttgtttgcccaatccacgtgggtttggcggcactcgcgtatcaccaagagtcagagggcatatcgcgcgcgcgtcgtgctggggtgctagcttaacacagttcaaccacgcacatcaacgtcacaggccatctcag

SEQ ID NO: 690925 - DNA, 1032 bp, Homo sapiens
ccatcacttcttaaagatgtttttccagtttgttctcactgtggtgaaggagctgggagtctctgttcgcacgcgagtgctatctctcgtcatgggcattggaatactgtcagagtacagtccctggcgaaacccctctggctgtaagccgggctgcttgctagcatagctcattggcaggtctgccttcgcccaagggagggtgcgctattacgggaaagtctaaatgaggtgccactggtacgtctcgatgctgggccatactgcgtgggcccaggatactctctcctgtatcatgtcgtaggctgattaaggccattgtcaccgatacgtgtatctatgtagcgtcaattattcagactctgtgcacacgtggcggtcacttacaacaaatgtgcggtatgttgaagtagtttcgattcaactagaggacatgcaccatgaaaagcgtggactaatgtgagactgttttaaggattagtttaatgggtcacacaagcaacactgttgagcacatcagttatcggtaacaaggttgagccactatgagcagcgggttcttatctatctatgtacagtagcggtataaccgaaagtagctgtcgatcgctatgctgactctttaacaagtgtagaggagtcgtccaacttctccgtgcctagtctgaaacaggaacagaagagccggtttgcaagaaaaaacaagagaaaacaaaagaaggctgaggcacagatgaagctcacggcctgtaatcccagcactttgggacggccgaggcacggcagatcacctgaaagtcagacatctgggatccggcctggaccaggatggtgaaactctgtctctagctaaagatacagaaattggctgggcgtagtggtgcgtgccttgtggtcccagctatttgggtggcctgaggcaggagaatcgcttgaacccaggtggatggaggtggtcagtgagtctgagcatcaacaccatacactcagcctggcgaaattaagccggtcgcatctcaactgaagaacccg

SEQ ID NO: 690926 - DNA, 148 bp, Homo sapiens
gtgtgtctagaggatcccgtcactttctacaccaggaacgtccccaagtgcatcttccagtagtgacatgtctctctcagaacctccacagcctcttgcaagaaaagacttgatggaatctacatggatgcagcctgtaaggattgaa

SEQ ID NO: 690927 - DNA, 900 bp, Homo sapiens
  misc_feature (150)..(150): n is a, c, g, or t
  misc_feature (210)..(210): n is a, c, g, or t
  misc_feature (238)..(238): n is a, c, g, or t
  misc_feature (256)..(256): n is a, c, g, or t
  misc_feature (262)..(262): n is a, c, g, or t
  misc_feature (377)..(377): n is a, c, g, or t
  misc_feature (496)..(496): n is a, c, g, or t
ggacgaacacgtgacgcggtcgggcggaccactgcagactgagcggtggaccgaatggggaccgctgcttataagcgatcatgtttctccagtattacctcaacgagcagggagatcgagtctatacgctgaagaaatttgacccgatgngacaacagacctgctcagcccatcctgctcggttctccccagatgacagatactctcganaccgaatcaccatcaaggaaacgcttcnaggtgctcatgacccagnaaccgngccctgtcctctgagggcgcggcggtgaacttgtatgtcgtatttcttggtcatgcgtggttactcccgtcgtgatgacgtcccgttagaccgaagacgtcgtgtcggagacgtngtttatgcgccatggagttgtcgtgttgttggccgagcgcagtacttcggtgtgggcagtccaggtcgtcttcgtgggcggattgagttattgcgttgtggtagaggcaatcatgggtnggcatcacccataaagggaacacatttgactttttttctcatattttaaattactacaagattattaaggatagactgattccaaggaaaaaaagtgaaaaacacaaaggtgggggggggcttcgcgcccatgagaaaatgtttaataggcccattgcgtgggggcagcagccacaggggttaaaggaagctggccataggtgggtcgaagggaccccgggcaggacctagggctggttctcgcaatgaaaagcgcgggggcgagcggttgtttgcccaatccacgtgggtttggcggcactcgcgtatcaccaagagtcagagggcatatcgcgcgcgcgtcgtgctggggtgctagcttaacacagttcaaccacgcacatcaacgtcacaggccatctcag

SEQ ID NO: 690928 - DNA, 620 bp, Homo sapiens
cagggcagccatctcttcgtgagacagcaagtgtcgcatccgcaggcgcaaccgtgccatgctgtgctctacagccatgtcttccgctgatggcagagacttgcggatggaaccgcacagagccgcgggccctttgcagctgcgattttagccctacgttttcaacggaggtactatactgtcaattgctggagaagaatttgctattgcagcttctgatactcaattgagtgaagggctttgaattcatacaccacatatccccaaatgttacgaattaacagacaaatcagtcattggatgcaggggctttaatggagactgttttacgctgacaaacattattgaggcaagactaaagatgtttaagcgttccaattgtaaggacatgactacggtggcaattgctgcaatgctgtctacaatcctgcattaaaggagctgattccatactatgtttacaacatcagttggtggacttgatgaagaaggaaagggggctgtctccagctttgatcccgagagggcttaccagaaaagacttcttaaaagtttggaggctacaacagtgccatgcttcaggcccctgcttgacaaccagattgtttttaagaacatcc

SEQ ID NO: 690929 - DNA, 112 bp, Homo sapiens
  misc_feature (5)..(5): n is a, c, g, or t
cccanaaaacttacttagtggacactgcaatttgaatactaatttctgtctttggaattttttttcaactatttaaaaaataatgatatggctgcactttgctgacccctgg

SEQ ID NO: 690930 - DNA, 173 bp, Homo sapiens
tttttttttttcccccgggggatttttttaacccatgcccccttttcttggggcctttgtaaaaaaaaaaccccggcccttgtattctttttttcccctcccctccctcccagggggaatttaaaaaaaatgttgttttgttttttattttttaaaaaaaatgccaaaagaca

SEQ ID NO: 690931 - DNA, 1100 bp, Homo sapiens
  misc_feature (1100)..(1100): n is a, c, g, or t
cttactcggccacccaggtcaagtaaggtgcttgcggggagaagtatgaagtttgctgtgttgtgttggcccctgtggcaggccctggtggctgtccttccttgtagtaacgggtactaaccctttcccatagctggtttcctcaaggcaccactgtcgcaggagcggtgggcggggggcagcgtggtcctgcactgtgaggctgtgggcagccccatccccgagatccagtggtggtttgaagggaatgctccaaacgacagctgctcccagctctgggatggtgcccggctggaccgtgttcacatccatgccgcctaccgtcagcatgcagccagttcgctctctgttgatgggctcaccgcagaggacacaggcacttacgagtgccgggccagcagtgacccagaccgcaaccaccttactcggccacccagggtcaagtgggtccgtgcccaggcgagcgtggtggtccttgaacgtgagtggccagggcacctgtttctgtttacctctcgtgccaccagacctggctcccactttgtagaaccagatgctgctctgccctaccactcatttgagactcccctgggcacacgggtgagctgaacactcatcagtgtccttgctgggtgcaggttggccttgcctcttccagtggctcctcggttcgcaccccaggccttggtctgctgtgcaccagcctgacttccgtcctggtctgtccatgacactggtctacttggctccatgtctccctgtgattgctggcagggttgggactgtgccaagggttcgcagagtgtatgaacggaaaatccacacgactggcgaaccctgggggtagggacaacccaagaagacaggaaagaaaagagagcggaccaagggccggccaccacacgagacggaaaccgaggcaaacagagagagaggcaggaagaaaggaaacaaagagggcaaaacaagcaagggaggacaagaaaacaacgagagacaaaatcagaaaaccagcagagacagacaagaagaagacaagcaagcaagcgacgacacagggaagcaaaccaacacccaacgggccaccacatcacccgacn

SEQ ID NO: 690932 - DNA, 177 bp, Homo sapiens
gcctgggtaaggccaagatggctgtcttcgccttagtactcgtgtgaagttggcagggacggttcctggtcatcttcttggggcttatttggtgtgctgttgaaggggggagactagagaaatgcagggaacctctatccggggcaggtaggcgcctgtgggactgggtgcctctgg

SEQ ID NO: 690933 - DNA, 209 bp, Homo sapiens
aggagttaactcgaggtagatccatgcctggggcataaccgaactctcgccgctcggcacgctgtccaaactgaaggccaagcaccgcgacctgccggttgagcagcagcgccacatcctggagaagcagggcaaggtgatctacggcatcgacatgaagatcgtcgacgacgccggccgcgagctgccgtggggggtacccgaagcta

SEQ ID NO: 690934 - DNA, 225 bp, Homo sapiens
ttttttaggggggggccccctttgggggccccccttttgccctcccctggggccccccccccccaacctttttttttccctgggccccccccccggggcccccctgggggcggggtttttttcaacccgggcccttttagggtatttttttcgggcaattccccgggtgggggttttttttttcccctggggggggtgccttcccccttaggccttttagggtca

SEQ ID NO: 690935 - DNA, 1204 bp, Homo sapiens
acgtttgttttaatggtctttctgattaaagaaagcccctgtggccttggaggccaaaaaacaaacaaaaaaacaacacaacacaacaaaaaaaaaaacaaaaaaaaaaaaaaacaaaacaacaacaacaaaacaaaaaaaaaaaacaaaaaaaaaaagggcggcggcgcgcggcagacaaaaaacacccccagacgagggcgccaaccaaaaatacgagagacacacaagaaggagaaaagaaagagagagaaagagaggaggcaacacaaaaagagaagcacatgataaataagagaaaacacaggggagaagcgcaccgagaagaaaagaagaacaccagcacgaggagggaaacaaacggaggagagaccagagaaaaaaacaagagagagaagagcaaagcgaacaaaaaataaagaaagaggagggagaaaagaaccaagagagagagagaagaagaaaaaaacaacgaagaacaaagaaacgaaaaagcaacaaagaagacggaggacgagagagacaaacaacaccaaaacagaaaggagaggaaaagaagagaggggagcacaaccaaaaagacggagcaaaagagaagaaagaggaaaagcggggacaaagcaaaagagaacagaaaacaaaagaagagcataacagaaaaaacagaacaaaaacacaacacaacaggcaagagaagaaaaaagaagagagacaacaaaagaaaaagaaaggaagcaaaacaagagaagaaagagaacaacaaaacagaggagaaagaagaggaaaaaagggagaagatagggaaaagaagaaaaagggaaagaggaaagggaaagggggaagaaagaaagaaaaggaaagaaaaaaaaagagaacagggagagaaaaaaaggaaagagagaggggcgagagggaggggaagagagaggaagaaaaagagaagaggagggggggaggaggaaggaagagcggggagaggcagaagaaaaaaaggagagaggcaaaaagagaaaagaaaagaaaacaggagaaagagaaagaaagagggagagaagaggaggaaggagaaggaaaggagcaggggagagaagaagaggaggaagggggaaggacggagaagaacgagagctgaaagaggaaaggaagcagaaggacaagagaagagggagaagaagagaggaaagaggggggagagagagggagg

SEQ ID NO: 690936 - DNA, 117 bp, Homo sapiens
ggatccaccatgtcacagaatactcttaattttttcaccattaaaaatgtaaaaacgatctttatatagttcatgatcatgattaggtgtcatgcacgtatgtgaaaagattggcca

SEQ ID NO: 690937 - DNA, 144 bp, Homo sapiens
cgggagtagtacaacatgagtgttggatgtggaacattcaaaccacagcagtatgaaaacaatattctgactccaaggttatataggtcaacgattacatggtggtaacggaatatggctagcagaatatggaattaggctaaa

SEQ ID NO: 690938 - DNA, 298 bp, Homo sapiens
tagaggatcccagttaagcgtcaggggaggagtgatgcaggtgaatgtgtttctaacaagcaggattaagggctcatgggtgcaaggtggggatgggcctgaagaaggtggcaggtctcattctctgagggagggagggaaggagttgaagaagaaacttcaggtggatggattcgattgtctaagccaaggaggaggtctcgtccttggtggtcattgccaggtaaagccttgacttcacattcacaggtgagaagggacctggtccaggaggcttcaacctgggggtcctccttaa

SEQ ID NO: 690939 - DNA, 492 bp, Homo sapiens
  misc_feature (298)..(298): n is a, c, g, or t
  misc_feature (369)..(369): n is a, c, g, or t
  misc_feature (394)..(394): n is a, c, g, or t
  misc_feature (439)..(439): n is a, c, g, or t
  misc_feature (454)..(454): n is a, c, g, or t
aaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaataacagatactggagaggatgtggagaaataggaatgcttttacactgttggtgggagggtaaattagttcaaccattgtggaagacagtggtatgtacccaaaggattatnaaatcattctacttttaaagatacatacacacgtatgtttatttacagcactgtttcacaatagcaaaganttgggaacccaaccccaatggttcntcattgatagactgtttaggcaagacttattaaaggagggaaggngagaagggattcaantcggtgggtattaaaaagtggttaaagggggtgtcacc

SEQ ID NO: 690940 - DNA, 546 bp, Homo sapiens
tagatgtgagagaagatacatgccggtgtatacacacatcccaatgcctatagtaattagcatggtgatcccagtgggagcaatacatattattacaaaatgattggtagagggatggccatgcatcacaaaaacaagtgcataggtgtatgccataattaggcataacactgggggcaccttctgaaatctgaagtcatgagagtgtggaaagtccgggatatctgaaaccatgttccctaggctcactcaggactgaaaataagttaatccggcaatcaaacacacatagaaaaacaaagtataattaatttgattcttagagaaaaagtcacccagacataaagttctagacattcacaacgttgtgagagacactatgtctcagtcatgccgacgactagctctcggcttgtacaggatacacatgataataaatctccctttgggttaaggttgtctgaggactttccctaagttacacataacaatttcttgactaagcagtagaaagtgatgacaataataagtagcatgggcgggggg

SEQ ID NO: 690941 - DNA, 110 bp, Homo sapiens
agcagtcactcactcttctgcctcttcagctgtctcttcacctgtccccctccccaaaaattaaggctccctgtatagattcaaaagagtctgtaaaaacccagacaacc

SEQ ID NO: 690942 - DNA, 237 bp, Homo sapiens
agaattagggggaaataaccttttcccaataattataaaaaattgtcctgggtctaaggatccaaaactggtttggatttttttttgggtccaaaccagatttcctgggattctaaactaaaaatttttgaaaaaaccctttgctttttataatgagggcgaaatatggtgtcgaggctgtttttcaaaaattaaaattgaagtgaaaattttaacaaaaataaaagaattttgcca

SEQ ID NO: 690943 - DNA, 188 bp, Homo sapiens
ataagcttgatgcaccccagtgtgaggctccacaagctaggaggggcccctggacccaccaggaggacaggtctgcagttcccagccatgccggctggaacgtccgcctacccactgcgtcggggtcctcggcctccctaggggggccctagagtctagtacgtaggcctagaggctgcctagcgccc

SEQ ID NO: 690944 - DNA, 183 bp, Homo sapiens
ttgttcaaccctctccctcccccgaatgtcaaataaacttgggtgctggcttccaccgctgtcgcaaacagggcacctaaagggcagtccagagctgagttggcagcctgggggacaagcgaaggaaggaagaaaaagagagcaacactctactcccttagcccttagggtaaacatttacag

SEQ ID NO: 690945 - DNA, 153 bp, Homo sapiens
ggcttgtcctctcttaggtccagagctcaggtgaatgcagattttcccagtctgtcatgtgctgtaagtccctggtggggaggctccttggctggtttccgtgtaggtagacatgctacacgtcgctgcccttacattggcttcattttcatg

SEQ ID NO: 690946 - DNA, 1115 bp, Homo sapiens
  misc_feature (750)..(750): n is a, c, g, or t
  misc_feature (1115)..(1115): n is a, c, g, or t
ctcagacgctgcaggaaatacgagaagcgtgctgacactagtcctggccgccatcatcctagtccgtcatcggcctcgccatccctagcgcgatcctctatacataacagacgaggtgcaacgatccctccgcgttgagccagtcagaatcaatggggccgaccaatgggtactgaatccgtacgagtttagcagccgacatacggcgggactaatgcttcaaactcctacgatgaactgtcccgcatttatggtcctaggagaccagagcgaaactgcgtactccttgatcgtctgatcgatcgagtgggtgacgtcccgaatctggaacgtcccccaatatcgatgaataagtgaatgtatcattcaacaatggaccgtctctgacaacttcattgaagcatgtggccgctagcagtgtagagtcgtgtaaacaagagcagaagtgcaaagtatccgcggatcgggtcttagagaaccatagaggcacattttgcaccgcatacatcgagcgcggggggctgtactaagcgggtgcgaatggctcctgtacatatctcgtgtgaggcataacgcatcaggtgtgtcatgtcccatgcgttcctaagcaattgaattcggcctagaagagatcttgtcgagaattagggccccgctatatagccctatagtcagcccccctctaagcgccctctagagcccaaaagcatatatgagtaaccccaaaacagcccccattaaacaccagancggggctgcggcggctggctcagaaggtacacccacccaggagggcacaccccaggtgaacgggaccaccacacccctcgctgtgcgcccaggggcccaccaaacgcgcaaggcggaacaaagcgcggcgccggccccaggtattcaaacccacggggccggaaaaaggcacgtgtggtactcgggacggtgcccccgtgcggcgcgccggggcaacccacggaataggggcagcaacacaggggcgccaggggcaccaccacctcggccgacgacggcataaacacaccagagaaccaaaggcacaaaaacgaacaacaccaacagcaaagcacacaccacacacgcgccacccatatgtgggn

SEQ ID NO: 690947 - DNA, 682 bp, Homo sapiens
ctattgggttcttcggatttccgaatatagatgccaatatgctgcctttaccccggaggatgctgatgtaccttctctcaggccgatgatctcaggcctccatggtccctggagctctgggaaaggcgagcgcgatctcgcgcccgactacccagtgctctggtgtcgataagcctgtgatctggtaaagaacaaacgcccttgtgagaagacggggactcgccaggataccccttctctcgcctcatgcagcctctcaggcacaacgcatatgcgctcactctgatcctcctgccatcctttgcgctagagtgccatcttcaagctgctcggagctcctgtgggcgaaccccttggggtgcaacttgtgactgcgaagataggcgtcaaccgaagcagcttgtgctgagaatgtctgctggcgagagccttgatgtgctgtgccaggcctttgtgactgacgtgctgtgcatgctattagttccttatactgtgtgtaccactcgattagtagcccactttcctcgagagcatacggagcacgagaaatctgaagtggcttgctccaggtccctgcaggtatactaaggtggtagaaccagggactctgaaccatgccctctgcttctgaagaccggttctgaattctcttgactaggagcttctcatcaggtaacccaga

SEQ ID NO: 690948 - DNA, 371 bp, Homo sapiens
  misc_feature (336)..(336): n is a, c, g, or t
  misc_feature (369)..(369): n is a, c, g, or t
cctcacacttcaccactgccttatacaaagcacatctatgacagttaattttatgtgttaacttgattaggccacaggtgcccagatatttgtttaaacattatttctaaatgtgtttgtgagggtgttgctgggatgagattaacatttgaatgagtagactgagtcaagcagattgccctccccactgaggatggacatcatttaacccactgaaggtctgattaggaacaaaaatgtgggagtacaggagaatttgctctttctccctgtcttcaaggcaaggacatagcttttctcctgcctttgggacttcagattggaaacttattaccnttgggctctcccagtttctcaggaccttcagantt

SEQ ID NO: 690949 - DNA, 481 bp, Homo sapiens
ggctcggtaccctctggatgcaagtgtccaaggctccagtgcctatgagaactgccctgggttagctggccaggaggcggtccataagaatggggacagtgtggctctgccagggcgtgtcgcacctgtcctggacacacattgttctgttcctcctcatgtcatttccagcctttctaccctccctgactctgcggctcccctcagcccccttgtcagttcatggcctgtccctcccatactcctgctccactgaaccttcgtaccagtcctcccttctgtgctctcgtttccccgtccttcctctctctctctctctctctctttctctctctctttctgtttgtgtgtgtgtgtgtgtgtgtgtgtgtgtctgtgtgtataagatacaacctgaaatggcgtgggaccacacagaactatgatgccgaccataactttgtcttctgccccatgggtgcccactaggtgatcttgcaaa

SEQ ID NO: 690950 - DNA, 145 bp, Homo sapiens
tgagctttaagtatataattatccacgctgtgaactctgcaactttgtttagcttgtgatccctcaaatatggagcgtacgttagtgtttgttactagaaatgtcctaaaaaacatttgttggtgagtctgacagtcaaagctga

SEQ ID NO: 690951 - DNA, 303 bp, Homo sapiens
  misc_feature (249)..(250): n is a, c, g, or t
  misc_feature (282)..(282): n is a, c, g, or t
ccaccacccctggctaatgattcactaagaaaactcaaaggactcagcatattgtcatattcacagctatgtatttattatagctaaaggatataagagaaatcagcaaaaggaaaagatacattagctgaacgtccaggtggaaaccgaggcacaacgctttcaaggggtctccccatgcgaatgaagttcgtgacaagcacatgtgacaatggtgccataccaggcgaagcttattagaagactctnngccctgggtttttattagggggctggtcacantaggcatcttccacttgtgca

SEQ ID NO: 690952 - DNA, 548 bp, Homo sapiens
aatttaacatatttctgttattaaaacctccctgtctgatgtttaaaatctcaataagctatcataaagagattcttccttaccttcagcggatcacctgaggtcaggagtttgagactagcctggccaacatgctgagacccccgtctctactaaaaatacaaaaaattagctgggcgtggtggcgcttacctgtggtcccagctactcaggaggtgacgcaggagaattgcttgagcccaggaggtggaggttgcagtgagctgagatcgtgccactgcgctccagcctgggagacagagcaagattccatctcaaaacagcaacaacaaaatcctaggtagcactcaagtcttttgtataaaagtcagcaggtttctcgccagtatactgttttgtaacattgtctcaaactttaaagaatgattctatatggattatgaaaaagaaatagacatagggctattggcaagcagaagataaaagtattaacatttgtagatgatacagttgtctactaagaaccttgctgtctaccccatatcaaa

SEQ ID NO: 690953 - DNA, 184 bp, Homo sapiens
ggatatgaaagttatgaggaaagagtactgtataatccagccattctcctaggaatatacatccaagagaaatgaaaacaagtccacataagatttgtacacaaaagttcatagtagcattattcatggtagccaaaaagtacaaacaacccaaatgtccatcagctgactgaatggactacat

SEQ ID NO: 690954 - DNA, 518 bp, Homo sapiens
  misc_feature (432)..(432): n is a, c, g, or t
tcatctgtattattatatatctttattcagacagagttcattttttgtgctaggctggagtgcatggaatgttaagatggcagtgtttgtcagagaagggcttactgagaaggtaaaggtccccaaaatatgagagaggtaaagaactgagccatgtggacatatgagggaaaggaatagcaagtgcaaatatcctgaggctaggatgcgcttgaggagaccatacagtagagcaaacaggagatgagaacgacatgagatcagcagtgaagcagggctaggtcacataggaccttcgatgaataatccactctgaagacttcggcttttttttttttttttttttttttggggaacaggggggtttcttttggggcccgggttaagggtccattttttttttttgggcccccggaacccccggcttctggnttaaggaattttgcccccccccccccccaggaggggggaaaaagggggggcccccatccgttaacagggggcccggcccaaatgat

SEQ ID NO: 690955 - DNA, 266 bp, Homo sapiens
gggcccgaggtgagttgaatggaaaaacctttgaagcggtctttccccagggttttggcaagcttgccagtgtccctgtgggggggggtgtacccgtttttgttgccccgggttttcccccccctgttgttggttttgcccctgctccaccagaggaaaaaaaaaatgaaaaaaaggggggttttaaaaagtcaaataatgccatgggattggccctttttgattaaattccggctcccccccaaaaaaagcctttttccccctca

SEQ ID NO: 690956 - DNA, 253 bp, Homo sapiens
agccccagttccccccaggtgaaataaggaattgctgctcacctggggcaggtgaaggtggtgtggacaggagttgaacgtggcctttcatgctgagagtgtgagattttaagactccaggatccttctctactttctttctgctgtcacaccatgttctcagcatgccatcccattcgaatggctcttatagattatttactggtgtgggggtttgctgttgttttttaggacctcaccacagcatatggag

SEQ ID NO: 690957 - DNA, 714 bp, Homo sapiens
ttttccccacaagggccccctcggcccacgcacgccctggggtcacggccgtcttgcgcgtactccgctctctcatactctctcttctcatgtgctccctctggaaagcgccccccttcccaattgtcctttgaaggcgcacacctttgccaccggggcgctcttttggagggacccactcggccccccgaagagaggggaggccccccccacgggcccccccgagagtgccccccccagcgggagaggagaggaaccccggttcacacgggagcgctttctttgtggcgcacgtagagcccccggtgtggcccctctttctcccacccctcgaggttcttgggggcgcgccccgcctccccctcggggcgttcgcccaattcccctcttgccacttcttctgcttcttccactggggaggccctccctccccctcttccccacctggcttttcactaactcgctcccgtggaccacttggccccgcgcttttcctcttcccgggccactaggcttggcccaaggttggctcgagggcacccctccctttttctgcacccctctggcccgacgggccgggctggcttttccccatgcctccacttcccactgccccctcggtggctttggcctcctccaagcactcccccctggtggatggactgtaagtgtgtaaatttttttgatttatttttttattaaaagggaaaggga

SEQ ID NO: 690958 - DNA, 428 bp, Homo sapiens
  misc_feature (42)..(42): n is a, c, g, or t
  misc_feature (47)..(47): n is a, c, g, or t
  misc_feature (68)..(68): n is a, c, g, or t
  misc_feature (78)..(78): n is a, c, g, or t
  misc_feature (100)..(100): n is a, c, g, or t
  misc_feature (119)..(119): n is a, c, g, or t
  misc_feature (123)..(123): n is a, c, g, or t
  misc_feature (125)..(125): n is a, c, g, or t
  misc_feature (147)..(147): n is a, c, g, or t
  misc_feature (156)..(156): n is a, c, g, or t
  misc_feature (196)..(196): n is a, c, g, or t
  misc_feature (210)..(210): n is a, c, g, or t
  misc_feature (219)..(219): n is a, c, g, or t
  misc_feature (223)..(223): n is a, c, g, or t
  misc_feature (233)..(233): n is a, c, g, or t
  misc_feature (248)..(249): n is a, c, g, or t
  misc_feature (255)..(255): n is a, c, g, or t
  misc_feature (272)..(272): n is a, c, g, or t
  misc_feature (275)..(275): n is a, c, g, or t
  misc_feature (281)..(281): n is a, c, g, or t
  misc_feature (300)..(301): n is a, c, g, or t
  misc_feature (322)..(322): n is a, c, g, or t
  misc_feature (413)..(413): n is a, c, g, or t
  misc_feature (427)..(427): n is a, c, g, or t
agcagcggccccgggggcggactgagcggacaaacggaagtntaggntacggtctgagacatcaccgncaagctgggnatcggggagatggccgagactnaccccaagaccgtgcaggncctnanctcggtggtgcagacactcctncagcagatncaagataaatttcagaccatgtctgaccagatcatttggngaatttatgatatnagtagtcgnattnatgatctggnaaagaatatcgcggnnctcatnacacaggctggggtggnagnacttgnaagtgaaacaagatacctnnccacgcaaaagagttgaaggntgctaataatttatactggaatctggcatttttccaagccaagagaagatcgaatggcttttttcagctaactactatgtgtagacagggnttatattataacgna

SEQ ID NO: 690959 - DNA, 399 bp, Homo sapiens
  misc_feature (340)..(340): n is a, c, g, or t
ctgccatgattcagcatttgtgggactggggtaggaagattgttgagcttaggagtttgagacagcctggacacatggtgaaactccatctctattaaaaataaaaaattaagctgggcgtggtgttacacgcctgtaatcccagctactagggaggctgaagcacgagaatcgcttgcagctggctgagatcagtgagctgagatcaagtggagtgcaatggctcaatctcagctcactgcaacttccgcctcctgggttcaagagattctcctgcctcagtcttcctagtagttgagattactggtgccggccaccgtggctggctactttttgcgtntttagtagagacaggtttcaccatgttcgccaggctggtctcgaactcctgacctcagg

SEQ ID NO: 690960 - DNA, 138 bp, Homo sapiens
cttagaaaaacaacgtacaatgtgtcaagagcatatctccaaccctatgggacgcatcatctaaaattgcatatcagctcatgcggtatcgtgcaatattgtaaagcccgtattagaaagccgccaagcgtcactcag

SEQ ID NO: 690961 - DNA, 107 bp, Homo sapiens
tgtacctgtatgagcagtattgtgctattgcatactagtctttgctgcctgtgaacattggtgggcctagccctactagtctcaatctccaacacatattgcctagt

SEQ ID NO: 690962 - DNA, 123 bp, Homo sapiens
ttacgcgtataattacgtctctagttttctaatcaaaatatcttcatttgaagaaaaatactaattgataattataaaatgatatgtctctatacgaattcatggaacagagctcctaaaatc

SEQ ID NO: 690963 - DNA, 148 bp, Homo sapiens
cgcggggttgatccgctttccatgtctctcgtggcgaagcaggggctatggaggatccgctgcagggaggatttcaccatccgggccgcgtggggtccgaaaccagcgaaaacctccgtctgcgatctctccgctgccgtcagccacg

SEQ ID NO: 690964 - DNA, 199 bp, Homo sapiens
gctccgcacagggcatgcgcaggcactgcctccagtgcggcgcacaggccctgcctttcaagtgcatgcagctcactgatttcatcctcaagttaccgcacagtgcccacccaaagtatgtccgacaagcctggccgcaggcagacatccatactcatgtccagcccggggctacccgagctcgaacttcgtacatcct

SEQ ID NO: 690965 - DNA, 323 bp, Homo sapiens
atgctgcactatgggtcaaatgattctcctgcgtcagcttcctgagtagctgggattacaggtgcatgccaccatgccggataatttttatattttatattagagacgggatttcgccatgttaaccaggctgttctcgaactcctgacctcaggtgatctgcccgccttggcctcccaaagtgctgggattacaggcatgagccaccgtgcctggccttattggcttagtatctaactttatcctccaaaaattttgggccctttttctgtggggaaaaccaagttaaggcttgctcttcaggcatagacactaacctttat

SEQ ID NO: 690966 - DNA, 794 bp, Homo sapiens
  misc_feature (23)..(24): n is a, c, g, or t
  misc_feature (140)..(140): n is a, c, g, or t
  misc_feature (142)..(142): n is a, c, g, or t
  misc_feature (147)..(147): n is a, c, g, or t
ggaggtgtggggcaaggcagggnnccagtgaagacaaggagcgaggctctatactgaggcctggtagaagtggagcagatgggccacctgaagagctactaggaagttgacaccaataagatgtcgttagtctgtgtatngngagtnagggaaaggaagaacttgccagtttccaggttttaatccttccaaaggatttctgcagaaagacactggaagagctgtattcctacttatccttaaaggaaagaaactgcccttgaattccaaggacatgattactgagctggaattccaaataatgtgtcccagtgagactcctgggggtagttttgtccggtaactgtgtgtgttagatgaaactgcagacttccagccactctatcttacatgtctgttaacagttaatttgctctgatgaatttgccccatcttggagaagggggctctgctgactgttttttatcttggagtaacatgtcctttgatcaggaaggttctaggacttattatttgttaaaaacaaaccattggaaggctgggcattggtggctcattgcctgtaatcccccaacacttttggggcacgcccaaggcagggcgtatccggtttgaagcccccaggcagttccgggagccagcctggggccgacattgtcgcagaagctctcttcttactggggaattgccagggtttaggccacagacgttggtggagttgcgccttgggtttccccggccgctttaggagggctgggtgggagaaacccctgggggccccggaggttggggca

SEQ ID NO: 690967 - DNA, 359 bp, Homo sapiens
  misc_feature (16)..(16): n is a, c, g, or t
  misc_feature (52)..(52): n is a, c, g, or t
  misc_feature (86)..(86): n is a, c, g, or t
  misc_feature (91)..(91): n is a, c, g, or t
  misc_feature (96)..(96): n is a, c, g, or t
  misc_feature (119)..(119): n is a, c, g, or t
  misc_feature (141)..(141): n is a, c, g, or t
  misc_feature (160)..(160): n is a, c, g, or t
  misc_feature (164)..(164): n is a, c, g, or t
  misc_feature (178)..(178): n is a, c, g, or t
cctggaaccttaatgncccaagatgccagtaccccgtaccagcctataatanccccccataccaaagtccatggggaaacaaacantattntgttncttggtttatttaatacctatantccgccatacagtactttaaangcccaattacagtgccaancttnatttattgtaaaantttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaa

SEQ ID NO: 690968 - DNA, 731 bp, Homo sapiens
  misc_feature (718)..(718): n is a, c, g, or t
gcgatattggctcaccgcgacctctacctctgggttcgagcgattctcctgcctcagcctcccgagtagctgggattacaggcatgtgccaccacgccggctaattttttagagacagggtttcaccgtgttggtcaggctggtctcgaactcccaacctcaggtgatccgcccaccttggcctcccaaagtgttgggattacaggtgtgagccactgcgcctggccatgagtcttgttgaaagttaacatttttgggccatagtacaggtcatctaaaacaaagtaacctggtaaggtactaagaaatagtggcatataaagaaactttatagacgttgaatcattgagactttataatacctgtagagatcttgttctctctggcaaaccgtagttctttcctgaaaccccaatgttgttttttcccttgatagtgtttaggacaattaaaaacaaaaacatgaattgcaggaaagttcaggttgtgtggatgcagtactttaagactgcacactgttcctgacacagtggaatagttaggctgtcagaactttggaagctcaggcaaaaatgggattgatctgtttatgctgaattagagagtttcacatctttccccctaaaagtttgggaaaacaatttaactagaggtgtacataatttgttaggattaattttaacgcatgggtaatatttggatgcagttgttccctccnttaggttttgttt

SEQ ID NO: 690969 - DNA, 802 bp, Homo sapiens
cgccgcgcactccgccgccatgtgagcagctgccgcgtcaccgacttcttcgctgcgccgccgtcccgtggcctactcacgcattaggcctattcacggctgcactgtagaacacgtgtccatagaggttgaagatcgaattgctagatataaatatcgaaatcaactactacagtgaacaacatattcctacaatacacaagacctgtcactaacagcgataacaccaattaattctcccacaatcaagatcactacatcataaaacacaaacacaacaccaataaataaataacatataatatatcaactcactaaatacaaacaaaatacacaaaaaaataaaaaaacaaaaccacacacaaaacacaagaaagcataacaccgacaaggcagacgactacccgccagcaaacagagaagacacaagaacccacacaacaaacagaacaccaaagagcgcggcacacacacccacaagccatcacaaacaaaacagcaagagagcgagagcagaaccaagagacagacaagaaggggaaagaaaagaaaaaactgaagacggcgcaaaaacgcgggggagaaacaagaggacggaaaccgagggggagatcatggataggaaaagaagcagggcaaacgaggagaaccagccgaaaatgagataagaagaacagaagacaacaagcaagagaaggcgcgaaacgccagcgacgagcgagacagaggagcaaggagagcaacgcagacgcaacaaacagaaagaaggagaaggaaaaggaagaggatggagagagaaaca

SEQ ID NO: 690970 - DNA, 173 bp, Homo sapiens
tcattcattctttcttgtctgtcgcacctctcattcactcaatacgaaaatatttggacaggcacggtggctcatgcctgtaatccagcacctttgtaggccgaggcaggagaattacttaaggccaggagaccaagaccagccagggaaagatagcaagaccctgtctctac

SEQ ID NO: 690971 - DNA, 984 bp, Homo sapiens
  misc_feature (152)..(152): n is a, c, g, or t
  misc_feature (157)..(157): n is a, c, g, or t
tacggtcaagtgtgagacacacagataataggagcaaatgtagttcccatgtgccaaacaaaataatgaaatctctgcatgtctgcagcatatctgccttttgggaatgtaatcaaggtataatcttggctagtgttatgtgcctgtatttntttanaatggtacaccagaaaaggactggcagtctacttctaccatagttgaaacttcaccctctttaatttcacaatgatattctttggaagcaggaagaaatggtcatagaagaggatcagaccttctttcccgtgtaagaccagtatttggcgcgcatatataagcctggttaaattggtcagtctaaagtctgtcataataagacattctgtgaagaggtaaacgatcgaaactggtgtataagtaaaagcatcaagccaacaacagggtcttgagataacctttgaagcttattgtactggcctgggaccagaaagatgtctgcattactcattggctagaacaatgtgtatgcacagaactggcaactaggattaatttgtcttacaaggaaggaaatgtaaactctaggtctggttttcacatacagcagctctatgaataacatgcatctgaattttaagttggaaaggtgatctgaataaatttttcatgtgcatcttttgtcgaatgtgttgggttcccagaaagactgtttagaggtttttaaaagacttcagttcttaatgtgaatgtgaaccttctgcatggggaaatcataaccatatggttgagtagactctttgtggtatcagcacacttgggagggggttatcaaattgacttggggtgagaccagaggcgggggaagaggggggtattaaggtggacaaaactaaagagtattccggggggtggcaacacctggttaagaaggggggaaacagggtcataacaaaaaggggggggcaaaatattagagcctttggtggcttaaaaggtttcaag

SEQ ID NO: 690972 - DNA, 361 bp, Homo sapiens
  misc_feature (185)..(185): n is a, c, g, or t
tacggatgtgaaaagtggggctaaacacagacacggcagtcacagcaacgccggctgtgggtgtggggagtgggttcgtgccttccagcgtcaggaaccagtggccaggcacattttggccagtgatgcgcacgttacattagtgacggggagacggctcgcgtgagcgtgctcgttgaacctcnacatcccatgtgacaacattctgggaggtggggtacccgcagtgtctgagaagcagcccacatgcctcgcaggagtcccccagaagctcacgagaacggcagcatgtcaaggtcccagaatagggacctctggccctgtactgtccgtagacccggtccacatccgtactggcccg

SEQ ID NO: 690973 - DNA, 195 bp, Homo sapiens
ggacccggtgatatacgccctcaagggcatacccgagcgatacaagagcataactaacgggtactacaacaagtacatcaatgcgaagcaggggagcatcacggggattaccatggtgcaggcatgctacatgctctttacctactcctttacctacaagcatctcaagcacgagcggctccgcaaataccactg

SEQ ID NO: 690974 - DNA, 381 bp, Homo sapiens
ccaccctgagaagctgactgtaatggcattatgtgagatgtggttttctgcaccgcacaggaaacacaatctggataatactgcgacagtgtttataccaggagttcaccatgtgtgtgttccacggaagaggcagaaacatgtagcaccattaggcattagcactgccttgtatataagtaatacaatgttcttgtcatggtaattagcacttttcccctcctgctcattcagaatctgaagctctggattttcaggcccactgcagttatgtgttgaaaaactggtgaaatctttaactgcattttcttgggctacagaactcacagattctttcttatcactcaaatcggagacatttggttgactgctttcacctgg

SEQ ID NO: 690975 - DNA, 950 bp, Homo sapiens
  misc_feature (419)..(419): n is a, c, g, or t
ggacagtgctgacactacaaggctcggatctccggggcactcagacatcgatgagttaggtcacttgcgagcccctcgtgaatttagattctcgtactgtctatgcgtacttttattttctctctgtcaacattgtgtaagcatactgttgctgaccatgagactagactgcttggcgatccttgagatgaacacgattcggtaggcttattcgtcctatactacctagtggcacttgtcagactttccctgagtctactttagtcataactcaacagtaagacataggagtctagcacgtctttcggaacgacgatcttacagtcacccgtttgagagaaccgaaataacatcatgaacgtctacaacaggcgtgataaatagccagaatccaaagctcgactttattaactctctgnatgaaatctatcaacaatccacatatactgcataagtagcggctggctaagcttatgacagctcacaggcaaacatggttgatgaagcagagattacttggaccactcatgcacagcgattcgcatgtcttgaaccacgatgatctccaagctaattccgagtaattttccgccacggacaacagtactactacagtttcgaatatttaatccacaagaagatctgtttgacaccttgaggacacgaggaaggctatgccccaaggcttgcaagccacacagtgcccatggaagccttgtctacatgaccactgggtgcaacagtccatgcatagtcactcggcgaacagatttgtccaatgactagtttggccacactacatggcgatgctaataaccagaaagcgggactttaactttagtatagaacctcctgaacagcttagaccaggcacattcttaagctctaactggtgacacatcgatggggtctggaaactgggcattggacctgtggttccaggaacgatc

SEQ ID NO: 690976 - DNA, 160 bp, Homo sapiens
  misc_feature (17)..(17): n is a, c, g, or t
taatatagtcgtccccnttaatcggcacgagctgacacccagaacatctcgctgaccctggatggccagcaaggcggcacgttgttcagcctgcccacgaccaccaccggctatagcaacattgccgggtacagcaatactggccctggtgcagccacta

SEQ ID NO: 690977 - DNA, 290 bp, Homo sapiens
  misc_feature (196)..(197): n is a, c, g, or t
  misc_feature (272)..(273): n is a, c, g, or t
aggatcgcagtagtaggactgctacacataggtcaagtgtgatgtattctgtatactccaagaactataatagtgaaccatgcagtactgggaacactatcttttatcacaggttgaacctgaagaggtttaactcttgacattagtatctgtaaagagcgtacggctcctttttggctatagtttttcttccacnnaactgacatgcacttggtgtgggagaattctgatggctgtctgacctaagagtgataactactattcaaaatgtnngggtaccttttcagtaa

SEQ ID NO: 690978 - DNA, 240 bp, Homo sapiens
gaaatacttactaaactgccctttatatatatctatcctattagttctgtccctctagagaaccctgactaataaatgcatgcataattaatttttctacactcctgggttgaaatttttgtgaacattcttatcttggtttcattttggtttggttacatgaatctgtaaatgatttggctcctttcccttgcttgtttctaaatatcttctgagagcaaaaataaatattctaaatgg

SEQ ID NO: 690979 - DNA, 152 bp, Homo sapiens
ccgatcacaggagccaagcctttaccactgtgtggactcaatgatggccaagggctaggtcctggtcacccaggaccctcaccacataccccagccaatcgggacagttcaaggaggaggagagccctattacacaggttggaataaaatat

SEQ ID NO: 690980 - DNA, 893 bp, Homo sapiens
actagttctagatcgcgagcgcccgctatcatgcccagctactgaggaggctgaggcaggagaattgcttgaacccaggaggcggaggttgcagtgagccgagatcacaccactgtactccagcctgggcaacagagtgggactccatcttaaaaaaaaaaaaaagtattgtaggctgggcgtggtagtcacgcctgtaatcccacatgttggcagggcggcaggcaggcagatcacctgaggtcaggaggcaagaccagcctggccaacatggcgaaaccccgtctctacaaaaatacacaacagattagccgagtgtggtgtctcgtgcctgtgtgtgtgtgtgtatgtgcatgtgtatactctgtgtacacacgcacacacacggttgtaacatgacttgcagcagacccagtgaacaacctgggggacccaaaccctgtgttccctctgcattccattacaaactggcaggaaatcagaggatgtagcttcaagggaagagctgctggagggtaccaagcgtttacatcccaatgaatgacaaggtatgtgacacgcccaattggacacgtgatgacgaactggcgaaactaacacacaccttgtaaggggcacccatgattcaaaagctggagtgatcaccatccccacgaaaaaatctttaacctggggtttcattcacgtgggcgccacacatgttggtatcaagaacagactgggtgccgtcgaccacagttggttacagcacctgaacattggacaccccaagggcgatacttacgtgaataaatcacaaggagccatgaaaccacattcttgtgtcagacaacgattccacaatgggatacctcaaagaattataaagtaacagatacccgtgcacacaatcg

SEQ ID NO: 690981 - DNA, 338 bp, Homo sapiens
  misc_feature (55)..(55): n is a, c, g, or t
  misc_feature (110)..(110): n is a, c, g, or t
gagtatcagtcagctggttgctgccgctgctacaaccgacccagccacagctganataccctcaacctgggcagtgactactgtgctctacacagtcagcggctgaaggncagtctcgtgccagccattgaaaatgctcaaggcacacatccctgctgaccttccccaagaccatggagaggcagctgagtccttagtttgaggaagacaggataacagcctgttcccgctgctagaggccagtgagatggagaggcttgcagaggtcactgatcaatgggaagaaagaaacagaagcttgctaaaggagagagctgggctttccaagttacctgatt

SEQ ID NO: 690982 - DNA, 926 bp, Homo sapiens
agcggagttgctgtggtacttggcatttaacaactagaattcagaatccagatttttaaaggtgaattattttaaataactgagttgtaatagagaagtaatttatttgaaattattttaggaaatggaagataaagtgactagtccagagaaagcagaagaagcgaaattaaaagcgcagatatcctcatctgggacacaagcccggggggtctccgatttcttaaggagaacggttgcgcgaaaggggccaaatatattgagtctggggatttacaacatgggtaaagcgaaaatgaggaacaagcgactttcctatcatgtgagcgtccgggataagacgggggtgactgggtgaagcacatttcccactctcgcgaagagcttcctctaaacggagagccgtgcctctgtgtgcgtagcaagctgggtgggtgagttaagagggggagactgcgtgtggatctgcgtaaatctcacttatttctccttaatatgttacttatctactttttatttcctttcacttcactagtcctttgagactggcaggtttgcgaaggtagcagtaggggggtgcgtgctattgtggaatataacgtgtgtagagggtttgattagtttaacagtgcactggtgaagaggacctgtgttgagcaacataagtaaactacttgaaaatagttgtatatatttacctaacttctagtgtgagtacctgggtgctaacaagtaacaagcaagtttttacaattttaaggggttggggtttcattactttcatcttaattatagcttgcgaggttactcttatttaatataatctccaatgggagggagagccttccggggatttacccttggggtttgtgaaaccagaagttttagaccccaaggtgaagagagggcgcctatttctaacacaa

SEQ ID NO: 690983 - DNA, 859 bp, Homo sapiens
  misc_feature (131)..(131): n is a, c, g, or t
atattactaccactgacatgacgtttccaaaaatacacataatttgaatcaagcacaatccacccagcagtcgtaagttattatgcgatcatccctctactattgttatgtaaccacaatcaacatcaacnctattgtagcgtgttccccaacgcttttccttccgaatcccctaaaacaaacccctccatccgtaatactataacatactctgtactccataccaccgtcagctacatcgattggcaccagccaagcgaccccatcttaatctcgactgaaacccactaactcacgagagaaacacacctcgtactcgtcttctactactatatcttccctaacaaagtactctccttacacttcatctaacatctcaccgacgcgcatcagatacttaacgtcacataagttattgactatgtccgttaccttcctgacaataccaacggactattcgtctacccaatcctgtatgcgacatacgtccaatcatcactcagactagatgagcaataaccaatgcactgatagccgcccctggaaacagcatcggcacctattaccatctccatactatccctagcaccacccatagacctagagcgatccacgtttacacgcctactgactctgcacgtaaatttgtacagcgtcgaccagaaccactagcgctcacctaaaccatttctaactaactcactcgtctactgtaccaaagaagctattcaagatagtcctgcagccaacccaaccttaacatatgcactagcttgaccacaagtagctttacatacgtacacgctaccttcattacaacggaactccgacttatgaccatcccctcaacagcccactt

SEQ ID NO: 690984 - DNA, 241 bp, Homo sapiens
cctcgaccagataccatcatacgacacccacaagatcgccgtcctgtatgttggagaaggccagagcaacagcgagctcgccatcctgtccaatgagcatggctcctacaggtacacggagttcctgacgggcaatggaccggctcatcgtgtagaaggacggccagtcggacaaggtggccattgagtagcctggtcgcgcttgtgatgacggcccactacatactgcgtagcacgacga

SEQ ID NO: 690985 - DNA, 113 bp, Homo sapiens
  misc_feature (11)..(11): n is a, c, g, or t
atagatccccnggcagaatcacactcaatatcgtgtactttgaacaggtcttctgagaggtcactggctgacttagaattcaaatctttatctttgtctaccttttatttcca

SEQ ID NO: 690986 - DNA, 228 bp, Homo sapiens
caggatctccgcccacacaacatcatgtagcacttataggaataaaagcacaactttccctcatatcatacctcttacagatgaaaccagtacctttatgaatataaagtcaataccacatttgacagctctatgattctgaaacctttatgtactacaattcactgttgattttccaccttcaaattcagaattcttcccccatcttttaggtaattctaataccat

SEQ ID NO: 690987 - DNA, 58 bp, Homo sapiens
  misc_feature (54)..(54): n is a, c, g, or t
caacttagtcaattggttttccttacaacaaaataaagtaaaatgtagcagtcnaaaa

SEQ ID NO: 690988 - DNA, 681 bp, Homo sapiens
  misc_feature (4)..(4): n is a, c, g, or t
  misc_feature (37)..(37): n is a, c, g, or t
  misc_feature (52)..(52): n is a, c, g, or t
  misc_feature (91)..(91): n is a, c, g, or t
  misc_feature (98)..(98): n is a, c, g, or t
  misc_feature (108)..(108): n is a, c, g, or t
  misc_feature (119)..(120): n is a, c, g, or t
  misc_feature (123)..(123): n is a, c, g, or t
  misc_feature (127)..(127): n is a, c, g, or t
  misc_feature (154)..(154): n is a, c, g, or t
  misc_feature (168)..(168): n is a, c, g, or t
  misc_feature (174)..(174): n is a, c, g, or t
  misc_feature (190)..(190): n is a, c, g, or t
  misc_feature (194)..(194): n is a, c, g, or t
  misc_feature (196)..(196): n is a, c, g, or t
  misc_feature (216)..(216): n is a, c, g, or t
  misc_feature (226)..(226): n is a, c, g, or t
  misc_feature (233)..(233): n is a, c, g, or t
  misc_feature (238)..(238): n is a, c, g, or t
  misc_feature (242)..(242): n is a, c, g, or t
  misc_feature (248)..(249): n is a, c, g, or t
  misc_feature (253)..(253): n is a, c, g, or t
  misc_feature (260)..(260): n is a, c, g, or t
  misc_feature (278)..(278): n is a, c, g, or t
  misc_feature (286)..(286): n is a, c, g, or t
  misc_feature (292)..(292): n is a, c, g, or t
  misc_feature (301)..(301): n is a, c, g, or t
  misc_feature (308)..(308): n is a, c, g, or t
  misc_feature (318)..(318): n is a, c, g, or t
  misc_feature (332)..(332): n is a, c, g, or t
  misc_feature (349)..(349): n is a, c, g, or t
  misc_feature (357)..(357): n is a, c, g, or t
  misc_feature (371)..(371): n is a, c, g, or t
  misc_feature (381)..(381): n is a, c, g, or t
  misc_feature (384)..(384): n is a, c, g, or t
  misc_feature (425)..(425): n is a, c, g, or t
  misc_feature (431)..(431): n is a, c, g, or t
  misc_feature (456)..(456): n is a, c, g, or t
  misc_feature (469)..(469): n is a, c, g, or t
  misc_feature (529)..(529): n is a, c, g, or t
  misc_feature (568)..(568): n is a, c, g, or t
  misc_feature (572)..(572): n is a, c, g, or t
  misc_feature (574)..(574): n is a, c, g, or t
  misc_feature (672)..(672): n is a, c, g, or t
tagnccacaaagaaacaattttattagcccaagaagngaagacccagtcccnctgcttgccccagccccaccccaaagccccccaaaaggntaggggnggggaagggngaagcttgggnnggnatgncccctatccctcagaagactggggggnagacgacgggctgngcaaanagggcaccagaggggnatgngngggggggtattagaccaggntaacaggggnagagggnggggncagngggggnnctgnggaaggnccaggaaaaacaaggggngcgggggntaaggnaccaaaggnggggggnagagtggggntagaacccaaaagngggggcctttctgaggnaggggggncccttggctccccntcatcacccnccncttgcccttgagtttcttcctcttggtcttcgtccccaggnccccgntgaacaggctgcttgcaaatggggnagggcttccgggnctgagtgagccaggggtccacgcagcggctgtggtaggcatgagcccaggggagttcccncagcttgtccccatcctcatattcatccaggcaaatggnacananatcatactggtctcccttctgaaagtcatgtgtaggaatctgtttcagttgctctttggtaagtcgattccgctggagccgtttccggtgctggatanaacgagcta

SEQ ID NO: 690989 - DNA, 261 bp, Homo sapiens
gagctgatcctcctgggcgaattctcctccgccgtaatagcggactacgaggcgccacaccacacccggctaatttttttgtgtatttttagtagacatggggtttcaccatgttaatcaggatggtcttgatctcctgaccttgtgatccgcccgacttggctcccaaagtgctgggattacaggtgtgagccaccacgcctggccctgatttagtttttcatagcatttataagacataggaggaggaggaatgcgccc

SEQ ID NO: 690990 - DNA, 412 bp, Homo sapiens
acacgtgtggatcaccttcaacagtgacgtctacccgtcccctcgcaggaccgcttttgcttccgagcttcttcccccgcggagctgaggttcctaaaggtggtggagactggaggagctgctgagatgaaccactgccactctgtcagccacgtgggacgttaaccttaaggatctgagagagcgagccactggtggcagccccttagaggtcggaggaggcactgtgggtcttgcgtggtaacatccttaagctcactatgatggcccgctcccatttatccacacgtggaagggaacctgcagatttggactgtatctctctcatgacgtgttactttctaattccctcatataattctttaggggcctattctcctgaggttcttcatatgtaaaagggggaaaatac

SEQ ID NO: 690991 - DNA, 432 bp, Homo sapiens
  misc_feature (289)..(289): n is a, c, g, or t
  misc_feature (374)..(374): n is a, c, g, or t
  misc_feature (378)..(379): n is a, c, g, or t
aaaggcctggccccctaaggttaaaaagggtgtggcaaaagagccttctcccaaaatggagggtgttggaatataacctccccccccgcaaagggaattttttgcctggtccctttcatagggtaagtcagctgaattccgatagtaataggtccccttccctccggattccgtcagctggaaaaggcctgtgggccaaaggcttttccaaaaggagggtgacattctggcttttgtggccaaggttaccagccctgggccccctccctgcagtagtgccccatttcantgcagtaggacgccctcctgggccgtttggcctgtgggtaatggaggggacggccctcccatgtggtgactccccccattcctgncacnntgtggccccgcctgggtagtccccgcctgaataaagtaatgcccccgcttcca

SEQ ID NO: 690992 - DNA, 526 bp, Homo sapiens
cttggccatgttcgacattttaccatagtgcagatggggctttgtgtgtggttcacctttctttgtttggaagtcttagaataactttttaaaaacttttctctcacgtctattgcattgtgtgtgtgtgtatgtgtgtgtgtaccgtgtgtgtgtgtctgtgtgtgtgtgggggacgtcagactatggattactgtttactgcaagggatcaagacaagggtattcaaggaaaccctctctctcaggttgcacattttgacacttgtactcacatgacatctcttccttttcttttggttgactcctaggtatttagactggtttggtcctatttgttattctatcattacggttggagaaaaggaaagtctcagatgtttttattctaccattttaacttggaagtctgtacaagtactttaaattttaatcaaagtaatacaagcaaatggttacaaattaaatcttgcaaaaatattgtgatacgaagcaactgagctcagctccagtgtggcttcagctaa

SEQ ID NO: 690993 - DNA, 123 bp, Homo sapiens
cttagatgagctcttaccggttagaaagaagacacacgaaagtgggctggagtagttggggtctgtggtgacgaatcgtcattgctgctggtcctgcccaccctcccgcggagttgtgggtca

SEQ ID NO: 690994 - DNA, 661 bp, Homo sapiens
gctgccggatttgatgtgccattgcctggcaggcatggccatgcaactggcggtgctgggtgatgggatgcttggtgacctcatggagctgtacagggtgatggacgatcagccacagacaagcaacgagaacttctggtgagttggctacgtgtgattttggtgcgagtcagaaggcatgtctgtggaaaggtaaggcagctaattaagcagcagcttgaaagtgtctccaatgggatggactgtatccgtatgcagacaggcttcagaaggtatcatgacatggcaagagcttatcagagttctgactcaggtgctcagaacatttctacttctggctaaatagttgaaggagtttcacatgcagaacagtgtctcactgggttgcaagaggacaattatcgttcagcactttcttgcattgtgaatctttagaattctatcacaaagggatgcttccttaacagcagtagtacaccactgaatcctttaagctttcagtgtgaattgtaaaactcaggatgaccttttacaagccttctctcacttatctgtacttgtatagcctggagacaagccacacctggcatgcacacaatgcatgacttggaatgactcagagtgtggcgctctcatcagataacgtcctgagattgagctg

SEQ ID NO: 690995 - DNA, 517 bp, Homo sapiens
ccgagtgctgggattaaaagcgtgcaccaccactgcccagctctgcctctgtaattatatcaaattttattaataagaggggcattttctcatacagctaagtgtagataaaagcagtctctcaatcaataacttatgttaactttcaaaatacttaagctcttttaaaatgtttaaattacattcagtgtgtgtgtgtgtgtgtgtgtgtgtgtgtgtgtaaaagtcagagcataacttgcctgttcagttctctccttctaccgtgtgggttccaaggactgaactccaggcaccaagcttggcagcaaacacctttatcctctaagtgatctcatccacccagaagctctcaggctctttgagccagtagttctacttcatgaatttgtcttacaaaatgctcagctaattgaacaaaaacaattagattacactcagtactgcattacttaagatcatgaaaccctggaacagttctcatgttcatctgatgaatgaacagggagtttaagtg

SEQ ID NO: 690996 - DNA, 940 bp, Homo sapiens
  misc_feature (450)..(450): n is a, c, g, or t
cccccggcctccgtctgcatctctgcgcccgtggcttacttttcccgcgtgcttcccgctttcccaagatggtgtcccggatctttccgtgtgtacggatttttgcccgaagctgaagctcgtgcaacagggtttccttcagaacccttcctgtccagggcgttttcgcccccatggttgcggccctttgactgggggctccccgccctgttgcccggccccccctgggtgccttccccccgggagtccctcgccgacagctctccagtgctctaagaggcctgccggttctccccccctgtccagcagccgcttcgtcatttctgcgggtctcccgaatcgggtccttttccgaccaggccacacattcccgagtgtggggctccatccacccaacgcgcccgcaccaaggatggtggtgtgggcgaaatacgtacatcccccacggcngtgttcaaggagccccggacgttcccggtgatatccgccgcgaccctttaattccttctctcgaacgcccgttccccgcgctgggtgatactcaccccgggccggtgatctcttccctgtgcaagaaccccccgttttcgtggcctcttctgtcaactatcttctctgccccccacttgcatttcttaataatcccttcgccctcccaacccccaatttgtactcactgcgcagctcttttaccacaaacatataactgtctactctgcgtttctcaaaaacacgccttttagtccttggaacactatttccggatgtccctattgacagcctcacgctcttctttcaaaactctgttttgagcgctttgaaatgcttcaaagccaggcagtacaagagaacaccacaccattcggtttgcaccaaacgacattaactccacctactcgggaaaagccccaaaaggccaaattccccccggaacataaca

SEQ ID NO: 690997 - DNA, 111 bp, Homo sapiens
agagggggctgatagtactttgagctctgtaatgtcgggcggagtagcgtatcgatggcagtggagggggcgaatatgatcctaggctataaatattcggagtatatgtag

SEQ ID NO: 690998 - DNA, 205 bp, Homo sapiens
atcaacggtcctcactttagtccacatcatctctacgacttacttgtcatgtgaccatagagaaagttatcttaacttctctgcactatggaggatgatatgttatcgggtagctgtaacaattaaatgagaaaatacctctgacgctcttaaaacagattctggcatttagtacgggccatataagtactaaaccattaatatc

SEQ ID NO: 690999 - DNA, 172 bp, Homo sapiens
tggagatcacaccactgcactccagcctgggtgacagatcgagactccatctcaaaaaaaagaataaataaataaataataataaataatttaaaataaaataaaagcctcttgcttgctgtcctgaggctagaaaaccaagccaagaacccgccagatttcacctgcctat

SEQ ID NO: 691000 - DNA, 349 bp, Homo sapiens
gccctttttagatcccctttggggtccccttaccccaaaccgggaaagggcccaattaaagggggggtggagcccacccacccggcccgggggttttttttaccccccccccgggccccaaaggggcacccattttttttttcagggtttttgggaaattttttgggggcaaacccccttaaaaacttttttttttaccccaggggggtcccccggccttcaaaaaaatttgggcccctttttgggataggggtttaaaggtttttttttttgggaaccccgattgaaggggtttttggggaggaaggtttttaagggttatacccccaaaaaaacccttttgggggga

SEQ ID NO: 691001 - DNA, 167 bp, Homo sapiens
  misc_feature (158)..(158): n is a, c, g, or t
gcttctcctccagagtctcatgagccatgcaaactgaacatcaagtcgtgcgagtttcaggagcatggtacatgaatgacgtttcctcgggccctctttgcccaggcactgggcatgtcgattatagggcagatgataaatgtagtccctgggatgancattctcca

SEQ ID NO: 691002 - DNA, 348 bp, Homo sapiens
  misc_feature (23)..(23): n is a, c, g, or t
  misc_feature (162)..(162): n is a, c, g, or t
  misc_feature (174)..(174): n is a, c, g, or t
  misc_feature (184)..(184): n is a, c, g, or t
  misc_feature (224)..(224): n is a, c, g, or t
  misc_feature (269)..(270): n is a, c, g, or t
tgagccaccgtgcctggcctgcnaactttattaacagaattctggctaaagcctccagtataaatgggcaaaggagatggcttaatttattttatgctgctataacagaatatctgagactcggttatttatgaagaaaataaacgtattttttatagggcnggctggagaagncaagaccatnagggtttgtatttggtaggggaccttcattttgcgtgtgncctcttctatagcaataagatgttcagagcgtttcccacttcctnnttatttatcaccctctccgataatgttagatttcttttacatgagtaagactccttcctgaccttatataccttaatg

SEQ ID NO: 691003 - DNA, 129 bp, Homo sapiens
gggttaatgtgatacttaaacaccttcatcatggaactctcagagtggggctccgttttggtattcctggtgatgggttttgaaagataagggaaagcacattttagagcatgtctagggtaccatggt

SEQ ID NO: 691004 - DNA, 934 bp, Homo sapiens
  misc_feature (97)..(97): n is a, c, g, or t
  misc_feature (220)..(220): n is a, c, g, or t
  misc_feature (308)..(308): n is a, c, g, or t
  misc_feature (634)..(634): n is a, c, g, or t
  misc_feature (636)..(636): n is a, c, g, or t
  misc_feature (638)..(638): n is a, c, g, or t
  misc_feature (640)..(641): n is a, c, g, or t
  misc_feature (644)..(646): n is a, c, g, or t
  misc_feature (683)..(683): n is a, c, g, or t
  misc_feature (685)..(686): n is a, c, g, or t
  misc_feature (697)..(697): n is a, c, g, or t
  misc_feature (705)..(705): n is a, c, g, or t
  misc_feature (707)..(707): n is a, c, g, or t
  misc_feature (720)..(720): n is a, c, g, or t
  misc_feature (917)..(917): n is a, c, g, or t
aatattaatgaatagtttaagaattgtgggggattaagatagagagaaaaagaaaatatttaaatttttgtttagaaaagtataatttaagaattgntgaagaaaaaaagttaataaatatggagaataaaaaattaaaagaataagaacattttcaaataaaaaattatgaaaaaattataattttgattatttagttgaataaaattgagtttttttnttatttgtgttgaatttgatgaaggtataagggtgttatttttgtgagtgtgtgagttgttgaagtgatgagtgagagtgtgtgaggngtggatgggagggaggagagagtttgagtgtgatggatttggagatttagttgagagtggatgagttatgaaaagaggaaggatagagaggggtatgatttatagtaatttgggggataaagagattttgttatgattgatgaaaattggaattaattgtaaaaaaataatatgaaggtgggttagattaagtgaagaaggataagtagaggttttatattgaaaggtaataggtgaatgaagggtaaattatggggagagtatggagtatagaggacatttaggatgactgggttactgcggaggccaccatatcggtcccgtanancncnntgnnngggtcctgtttcatttctcgtgacactgggtagaatnannatcctgttttnaatgggtngntttaccccgggantgacggggaggctctgaccgtttagccaccaaatgtaggtgtagttctcactcttaggttcacaggtgaaggctaagacatccttattctccctggggtttaagttgttgatggtgatgtaggggataggcagcttcgggaaaaaattcagggtgactgggtcactgcgactggcaaaaactgggttccgtatttcncattcatagggtcctgc

SEQ ID NO: 691005 - DNA, 329 bp, Homo sapiens
ttctttgtggtaaggatttaactctgtgtttaccactattgtcagtcacagctgcaaactttcaagtgaggaataaagtgcctcaagtggtaccttgctcaaggagccaatagaatcacaggtgccactgggaacttggcgcaactcatctgatctatcgggggggttctttagatttttttaaacatataattggaacacacctagtattttaaagaatatgctcttgaaaagatgaaaagagtttctcccgggaggcggaggctgcagtgagcgcgcgatcgcatcactgcactccagactgggtgacagaaagagactctgtctca

SEQ ID NO: 691006 - DNA, 115 bp, Homo sapiens
cgactgccagtggagatgggcgtctgtaccgctaccctcatttcacctgcgctgtgtactctgagatcatccgtgcgctgtgttcaatgactgtcgtgactgcattcctcgcatg

SEQ ID NO: 691007 - DNA, 183 bp, Homo sapiens
cacggctggcatgctagctgggtctcgtctatagcacaaggacattgtgcctgaatctactaaaataaaacaaaccaaaaaagagaaaagtagcaattgagggaaaaaaaaacagacactgatccttactctggtccgcattggtgacttacccggtataatccgggatcccttgaaagtcac

SEQ ID NO: 691008 - DNA, 103 bp, Homo sapiens
gcggccgcctactactactactgctcgaattcaagcttctaacgatgtacggggacatgcctcaggatactcctaatatagccatcgttgtatttcaactaca

SEQ ID NO: 691009 - DNA, 200 bp, Homo sapiens
tagggcgaaaatgtgcctcctcaagcacaaaagttaccaagctacatacttttcagttgcgataacaagatacagtgctacaggtagtttcagtattccatgtgttgttatatcctctgtagaataaaccagaccaagctaagctgtgtcagccaactacatcctgaccaaggcctctgagacagcagacacaagcaccc

SEQ ID NO: 691010 - DNA, 196 bp, Homo sapiens
  misc_feature (32)..(32): n is a, c, g, or t
tgatgctgaggtactctagaccgatcccatgnctctggaaaaggggagtagttggtaatgggtaaaagagttggagctccagctgggcacggtggctcatgcctgtaatcccagcactttgggaggccgaggtgggtggatcatgaggtcaggagtttgagaccagcctggccaacatggtgaaacgccgtctcta

SEQ ID NO: 691011 - DNA, 313 bp, Homo sapiens
cgcccggttcatcgaaagcctaactggaatggcatgcaatgaactggaatggaatggaatggaatgacttcggaatagaatggaactggacacgacaatggaatggaactggaactggaatggaatggaatggaactggaatggaatggaatggaactcgttccgagtggaataggagggtttgatgacagggtttgatggtcatcaaccctgtcatcaaaccctgtcatcaaacccttcatcaaaccctgtcatcaaaccctcttgaactctctcttcaaagttcttttcaactttcccttagggtttcgat

SEQ ID NO: 691012 - DNA, 697 bp, Homo sapiens
ctgggtcttgtctcccctggctttgtgaagtgcggaaaaccagaggcgcagtcatgtcgggattcgacgatcctggcattttctacagcgtacagcttcgggggcgacgcccaggccgacgaggggcaggcccgcaaaatcgcatgctgcagaggcgcttcaaggagttcctgcgcgccagctaccgcactgcgcgcaccagaacgcacgggcttcacccttcaaattacagaggatgaacatcaagcggcattacaacctggcgggagctactggacttgagcgtggcacgcactggaggactctggccagactatcgcatgagcgaccctggccgactactagctaccaaagcagccagcccgagcacctgcagctgcctggcagcgaagctgcccaggcacgctagcctgcactgaggctgcacccggcccccggccctccctgccggcacggcaggtgcctccaagaaccatccagagtcattgctcaagatcggaacgcccagcacctatccaagcactcccgacagccatagaaacaccaaaacaatgaatgtcacaaccaagaaaagacagaatcccatggcaatcaatcaatcgcgggccattcttgcgagtaccgtagccaagggatcaaccgccattctcatattccagtgaccgccaccatgcccgcaaacacaccaacacccaac

SEQ ID NO: 691013 - DNA, 740 bp, Homo sapiens
cctgtaaaaagtactcaagggctttattacagacataccctccctttgaaaagggacatgctaaaagactcattactactcagccttcaatgtacctgtgtgtccatcttatatttctttcttttttcttacaatggtgaattagacttgtttttcccactgggagcactttgtaggcattgcttgacccatgggatgatgattctgcggaggtattgccttggtgaattggctgctatttaagtttggtcttgctgtaaacttgtagcattaaacaatcatggtcgtaataggtctccttttggaaacaattcatgtgcaactgtatagctgcttttggatgaaacagcacgctattttgcctttttatattcccttggactttggacgctcgtgcttgggaaacattgccccctttcccctccttgggaatgctgttataaagtgtacgatataaataactaccggactgggaaaccaggctaccggataaatggcttacccggaactctttttaagatgttttccccttaagttaaatcaccggaattgtatatattaaggccgtgttctaaacttgtctgggcccgggcttgtctctctcacaatctgggtgttttataaacccgatctccagaaaaggtacgatcgcctttggacgcccgaatgactttgaacttcacggtttacaaaaataattttctgggattgccctgactaatatagggcacagatttgaa

SEQ ID NO: 691014 - DNA, 123 bp, Homo sapiens
atccgtgagttggcccgcctgttttacggaagatgaaatcccgcgtttgtcggcggaattggcgtattactttcttctgtcgctctttccgtttttgttgtttttactgacgctgttggcgta

SEQ ID NO: 691015 - DNA, 251 bp, Homo sapiens
acctggatgccactgaagcacggtacatagaccctgtgatcatccgtgtagacatggaagatattagaaaccaaagatgtctcagaaacctgggcattaaagcgctaaacctgtagaagaagcctggactttagggtaccatacatgacggtgcatgcaccactcagcagtgtggcagcacggagcgccataggtggtgcaagacctacctcggctcgcagcagtcccgtccacacacaggtatgagcagg

SEQ ID NO: 691016 - DNA, 146 bp, Homo sapiens
aaacacaattagctaggcccggtggggtgtgcttgtagtcccagttagttgggaggctgaggcaggaggattacttcagcccattaggtcaaggttgcagtgaggtgtgattgtgctactggatgccagcttgggcaatggatcca

SEQ ID NO: 691017 - DNA, 195 bp, Homo sapiens
atcgggcaacctccgcgctggaatcctcaacaggttcaggagccggatctggggcgtgatcgaggacgccgccggtgggatcgtcggcataccccaccctgacgacgtcgttccaaggtcgtcggatgtcatccaggacaccccacgcgaaccatatctcgcaggccagacgtagcactatcgacgcccagtaca

SEQ ID NO: 691018 - DNA, 229 bp, Homo sapiens
ttttttttcccctcccaaatttttgtactgaaattatttttcatgaaagtttttctaatatttctaatgaaagtttttttaatttgggggcataatttactaagaatcagtttgcttttttttggaataaatagtaaccgtaagtccgccgggttttccaaacaaaagactaggttttttgaggtaagcttggttttagaaaaaaacaattaaagtttggatttccgga

SEQ ID NO: 691019 - DNA, 132 bp, Homo sapiens
cgattctcagacgggtgcgcgaattcacacactggtgtgctaattactcaagccacccccgatcggtctgcgtcaaccaatttcatagacgagatgagttgcattcagccaacctagatcgatcaatagtct

SEQ ID NO: 691020 - DNA, 237 bp, Homo sapiens
ctcgggagcgtgactaactggggctggactacagcaagtgcattagatccagaaaaacatcaagtttcttgcacatgaagctcagagaaacatcagcgaaatgatgccaatttttaaaaacgaaaagctaacaagtacctcgtgttcatacaggtcgaagaatgaataactctcagtgacgactaacattgggtacagaacaagttcgtggctaaaacaccactagctctcccgagt

SEQ ID NO: 691021 - DNA, 338 bp, Homo sapiens
ccacctcagcctccagagtagctggggctacaggtgcacaccatcacgccaggctactttagaaaaaattttttttttagagacagggcctcactgtgttgctgaggctggtctccaactcctgggcttaagcagtcctcccgcctcggcttcccaaagtgctgggattacagggatgagcccactgccaggctgcccctgcttctcttaacacacttgggaagctcctgctgtagcaaaatcctcaataactaggtgttgatcagatgaactgatacgaataaaacctatgtgggggtgggagagattttaaattactcagatttttaaggaggatt

SEQ ID NO: 691022 - DNA, 977 bp, Homo sapiens
  misc_feature (602)..(602): n is a, c, g, or t
gacccacgcgtccggcatttacgcatctcacttctagggaatactagtatatcgctcacacctcatatcctccctactatgcctagaaggaataatactatcgtctgttcataatagctactcttcataaccctcaacacccacatccctcgtgtagcacaatattgtagccgtattgccactacataggtcatttgcacgcctgcggaagccagcgagtggagcctagacccatactgagatctcgaatcatccaatcacatactggccatagactacgtagcataaccttaaacgctagctccaaatggcgtacaacatagaatcgtaccacaaccaagtatagtattgactagcgcatctgacgatgaactttcctaaatacaagagcacagtatatttgaaagtccaacacagagcctaccgcacaggcccttatattattgagcgatcaatcgcgctcgttacgttattgtgtttaacatccaaaatcgaacgaaccaatcctgactttagcatgtgtcgcccgacatcgtttatccgtcctgagcctcctcagaagaatcgcccgcgtccataagttactaaatcggaccatgaantccattacccactctaacaatgctattggctataagccacatcgccacatatataccagtgaacacactgatgcagcggacaaacaaactacttaacatcttctatgagtgaatactacccttacaaaatctcccttgagattataagcattacacagggcacaggaactaagtcatcattttatatcgttcgttcgaagagccacgacttatccccaaccttgggctatcgagtcaccccggatgaggcaaggcagccagaagcgcctgaaacgcaggcaccattacttgcctaattctacagcctaagtaggctcccttcccctactcatcgcacgtaatttacagctcaacaaaaccctaggctcacttaaa

SEQ ID NO: 691023 - DNA, 167 bp, Homo sapiens
ttagaattgccacagtgctcatgatttctgatagactcactcagtactgactgagcatcacctgtgctgcagcgagactgtacagatattcccacggagccctcatggatctgtgtttcagagacactctgtggaccagcaacattctcagcattcaaatgatgacc

SEQ ID NO: 691024 - DNA, 300 bp, Homo sapiens
  misc_feature (59)..(59): n is a, c, g, or t
aatttaagcctgtggcatggaacctaaagactagaggcggttgtgtgagtcaggaagangggccagatatctgagtgttcctctttagtttcttcaattgcaggaaagacagtggttcctgactcaggaagacagtctcagaaacatgtggaatgatattgagctgctaacaaatgatgataccggaagtgggtacctgagtgtcggttcaagaaaagaacatggaactgccttatatcaagtagatttgctagtgaagatctcttctgaaaaggcctcattaaatccaaagatacaggc

SEQ ID NO: 691025 - DNA, 120 bp, Homo sapiens
atgtacttgtcaagaaaaccgagcactccatgtttgatgaaaatggtctgcccacacattgacatggagtgcaaagagctcagcaaagggcagccaagaagctgaagaagctcttcgagg

SEQ ID NO: 691026 - DNA, 310 bp, Homo sapiens
aaaaaaaaaaccccccccttttttggtgataaagaaaagggggggggtgcccccctccggggtcccccccctcccaaaaggtatatcccaaaagggttttccccccccccccccctgggccccccttttaaaaaaaaaccgggggttgttttatggcccccccccggaacccagggaaatttgggccaaaaattttttttttgaaaaggtttgggatttgggggccttttccccgggggggggtttttgggtaaacccccccccttgggggggggggtttttgttttttcccaaaaaatttggtttttta

SEQ ID NO: 691027 - DNA, 155 bp, Homo sapiens
gatacgactttttggcagtccacatttttatttccccggcaggtgataaagagccaggatcactttccatgacagagccagatgctatctggccagacgcgtatgaaacaggtgcggtaaaggatgcagctcttagtcccttctgtcgtcttctc

SEQ ID NO: 691028 - DNA, 835 bp, Homo sapiens
ctgattcgccctcgatttaagagggccgcgtagcgagtaccagccgtccgctacctctaggcataggtgtcgattactgctatgcaatccttagccggatgctagtgataaataactccagctaaaagtgtaatggtgtcttatctccaccctcatttcctactttgcttaccctcatcctcagacagatgcctcttgctttaaaagttggatttaacagacgtgtgtagggttctatggtctgtgtgaaggcagagaccagagagaaggaagtgagcccactgctctcctgggagcaatgtgggtgagtaccaccagaggccctgcatgtgtgtggacaaataaattatatagatacttacccacagaacctcgaggcagagatgtgtggatgtatgcgatgatggatatttatatatgtacaccatggactcactgaatgtattgaaactggaggaagtatactaacagatggacaggggttctatataacaaaggatctactagacatgaaagtatataagacataactcccagtcccttagagacaatatacattgtgatacaatgaacaagcataaatacaagtgtctgtgaaatattaagaaaagataagtaacctacgagaggaacattcactggagacaggcaaataagacgtgtatacaaaaagacacaaaagaagacaaggcaaaaggaacacataacgcaaagaacagatcacgaccaacgggagcaccgacagcaagtcaaggagaatgaaaagggcaaacagacaacaccagaaaacaggaccgaagaagaagaaacaacaaagggaagggagaaagaacgg

SEQ ID NO: 691029 - DNA, 346 bp, Homo sapiens
ggaattcggctctctgggcataaactgttctttgagcaggaagacattctgagctttggtttctaagagcctgctcttacagtggtcccaaatcatgccccccttgcccaggtaggtgacatttctcatagcaccattgtctgttatgttactgagtacctcatgccccaccagttcagggacttcctggatcccataaacctctgcctgctgcacagccttagaagttacggaggaattctttagtactttggatagtaatctagaattcctccgtaacttctaaggctgggctgatatcatccacttccaaagcttccatgtcacaggctccaggaggccttag

SEQ ID NO: 691030 - DNA, 381 bp, Homo sapiens
ttcatattcgtgtgtaagaacatagttagactcactagtaaaggaagctgaatgcacttctctaaaaagctgcactttccgtgagcactttacgtggtacaatccacatgacccacattctcccctggagaacgttggtacaaaatttagcaccacttgggaagagtatattatcacagtaacttgacagcagctctggaactaattatttctgccccgagtaatgccacactgagactttgagtaacctcctggaggactcaaccctgttcaactcagaaacgagcctcctctcactaatgcaatgctttaatgctatctctgactgtactgaaactcttcgtattcttgtcaactctaaagagactgaagaaaagattt

SEQ ID NO: 691031 - DNA, 429 bp, Homo sapiens
  misc_feature (25)..(25): n is a, c, g, or t
  misc_feature (40)..(40): n is a, c, g, or t
  misc_feature (282)..(282): n is a, c, g, or t
  misc_feature (425)..(427): n is a, c, g, or t
actggtaaactgattgacatatgtngatcacaataacctngattaatattataaaatcctaagacataatcagagacacacgcttccccaattacctaaaactatttctgttatattaaaatactaaataatggcccaggcgcagcggctcacaccctgtaatcccagcactttaggaggccaaggcaggtggatcacctgaggtcaggagctctgagaccagccttaccaacacagtaaatctccatctctattaaaaatacaaaattagctgggtatggntgcatgcgcctaaaacgcgagctactcagaggctgaggcacgaaaatcacttgaacccaggaggcagaggttgcagtgagccaagatcgcgccactgcactccagcctgggcgacagagtgagagtccatctcaaaaaaacgnnnta

SEQ ID NO: 691032 - DNA, 156 bp, Homo sapiens
tcagtaagcggagcatcagtagcggagcgtcagtaagcggacgcatagtagcggagcggtcacgcctgctgggggtatgttgtgttgaccgctccgcttactgatgctccgcttactgaaacacaacatagcgctccgttactgatgctccgctta

SEQ ID NO: 691033 - DNA, 514 bp, Homo sapiens
agtaagaaaccaatgcccacactggccaggaattagtgttgggcccttcatggccttaatccatttttccaaaggttttaaaattagggaggtttaaaatctaaaaattttgcctttcctgctatcaaaaaccggatttttttccccaatccaaaaaaaaaaaaaatggtcagagcctggaccccgggtttttttttaaaaaaaaaaatttttaaccaggggttccctatttaaaaaacaggggtttagtccttaaaccccctcctttagaaaaattggaccataaaggttgccttccaaagccggtttccaaataaaatttcctttccatttaaaacggttcccggcccttggtaaaaatttcccttttcaaggaaggttaaataaccgcctttatcttttttcccaggttttttaaaaccaaaggtatttttttaaattcagcgagaaataggataaaaaaaagcttttggaaaaaagttttaaaaaaaatttaaaaaaccttttttggcca

SEQ ID NO: 691034 - DNA, 395 bp, Homo sapiens
accagtcagaggtcttgagtcggtccgcatgacaagttcaccgctcgcataaccagcattcaagaaagccagcacactaagcctatctacagccagggagtctcagagtctacgtcactcccctgccacctcaatcagagctggtgctggtatccactgctgggagacttgtgctgaggtgaagcctgggctggatggctggaggatgaagaactgcacggaggagatggaggcacccagacagatgccccatggacatcctgaagcagagctgcctcactgccctgcacacacatgagagcgcagccaggaacagaaggactgggcaacattcatgcggagcccaggccaattttctaaacatggaatatgagttaaataaatggcttcgtatt

SEQ ID NO: 691035 - DNA, 152 bp, Homo sapiens
tacagttagctgtatgtatctatgatatttatttttaagagacacggtcttgctctgtcactcaggctaaacgtgcagtgctcatgactcatatgctcactgacagcctatgaactccgtagtctcaagacgatcctcccacctatggctta

SEQ ID NO: 691036 - DNA, 320 bp, Homo sapiens
agtttcgacggttactctccttatggtagtgtctcctacatgccaaaatcagagagtaagtcagaataaaacctcccaaggttgaaaactagagctggcacgtattacatggtctgtagatgtttatccgtggctggatgagtgaaggaatgagtgagtgagtgaatccaggatcgatctggaaacacaccagggctcagacctcttgggctaagtgccagtctcagtcctcttgggctgtgtaacaccaaagagaacaccccaggctctggcttaccccaagggcacacccatgctcacaaacacacacacacgcacgc

SEQ ID NO: 691037 - DNA, 251 bp, Homo sapiens
aatatggccagatcttctgatattcaaggagaagctgaaaaattgggacttcaaaaaatatgaaacctttcaatttttaagagtggctggcaattaaaatttaaaaagaacagctctgtgtgccagatccagcccatcagttggagaccttggctctaaggtgatggtttccaaatcctctaagtcggtgtaacccatctggggctgattctccttctaattggctagtgcaccaaggaaggagaggttac

SEQ ID NO: 691038 - DNA, 207 bp, Homo sapiens
atcctgatgcatgctggtggatgcatgctgatgctggtggagcagctggagctggagctggtggtggccgagctggtggagctggcactggtcgtgaccatggtggagcagctggagcagaatcctggagcagctggtggagctgcagctgtgctggtggtgatgatggtgatggtgatgatggtggcagtgctggtggtgatggca

SEQ ID NO: 691039 - DNA, 387 bp, Homo sapiens
  misc_feature (16)..(16): n is a, c, g, or t
gaggagcccccgaggngcgcttagacctttaccgttacgtttttggtcagaaaggaagtgggatccgcaagaggagggtttagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattacca

SEQ ID NO: 691040 - DNA, 160 bp, Homo sapiens
tactacgcaatacgtaacccggttgatcaatccccacaacagttacattttctttacaaatctctgccctcccattagatatgaacaaactccggtttctcatgacacgtttgtatcggtaagctgcttacaggaacacattggccatggaaggactaaa

SEQ ID NO: 691041 - DNA, 215 bp, Homo sapiens
tgcgggtctcttcgacgagcatcagccggggaaaggagggccctgggcagccttccatcggtatgactgactgtcaggtagcttgtcaggacttcggcatgaggcgaggcgacgggtggatggaagtcaaggtggaggactacagaggagacgctcgagactactctatcgatgtgtcgactctgtttcgtccataggtcggacaacctgtgcga

SEQ ID NO: 691042 - DNA, 676 bp, Homo sapiens
  misc_feature (526)..(526): n is a, c, g, or t
gttagtaagtctgctaaggtcctatatcaataggtcacttagtgaaactagcgtaagatctaaagttacagtagtacacctgagttgaagaagttactagatctgctgacagctagctaagcatagcgacatcagagtcagtgaacccagtgtgtagggaaatagactgtgtacaactgtacatcttctattctggacgctatataactcaaattagagcagagaactacttgtagtcactgtggttacagaaggtttcatggacagcgaccataaagctctactagctaacaaataggtcttaatgataaaaacgtgggccttcagagaactaaaggtaccaatgtgtggcagtccaaaattacgaggaacaatgagttcccttcatgggtcacagtcagcaatttattgtttttcccctttggagacagagtcttgctctgttgcccaggttggagtgcagtggcatgatccaggctcactgcaacctccgcctcccgggttcaagcaattctcatgcctcagngctcccgagtagctgggattacaggtgcctgtcatcaggttggctactttgggatttaagtagagacagtgttcaccatgttggccaggcttggtctcaactcctgacctcaagtgatctgctggttcaggcctcccgaagtgctgagac

SEQ ID NO: 691043 - DNA, 102 bp, Homo sapiens
cctgaggatacccggaaatacacatgcgggtacagtgacactgcgaaaggctcattaaatcagttatccaagtaggagaggagcgagcgaccaaaggaacca

SEQ ID NO: 691044 - DNA, 486 bp, Homo sapiens
ctatattctcctctacccctcatatattctttttttgatttttagtaacagccatcctaacaggtgtgaaggggcatcgcatcatggttttgatttgaatttccctaataattggtgaaactgaacatctttttatgtgcttattggccatttgtgtatctttttggaaaaatgtatattcaagttatttgctaattttttaagtcatttgtttttcttattttgttgtaagacttggttacataatctggaaattagctccttgtcagatatataatttgcaaatattttctcttattctatggatggtctttttattttattcataatgtcctttgatacacaagatttttaattttggtatagctaaatttatctatttttttgttaccctggctttgctggcatatttaaatggttttaagcttttaccttgggcttttgatttatttttaacttttaaggcgttccttgtggattcacctt

SEQ ID NO: 691045 - DNA, 130 bp, Homo sapiens
gagtgtacaggttagatgatgtgtgtgaggagtaaaatcagtgtgtgtatgaggtctgtgtgtggtgtagctgagatctgtatgtgtaaagccagtgtgcttcggttggaggccaggatgctatcggttg

SEQ ID NO: 691046 - DNA, 327 bp, Homo sapiens
ccgagatcttttatcccggaaccacctgctactagtgtctatgtgtgataggcccccctcggtctttgttctacagacgcaataatagtctgtgtctcccacgggctgacccgggccgggttgaagctgaggcacttgtcagtagcacatagggcacctgctaggcttctagcctactagcaggcggggctagaggtcattaaaaagcgaggaaaaacactagctgaaaaaaccctttcctaaaaagtagccctagaagagagtagagcaggctagactagtaagcctctactaggggcaacaaggcaactatagggggtagtaggc

SEQ ID NO: 691047 - DNA, 653 bp, Homo sapiens
agcggggctgccatcttgcgtccccgcgtgtgtgcgcctaatctcaggtggtccagccgagaccccttgagcaccagccctagtcccccgcgcggcccttatttcgctccgacaaggatgaagagaatcaatcatgaagccaggaaaaactcgccaatgactgcatgcacaatgtgcgcattggttgggaataggaactgctcgcagaaagaagaaggtggttcatatgaacagctcatcacgtcagatgacataagaataccttctgattctccgtttaaatgaagttaaggggtaaacaactatcttctgatattagaaggaggtgaactatgtttgacaataccacatggaacatgtgtatccacatttaatcggagcctcttaagagttcagtgcatcttctgtgcagacgagacactttcaccattacagctccatgctgtagacaaagcagcttgacagaaagagtgctatcccatgcaatcttaacatcctaggcttggatagccgcgataggtctagactagatttaatggatgcactggtccgaacgctactgtccaaatcaactctagtaggatggacacacatgcacctactttgctactgtgagcggatgactgatgatcgaacgttccatgatcgttgtg

SEQ ID NO: 691048 - DNA, 176 bp, Homo sapiens
  misc_feature (54)..(54): n is a, c, g, or t
ttcatgataaattcgagcttgtacctgaacattcgtgtcaccagtcaaagcganactatactcaattgatccaataacttgaccaacggaacaagttaccctagggacacggacacgattggacacgaatgggacacgaatgttcaggacacgtatgttcaggacacgaatgttca

SEQ ID NO: 691049 - DNA, 304 bp, Homo sapiens
  misc_feature (116)..(116): n is a, c, g, or t
cccccccctttttaggggcccggttaggccccagggggggagggggttttttggccctccccccagggttttatatcccgggcccttggggttttgggtgggtttatcccttttanccgggccaggatttttttggcctttgggggcccccccggggggggggggggaaggggggggtgttggttccttaaacctttttggggccccggtttccgggttcggggcccgggtttttttttcccccccccttgggttttttttgcccctggttaaggggccccttttttttttcccccttttttta

SEQ ID NO: 691050 - DNA, 101 bp, Homo sapiens
acctgagtcaggagcggattcggcctctcaaagtgctggggttacaggcgtgagccacggcgccaggctgtgtctaggtttcttactcaacatcatgtttg

SEQ ID NO: 691051 - DNA, 386 bp, Homo sapiens
  misc_feature (55)..(55): n is a, c, g, or t
tgtgacctctggtctagttggacacgttgcctactcatagaagcttcccggtggncactggcattcctgggagctaggtgagggagtcgggagttttgcatgacatctactcactggcagcttctcctgcagagttaagcacttttccctgatagaggacaggatcatgccacatgtcctctgccatctctgttccagctcctgttgatgtagaaggctacattggccaggttcctggcatgaagcaggcacagtccttgtctcctcagatgctcactgtttagcagaggaggcagggaaacaggcagcccacagcacaaaggggagcttgctagcagtttaaaaggggctctgggggaggcagcagaggactgtgggaaagggca

SEQ ID NO: 691052 - DNA, 144 bp, Homo sapiens
aagccttccgtgtcttgactgtactcgtggtgcggcgctcctgttccggaagctctgctccgtagcactgctgcgcgtgtctgtcctgcctcgcgatcagaggctaggttgtggtgacgaagcgctccaatattgtcgcgcctc

SEQ ID NO: 691053 - DNA, 260 bp, Homo sapiens
cggaacacaaagagcgtatgagtgggggaggggtgacatgcgagagaaacctcccggcggcagcctcagcctagacttcggccgctccagctcaaggccttttcttcccaggtgccggcagacggggcaggaagtaagagtgtgacaactctaccaggaaaagaggtactttacctgcgggacagtccactcagaccaaggctggaaacggttgtataacccccccgcgtctactggtgtttcggctccgcttttgtgtt

SEQ ID NO: 691054 - DNA, 490 bp, Homo sapiens
  misc_feature (101)..(101): n is a, c, g, or t
  misc_feature (105)..(106): n is a, c, g, or t
  misc_feature (144)..(144): n is a, c, g, or t
  misc_feature (159)..(159): n is a, c, g, or t
  misc_feature (176)..(176): n is a, c, g, or t
  misc_feature (198)..(198): n is a, c, g, or t
  misc_feature (201)..(201): n is a, c, g, or t
  misc_feature (206)..(206): n is a, c, g, or t
  misc_feature (212)..(212): n is a, c, g, or t
  misc_feature (216)..(216): n is a, c, g, or t
  misc_feature (219)..(219): n is a, c, g, or t
  misc_feature (222)..(222): n is a, c, g, or t
  misc_feature (228)..(228): n is a, c, g, or t
  misc_feature (237)..(237): n is a, c, g, or t
  misc_feature (241)..(241): n is a, c, g, or t
  misc_feature (251)..(251): n is a, c, g, or t
  misc_feature (265)..(265): n is a, c, g, or t
  misc_feature (290)..(290): n is a, c, g, or t
  misc_feature (308)..(308): n is a, c, g, or t
  misc_feature (314)..(314): n is a, c, g, or t
  misc_feature (322)..(324): n is a, c, g, or t
  misc_feature (327)..(327): n is a, c, g, or t
  misc_feature (343)..(343): n is a, c, g, or t
  misc_feature (359)..(360): n is a, c, g, or t
  misc_feature (366)..(366): n is a, c, g, or t
  misc_feature (372)..(372): n is a, c, g, or t
  misc_feature (379)..(379): n is a, c, g, or t
  misc_feature (382)..(382): n is a, c, g, or t
  misc_feature (385)..(385): n is a, c, g, or t
  misc_feature (387)..(387): n is a, c, g, or t
  misc_feature (390)..(390): n is a, c, g, or t
  misc_feature (409)..(410): n is a, c, g, or t
  misc_feature (421)..(422): n is a, c, g, or t
  misc_feature (424)..(424): n is a, c, g, or t
  misc_feature (434)..(434): n is a, c, g, or t
  misc_feature (455)..(455): n is a, c, g, or t
  misc_feature (457)..(457): n is a, c, g, or t
  misc_feature (460)..(460): n is a, c, g, or t
  misc_feature (476)..(476): n is a, c, g, or t
aaatgtctgttttgaggaaagggctttgaattccccagatactgagcaatttgtgtttgtgactgatggagaatttcaggaatgaatgagaaagcctttgngaanntatgcaacagtttacatcagtcatgtgaagtatttgtntaaaacagagcaaantgaagaccaaattattntcctgttgaggtccgtggatgncanatttnaagggnaganccncanaggctngcaaaaatngganaggctccatntttaatgcatgtanaagctccttacgggtgcccatcaanagcatagcttggaagccnccatgntgtggggnnntgngtcagggcaaatgtcncagcaggatttccccnncccagntccatnatcacanacncananagntgcaggggaggcctgcccnntgttttgttgnntntgccctcctntggcagcatagatccttaggngntcnataaaggtgtgctgtnttgaaaaaaaaaaa

SEQ ID NO: 691055 - DNA, 300 bp, Homo sapiens
aacaaaaactccaccaggggtgtcaaactttgggaaaaacccactcggcttttacagggagaccccccggcgagggggccccaagattgggggaggatgggccccagccaacccagggtttagggttgggctccggccgggttaaaggggacgtgccccgtcccagtttggacttctggggctggatttatgtgtttcccaaactcggaagggttttgctcctcctcctccccctgaacaaaggtggcagttgttacaaataaatttattggagggttatgggtccggtttcccccccca

SEQ ID NO: 691056 - DNA, 219 bp, Homo sapiens
cctcacgaggcctggtgttgtggtactgccaggtaacgttgttatttcagttgagcctggtgtgatgcatgatgttgtagattctccacgacgctgtggttgtgtagtgtgcggatatagggtgttgcgcccctttgcttttgggctgctgtggactattgttgattcctcactgtggcccgaagttgtggagctggcagggaagtgtgttgtaggggg

SEQ ID NO: 691057 - DNA, 286 bp, Homo sapiens
gagctgagagaggagccaggaggccagaagcgcatgaatttcttctcaactcctgccctggaaattatgtcaccactactcacgagggagacaaaagaaacttgtgttcggagcccagaatcccagtgaggttgccaaacaactgcagaaacaagaagagaatgacaaggtattgctctgagagaacatgggagagaaaagaggctttagtggtgctttccttcccacagacttcagctcataaatcaaaatgccaaagcttataaacgtttaaccctcaccagtc

SEQ ID NO: 691058 - DNA, 221 bp, Homo sapiens
tgatgaatcctgaggacatcagaaaacacctgttggtccacgcacctgaagacaagaaagaaattctggccagttttatctccgtgcctcttcaatttctacgaggacttgtacttcaccctacctcgatgatcaatcccacttggtaacatgggtgtgcttgtgtgggatgggggcaagggtcccagtgcctaacaagcgcctgggggtacctgaagctc

SEQ ID NO: 691059 - DNA, 338 bp, Homo sapiens
  misc_feature (135)..(135): n is a, c, g, or t
  misc_feature (242)..(242): n is a, c, g, or t
  misc_feature (282)..(282): n is a, c, g, or t
  misc_feature (333)..(333): n is a, c, g, or t
tctttagacggagctctcctctgtcgcccaggccggagtgcagtggcgtgatctcagctcactgcaacctccacctcccgggttcaaacgattctcttgcctcagcctcctgagtagctggggctacaggcacgnaccaccatgccgggctatttttatgtttttagtagagatggggtttcaccatgtcggccaggctggtcttgaactcctgacctcaagtgatctgccggtctcggctncccaaagtgctgggattacaggtgtgagccactgtgcccngccagagacttacaattcttaatggcaggtgcaccccattattctctttanaccac

SEQ ID NO: 691060 - DNA, 155 bp, Homo sapiens
gggcggagtagcatggctggggaggctaggaaactgacaatcacggcagaaggcgaaggggaagcaggcacgtatggccatgtaggcgcaggagagacggagagagtagaagtgggagggctgcacgcttttaaacaaccagaatcccacaagcg

SEQ ID NO: 691061 - DNA, 142 bp, Homo sapiens
  misc_feature (56)..(56): n is a, c, g, or t
  misc_feature (58)..(59): n is a, c, g, or t
  misc_feature (85)..(85): n is a, c, g, or t
  misc_feature (120)..(120): n is a, c, g, or t
  misc_feature (122)..(122): n is a, c, g, or t
  misc_feature (138)..(138): n is a, c, g, or t
taagaaaaacaacaacaacaaaaaaagacaatgaaaaaaaaaacgtcatgtgagtnanngagatgtcactgtctgtggtcttggngaactagtctcgtagctgaggggtggggctccttntnttctgggggaactggnaacc

SEQ ID NO: 691062 - DNA, 118 bp, Homo sapiens
gcattacaggaatagctcaaccagcgcctcgattgcccttgcccgggactgtgtgcagcacgcgagctgctcgcttcttcaggtgacagctccagtgttggagcctgcccctgtgcac

SEQ ID NO: 691063 - DNA, 178 bp, Homo sapiens
agagtgttgacattgaagatgtcccttgcaggtgatctcggggtgctgttcgtctggctaccttgcttcactgcggcctcctggtcattcctgtggcctgtgtcagcttgttatccgtaagtccacacatcacactggcatgcagcatgttgtggcgtgtgcgcttgggggcctggag

SEQ ID NO: 691064 - DNA, 203 bp, Homo sapiens
gtactacaccaccaccagaggctgcagcgactgcagctgctgctgctgagcacgccgctttctcgtgcccagccacaccctctgccagaagcatggtgaccaagcgcatcagctgtgggtccaccgggtcctcctcctgggagctccgaatgctgagccctagcatgcagtcaagtggtctgagggacccagagaccccaata

SEQ ID NO: 691065 - DNA, 303 bp, Homo sapiens
gtactgtatacctctacaattgtatcgttgccactcggtatagcttagtcactagggcggttatgtttccgacagaatgcgcattttgtgtagacaaggaggtaacatttacctataaggtggtcctgtcagagatgcatgtgtgcctaataagaatgagagcggtcagtaagaaacttggtattggcactgggctccgcttgatgctccctgataactgtttctaagcaacttgagactatcgtgttggagttgcttgttttgctgccagcctaatgtccttgcgtgggtcccttgcaaatg

SEQ ID NO: 691066 - DNA, 349 bp, Homo sapiens
gggtttgaaacctgctctatgaaagggaacgttcaactctgtgacttaaacgcaaacatcataaagaagcttctgagaatgctgctgtctactttgtatatgtaatcccgtttccaacgtaaccctcaaagctatccaaatatcctcctgcagattccacgaaaagacgctttcaagcctgcccttagaaagggaatattcaactctctgatatcaatgcagatatcacaaagtagtttctgagagtgcttctgcctaagttttatatgaagatattcccgtttccaacgaagcagttagggctatccatgtatcaacttgcaaattctataaaaagagtgtttccaaa

SEQ ID NO: 691067 - DNA, 533 bp, Homo sapiens
ggaaagctgatacaggataagtccttatgagaccgtacgtctatagtgaggaccactctactatcatgataacagctatgagggtaacccccctgccatgattaagttacctcccagcaggtccctctcagggcacatagggattatgggaactgcaattcaagatgagatttgggtgtggacacagccaaaccatatcattccacctctggcccctcccagatctcatgttttcacattttgaaacacagtcatgcctttccaacagtccctcagagtcttaactcattccagcattaactcaaaagttcaagtccaaagtctcatctgaggcaaggcaagtcccttccacctatgagcctgtaaaatcagaagcaagttagttacttcctggggtcattgggtagataacacccattccaaatgggagaacttggtcaaaacaaggggagtatagaccccgtgcaaatccgaaatccaacgaggcagtaattaaatcttaaagttgcaaaaggatctcctttgactccatg

SEQ ID NO: 691068 - DNA, 673 bp, Homo sapiens
tttcatttgtcgcatttccagtttccaataccaactcacctacaacgatattaccacaaaccttaggaccaataaatgtgaatgttggaccccaaatgattataagcacaccacagagactaaccagttcaggaagtgtatctgattgggagtccatatacccctgctaccagcaatggttactcagacacacatagcaggaagctactggctgggtccctggtgatagaaaactgggctagaaaatttatagactctgatttttcagaaagtaaacgaagcaaaaaaggagataacaaatgggaaaggcttgagacacttcttcaactgaaagtgtgtgagaaagttcacacgaccaaggtacaccatcgtacaactgaagtcgctgaatgagctggtgtcagagcttcaccaattcaaatacaccatttggctagctagataacgcaggcttatgatcacgatagaacactcacagcagaagagctccctgatgcttaaaactgtgctcaatgcgcaatgacacatacatttcaccgcgcacaccacacaaatccacgtggcttcgcacaagcctacccaattcttgctcagtgattgtcgactctggacaccagagaaccacagcggatccaacgcatacacccaccggccccctgcacactctctacgc

SEQ ID NO: 691069 - DNA, 385 bp, Homo sapiens
ccctatgggctgaactatatcccccatcctataattcacacgcgtcgcagctcctaagcccccaaggcatcagactgtgactgtatttgaacacaacgtccttagagaggtgatcaaaataaaacgagatcactatggtgcgccctaatccaataggactaccgaccttataagaagaggacatgaggacacagacacacacagagggacgaccctttgaggacacagggagacgatggtgtctacaagcccaggagagaggcctcaggaggaatcagcccagcccacacctggatctcagacttccagcctccatggactgtgggacaatcaatgtctgttgtttattagccacccagtctttggtattctgtcctagctgttt

SEQ ID NO: 691070 - DNA, 460 bp, Homo sapiens
  misc_feature (383)..(383): n is a, c, g, or t
ccggttccatgcacagttgggttggtttacacaattctgaccaaaaaataaagtgagcaaactttctacttaatgggtgccaaaatcgtgtgcctagatcagttgcagacaagaacaggactttcagtggaaatctcaaacaagtgagatcaagatgctgaggcacttctttgaagaattagaataggagacgagccatggctttaccagtaccatcctgaagacaaagcacaatcagagcaatggccaccaagaggaggaagcagtccagtcaaaagaggaccagtcaaaagagcacaggccatggcaacagttttttggaatgcttgaggcattctgctttctgactttctggagggccaaagaatggacatctgtttatngtgagagtttcgagaaagttagctaaagctttagcaggaaaacgcctgtgacaatttcaccagacggtctttcttca

SEQ ID NO: 691071 - DNA, 673 bp, Homo sapiens
ggagagagagagagagagagagagagagagagagagcctatgtcgcggacgacatggccaaacgtcaccaagacacgtcgcgatcgtcggtaaatacgggacccgatatggggcctccctccggaaaatggtgaagaaaatagagactcagccagcacgccaatgtacacttgctctctctgtggcatttttccgagatgaacgagacgcatctgtggcgtcatctggcactgtggtctcctgcatgaagacagtggtctggcggtgcctggacgtacatataagcacattccgtgtgatcacggtaaacgctccgcacatcagaagagcagaaggaggtagacgagaccagtagcacgctcctctactctgtagagatactctgtggccctaattatactatggtgttaatcatatgtacacacaaacacacaaacacaacaaacaccaacacaacaaccaccccaccgcacacccaccacacccttctacccagcacactaggcgaagagagcggagaagaggaagaaccagcgagggacatccggaaagacaagccacccccccgggacccgctagagcgtgggggacaagcccgaggcggaggaggccgcaccgatccatcgacatatgcacgaaggagagaggacgaccccacgacaaggcgagcgac

SEQ ID NO: 691072 - DNA, 520 bp, Homo sapiens
attcgcggccgcgtcgaccaatgataaaaaaagacaagggcattatataatgataaagggtttaattccacaggaagacttaattatcctaaatatatatgcagccaatactgaagcactcagatttataagacaagttcttaaagaccttgattccacaaagagacttagattcccacaaaataatagtgggacactaaaacaccccactgacagtgttagacagatcattgaggcagagaattaacaaagatattcaggacctaaacttgacacttgaacaaatggacctgacagacatctgcagcacactccacccaacaacaacagaatatacattcttctcatctgcacatggcatatagactaaaatgaaccacatcttgaccataaagcaattctcaacaaattcaaaaataaaatcataccaacctacactctcggaccactatcgatttctattttcattgcactgtggtccgtcgacgcggccgcgaatttagtagtagtagtcgacccg

SEQ ID NO: 691073 - DNA, 588 bp, Homo sapiens
  misc_feature (321)..(321): n is a, c, g, or t
  misc_feature (326)..(326): n is a, c, g, or t
  misc_feature (329)..(329): n is a, c, g, or t
  misc_feature (332)..(332): n is a, c, g, or t
  misc_feature (339)..(339): n is a, c, g, or t
  misc_feature (351)..(351): n is a, c, g, or t
  misc_feature (357)..(357): n is a, c, g, or t
  misc_feature (367)..(367): n is a, c, g, or t
  misc_feature (369)..(369): n is a, c, g, or t
  misc_feature (374)..(374): n is a, c, g, or t
  misc_feature (422)..(422): n is a, c, g, or t
  misc_feature (433)..(433): n is a, c, g, or t
  misc_feature (437)..(437): n is a, c, g, or t
  misc_feature (442)..(442): n is a, c, g, or t
  misc_feature (450)..(451): n is a, c, g, or t
  misc_feature (463)..(463): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (486)..(486): n is a, c, g, or t
  misc_feature (488)..(488): n is a, c, g, or t
tccatggtagccaatcaagcttccaaataaattaaattccatttcattaaagggaaaatccccgagccactgagtcttggcttgtcactgaagttaaatctgaacccaggtgtcaacagctgctctaactccccactctggcactgaggagtattcccctcatctacctctctaagctatgcacccctccccacgtcttccagctggggatgggggagtcatagaaaagcccccatctccatctgggatagggaccttccatcagccttaaccctgggaaatgcctgctgcccccagtgactcttggtttcgtctcccacntacanaancanggtggangggaagggtggntctcanttagcagggntncccanggcaagtcagcctcctccctccatgcctctctggtcagtgtgccttanggtggcctctnactnccacnactctggnncccttgggggangactgggnaggggnccntgggananccctgacgctggaaccttgtatacacaaataaaggaccagtcctcaacagacttctggagccgcctgcctggagttctaaaacttagggcagggctggaa

SEQ ID NO: 691074 - DNA, 170 bp, Homo sapiens
tgaggatccctgctgtacatagtattgatgtctgctactgcaggttgtcgacatactttggtgggactgtgcggaaacttgaggatgaaatcagtgagctgcatgcacttataaggcatgcgctgtctcctcacttgagtgcaaggtccatcgaccaaagccctgttctg

SEQ ID NO: 691075 - DNA, 981 bp, Homo sapiens
  misc_feature (776)..(776): n is a, c, g, or t
gagttttagcccccttcgtatgtggttcgcgtggttgtgcacgaacccctgttgtgttgcatcccgaggtgttcgcgcgacaatatggcgtcgctattaccgctcgccccgtgttgccaaggcgcaccgtgtgaccgtggtgaccgccgtgggacacaccgcgtatacccttggggaaaccccctggggttcacctgacccccgtgggggaagacacctggcctcacgtcttccggggcccctctgcatattccggggtgtgggcgccccccccgtgggtatttattccccccacgtgtcgccatggtgtgcgcccgctatcctagtaggggcattcgctccctaagcctgacccgtgcttctgcgccagccccagtagccaaacatggcgcccccgggaggggtgtagtcaaaccccccctgcccgaaaaaaggggggatggcgccgcgcccctacgagggaggtagttcgaagcacccggacatccacgcgggtttaccgcacccccacaacagagccgggagccacgcgtcgctccctgaagacccgagtggggagagaaagatacagcccacacccgttgggtggtgtgagagaaaacattataggaccccgacgtctaaataggcatacataggcaaccaccacggcgtcttttatcccacatgtggggcaccccgctctccgctgcaagtaccccgttcgtcttgtctttgcccacacctgcgagagagggttataatgttttctatcctgggagccacagtgagggaanaaatcggccccatatccacaattcggtgtggggcagctcgctgtttctgtgtcgtgtcccctaggtaacacagtttgtgttgagccgccggatggtgggtgcaccccgctcccggcggcggttttttgtcttcccccgcccacgcacaccccccgcttttcgtgggaaaaaaattgggcaaaggagaaaacgaacaaacaaaaca

SEQ ID NO: 691076 - DNA, 709 bp, Homo sapiens
catggtggctcatgcctgttttcccagcacttcattaggccaaggcggacgagtcacctgaggtcaagagttcgagaagccagctgtgtccctggggccggcgtaccattcggaggtgccgtccctggctcactgcgtgaccacgtggagccgcatctccagccctcttggactagcagccatctctgcgatgttacggcacagaggaatacgcttctcacttgttagacgcactgtctgtcgaggcctctaaccagctccacgtatactctaacacacgtgtctctcacgcctgtatacaacttcgcttcttccattctctagacacagagacttgctctgtccctccaattggaccgacgcgccttgacactagctttctgcattcttcccctgtcacgccccgaccatccttatcctttgcactcttacttgctcgcgtcttaccccctttttccgatacgtcgtgctgttctcctatatacctcatctccccctcccgccctcttccgcatctcgttgcgcactcttgtccttgatcgttcgtccattgtccctctctcattactctttctatccccgtgcttacccccccgtccctccccgtccctttcactatgcggccgttcctctcccggtcccgcctctcgcctcctcgacctttcattgtactcgcgcttcgtcctgtcttcccaccttgctccccccg

SEQ ID NO: 691077 - DNA, 344 bp, Homo sapiens
tatacccaatccaaaacagaactatttaaaaatattggccaggcacggtggctcacacctgtaatcccagcactttgggaggccgaggcgggtggatcacttgagatcaggtgttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaa

SEQ ID NO: 691078 - DNA, 1002 bp, Homo sapiens
gacgctcgcaggccccgccgcgggtttttaatcggccgaggctgcttctgccactggttcctccatggtaccacacaagggaagatggaagtgggtctgggcaccgggagtgtgcccaccggagactccaagagaaacgtacgagtcgtcccaggaccggggtggtgagcgaggccccattttgtcctcccagggcctagtctcagacagactggggtgagggaggtggggacaggcggcgagccagcgggcagactcaggcctggagctcgtcctgttcccctggccacacaccaaggtgttgctgcctcctgctccctggtggccatgcctgctgtccctcctcactggccttccaggcatgggcgctggctggggagggatggaagcgtgccctgccgggggtgcccctcggactcggtcttgccattcgtgtccgggcctgtgtggtggtctctggcctcgcacggcccgtgtgtgtctggggaggggtgaagcacgccgcggccccctctccccgtggggccgagacctcctggtggtcgcctgcctgatggtgtcccgcccgcgttccagctgcaagctcgggtgccaggcaacgggcccgcctggcgactactgcgccggggcatgttcgtgcagcagctgctgagtcgcggctacggcttcgacgagcgcgccttcggcggcgtgatcttccagaagacggcgcggaccctgcagtgggctgggcgctcggcttcatgctgaacgtgaccaactgatccccgccgaccgcggggcttggcaaggcacaacttcagctcctggtcgtctctgctgtcttcgctcgcgcctgctggctgtcctgctgtggtagttcctcgccagtgcagaccacttggccaggcagacgccaatacaaagggagaacgaaaagcaccacgcaacaaaattcgctgcccggcagacccaaaaaacgcaggcgaaacaccatagacgcatgagcgcgactcgagcgca

SEQ ID NO: 691079 - DNA, 1074 bp, Homo sapiens
  misc_feature (492)..(492): n is a, c, g, or t
  misc_feature (551)..(551): n is a, c, g, or t
  misc_feature (560)..(560): n is a, c, g, or t
gaagaaacagatcagaaatgagaaagagacctgctgatttgctgtgtctctattatatgatacttatcatgattttgcaggagtagacattttaactatgagagtcgtgggtttatttgtgagtacgcttcattcatattctctttatcccgaacagtcaccaatactggttatgttgctgtccagtgaataagataaaatatggaatgatctctttctctgaatgggaacacatgttcctccaatctgctgtgtgacttaatcagtgtcattatgattgaggcagaagataccatgaatcagtcagaaagaagagtcttataatacacgtctcacttcccaattgagcattcagctgtagataatgttcctgctggagcatttagtgtcttatgagattccttattgagaggacattctcagactcaaacacgggcttgtaaattctgacctatgcaccacgtaaacaatgcaaatagatttcctatcttncctgggccactgttgtactagattacagtttaggtttcataggtccaggctgtgggttntgcgatgtntgcttctttcctgcttcgcagtagtcaactccctggtggttcagcctcttgaaagaagcttgagagtaagcttccttctgcctcaacaggactgaaaaaccactcaaaatccttccaaaggtgaagcattagcatcccataaaaggctgggtcccaaacattgttactatagtatcttctgtcaggattcagaggcatttaatgagttagagaaatagatgaaataaatcaaaggactaccttcccaactacaataattagtggaaattctaatattaggaacttttaccattgaggaatttaagaatttaaggcaattataggttgaatagccaaagtcaggtatgagcctatgagagctcttatagaaatgtcttcattcagtagaataaagacaacattagagaatacaatagcacttttcacttctaaaattgctatccatgtgcctggtatgctgctttcatttgcaattcaagctcttgtaggaagccagggatcctctagaacacta

SEQ ID NO: 691080 - DNA, 1041 bp, Homo sapiens
  misc_feature (452)..(452): n is a, c, g, or t
tgcctatggagtgagctgagcgcggcatgccgtcgcgttcggaaagtgccgtcacagttgtccccctgagcgacttccaggctacagaagctaggactttgtgtgtcaatagaagaaaatgtcatatagttatatactagaagagaatagagtcatcggtggtaaatcaacgaccggatatccttcaaccaagtattggaggactcagaagccacttggagaacgcacattgacgatggtagataattcaggtggcatgatgcgaacggatcacatgattggtgatgcatgcttgccactgccaagcttgtgagcccttgggtgcccccacacggtgcgacacctgtcaagggaacttttccgcacgttgtgggagacacaccagggtggccacaggaggtggggttaacacttacagggggggccggcaccacacagaactgatttggggnagcacttcctataccactgtggtgtagcagaacccagcaccggatataaagacgaatgttcgaggaacgagattggattcgataataccaatagtaatgggttaccgataatccgatgattgtcagttcaacatttcacgtatccaaagacacgacaaaaagagcttcacacgcgatgatgtatggcgcgttacattcaccacccgatagaatagcgccaggggtgagaccaccggcaaccaatggtgaaaattacccacgacgttaccccacccacgggacggtggtgcaggtaggccagaacaacatcgtagcgccacccacgggcaaggtggacaccaaagtttgcgacaaggtgaacggaattggcaacgggcgagcacgcaatttgtatgcacgccgagtgatgagaccacccccacagtttatgggggcgatgaggaaaaccaccccgttgttgtaccctacagggcgtggcgcacgtgaaaacagcagtgacacgcccattccagataggaggcaaacatgacgggctccagccgccaccatgtgtgtggacatgaggggacacacgacaagagggaaaagt

SEQ ID NO: 691081 - DNA, 400 bp, Homo sapiens
tctttctccctgccgcaacagagtgagcagacatctcaaatgatattacagatttgtgtttatgacctagaaaaatgttcagagcacagtactttcaaaacgccagactgggccggttgcagtgactcacgcctgtaatcccagcactttgggaggctgaggtgggtggatcacctgaggtcaggagtttgagaccagcctggccaacatcatgaagccccatctctactaaaaatacaaaaattagctgggcgtggtggcgggcacctgtagtcccagctgctcagtaggctgaggcaggagaatcacttgaacccgggaggcggaggttgcagtgagccgagatcgtgccactgcatgccagcctgggcaacagagcgagtcccactcaaaaaaaaaa

SEQ ID NO: 691082 - DNA, 537 bp, Homo sapiens
ttagtctcccccgatgtaagaggtgggtgaagggggcctggttttttcaggaagacagagttggagagcactgtagtcactacaaagcagtaaaagtgaatggtgtctccagcggctgggtccatgaacaccacggtagagccccacgccataaatggtgtgttcctgcctctggccctgcagcgaatctcttttgaatctactttgatatggtggctccacagagcaagtgggaagtcaactagccaggaggctggactagggttccctgtggaccccgcaggtccctagaggctgcttgggcaggtggttggtcggcaaagacagaaaggtccaagacgggttcaggcctggccacattagcggatcgacgaagggaaactgcgatgtagcgggtgcccctggtaggtggggagcacctcatggtaatgcgtgagtcgtacagggtgcatgagggtccaggccttccttggggctcggatggaacagtagtagcggaggaaccgacagccccggcctcgtaatcaacccgaactc

SEQ ID NO: 691083 - DNA, 183 bp, Homo sapiens
tacgtacagctgctctgcggatgttgtgaccgccaagaatgagggtggtaactgtgtcatgtagagacaggtctaggaactggccccacagctcgtatactaggcgccgctgcagccgtaaggagccgcatttgatcctctgtagccttggctgcaaactcatacttggccttgtagaaggca

SEQ ID NO: 691084 - DNA, 544 bp, Homo sapiens
  misc_feature (326)..(326): n is a, c, g, or t
  misc_feature (349)..(349): n is a, c, g, or t
agccagggggactccaggggagcacaggggggttatcggatggccctactccaacccttatgagaacagcttattccacccggttgggctttcgccccccagttatgtggtttgctcttaggacaccaggctgcagatgatcagggatccaatatgactcagagaaccagtgcagactcaagatttatggaacagggatggcgaggcctctctcaggagcaggggcattgttgattttgtctgcccaatccatcctgctcaggaaaccacacccttgcagaatttttaaaaaggaaaagttttttttgggatcaaaatataaaaanacccaaagggaggtaagtttttntcccatgatttctacaaaccccctttaagtcccatcttccccggggcaaaggccaaagggataaaagttaaagtttttgggcttattcagaagcgggatttgcaatttgaaggctactcataacaaaacaaaaaagtatgttaaacggtttttaaattttaggggcttcccccattaaatgatttttttctccta

SEQ ID NO: 691085 - DNA, 166 bp, Homo sapiens
tgacacgttgacgccactaactgaccgtgacacgtcctgtggacacgccctgtggctaccaactaacactgtttgacgccgtacgactgccgtcggacaactggtgacacgggacgacctcgaacgtacctctgacgtgcttgtacggacgggtaccaactagacg

SEQ ID NO: 691086 - DNA, 1434 bp, Homo sapiens
tgcatcacctcgttcgttataaggttgtttatgatgaaagattctttgattaatcccactagtaatatatttagtaatgttgaaccgccacactataagccctgtgtgaaaaataaaacaactgggggtggtttttagaatcaaatttgtatactgtcgatagatatatctgcccgtgtttacacaagggtatcccccttacaccagtttctaatggaggtataataatggtatattttggtgcgttttttccccaaggataatccctgcttcgttgttacaaaccccggaagtgttgtgggaaaaaagaaaaccccaccgaggggggcggtacacacgccaaaaaaataagtggaaaattccaaagttgttctcaaacttttccaggattatgttccctcctgttatatggtgatcggctgcccgatgtaaacacactcaacgggggaattgtatctttgttttttgaggtaatgaaaaaagtctccccagcagtaaattgtggactccaaatggaactcgtgtgataaaaattgaggtgctttcccaaacgccccttgtaaagaattgtagggagccccacgcgcccttggagccccccgtgaaaaaaagtgtttgtaccccaagtgaaaaggtgaaatatagaagattgtgccttttcccccccacaagtgaaactgtgcccacagaaaatttgggagaaaccacacttggtgtgtgacccacacatctcccacctctgagattttctgaaccacagtgtctcccgagatgttttcccccacgagaggtccaaaaggagaaaaagagaacctaagttgtgtggaaaagaaacctgtctgtggcgctgagatttcttgaaaattcacagataagaatactcccaccccgaaagggaaaggatcctcacgaagagtctacattggcgtgtaaaaaagcaccgcacaaatgtcacccacaggagaataaaaggttttccgagaaagagaagataaagaatatttctcgcacacattataagaagtttatccacacgcccacactggcacacacacatgtgtgtaacacattggctctcctgctttagattgtatactctatattaaaagaacgcgttttgtgagaaaactataacacccacgttcaattttataaattataatgttacccacatagagactgggccctcggttacacaacaaggagaatttgtatatttggagaaaaagttgaggtttgagaatctgattacaatgccccttatgagaaaataaggggtgtctttaaagagcccccccctggtgtagacctcttttatatggggaaaaaagggaaaaaaatcttcccacccttttaagataaactgatggtttgtaaagattttccaagcttagattatttaaagaaaaatttaattataaaggaataggaagt

SEQ ID NO: 691087 - DNA, 1419 bp, Homo sapiens
gctgttttcctgctgcaggagcctgcggggccgtaggcatgccatgtgcgcccagccggaatggcatggtcttgaagccccacttccacaatggactggcagctggcgctgtggccacgtggttcaaccagcctggcccgtaagatcctgcagactgtaaggccctggcaatgccaatggcgcgccgcatctgccccgcgccccatgcgtacggtgtcccaatcacggtgcccatcgttgctgcttgccccactggttctgtgtaccaacactgaatgtgttgctgctgcctggcgctgcatggcattcaagccctgtgatggatgctcaagggttgtgcctggcatatcacaatgaatgtgttggcacctgtgacccatcggcgcatattactatgtgcgatcctgatgtgatgtgctgtgaaaccaatgtaccaactgtgaagttcaccttgccatgtgccaaactagtgccaagcggtgctcagaacagggcatgtacccggctacccaatacttacaataccatcatatacacaccaatgtgaaatggccactccggtcaccgccaaagcaacggcgagcacatgtttctatgctttgaatgcaacctggaaaacattgtgcccacaccaagcttgacccgggcacccgtgttccatgacactggtcctgtgaacactgctctactacacgaccggacgaaacgcatcgacgtcattcaccttgatggaaagagaacgcaactttcaaacgccttcagctagatctcacgtatggacccgtggccaaacgcccgggctctatcgggcataacgggccacaaatgacgcaatggacagccgccggacccaaggactgtctgcacccggactcaaactaaaaggccctccttgttggacctggcgaattcacgtccggcaactcaatgcctagggatcactccacgtaggtgtagttaccgcaggacacaactgggccctggagatagcgcgcctacaatgatgttgacttactcctagcaggagcataaggcgacaatcctggacacgaacagcccaggccccggaacaacggctaaccacccgtgtgtgcaccacgatagcatggcgccaaagcaaagatctacacgcgcaacacaggagacagcacacccacaaggcggccctcacacggacacgacgctactaactaccaagcgaacaggtgcgcagatggtccaacacgctaacacacccacgacagtggtcgcaccaaacagcgcgaacccgtcaaaccacacaatgaccagaccgtgcaacccaacgcagctgtgcacagccacaacacgctcacaagagccctcgactaccaccaagtaccacatcagtattattacgcgacacaacccatcccacaagcaacccacacaacaccacca

SEQ ID NO: 691088 - DNA, 668 bp, Homo sapiens
catagtggcacacatctgcaatctcagccacttgggaggctgaggcgcgagaatagcttgaacccaggaggccgaggttgccgtgagccgagatcgtaccactgcactccagcctaggcaacagagccagactctgtctcaaaaaaaaaaaattattaattacttattgaacttaaatggattaaaggctaggaagaattagaaaattattttttaaattttaaggtctttaacaacggttaacaaaccgggcccggaaggcttctggcttataatcccaggtggcttgggggagggctaaccggtaggagggatggcttggagggccagggagcttaaggaccaggtctggggcaacaggagtggagggatctggtctctacaaaatattttttaaaatttacgccagggccgtgtgtgccacattggttggtagtcctgggtgctcagagaaagctgaagggggagaatcacttaagcccaggaattcagggtctattagtgagctatgatgtgcccattgacctccagatgtgctctaccagagaaaggacctctatctctgaaaaacgaattgacggccaggcatgggtggctccgtgtggtaatcccagcacttgtgggaggctgaggggaagtagatcacttggagaccgggagttcgaagc

SEQ ID NO: 691089 - DNA, 755 bp, Homo sapiens
  misc_feature (238)..(238): n is a, c, g, or t
  misc_feature (549)..(549): n is a, c, g, or t
gtattatcctgataccaaaaccagaaaaagacacataagaaaaaaaaaaaaagggaaaactaagggctaattatcacgtgattgaattacgtgattgcaaaaattcctcaacaaaattacttatttaacccaaatttcaacaacacatttaagaagactcatttcattcagtgaccaatgtgggattttactcccagaagattgcacagaattagtttcacccattttgcaaattcantctattattgatacattcattcccaaaaggaacaaacgaattaaacccattattgattcattttcaatttattgctggaacaaacactttgggataagatttcagcattcgtcttttatggtaataaaaaaaacttcctcaaaaaaccggggttttacaaagggacccatgtgcgccttcaccttaattaaagggccattattttggagagacccttattagttaggttattcacatccgtgaggtggggcaacaaccgtgaaaagaccctttattctcgtgatagctcggggaccattaccagggtatangccccaatttttccacccattggtgtttttcccaggacataatcgggtctaagaaagatttctgaagccttaggagccatatccgagacaccagagaacatttttttgaccaagagagagcctttccccaacatttttgcacatttttcgacacacaaggtgtccaactttacttccccatgggggtccccatcaaggattgcatt

SEQ ID NO: 691090 - DNA, 388 bp, Homo sapiens
tcatacctggactgtggttcatactgcactgtggttcatacctgcacgtgtgttcataccgtgcactgttgttcatatctgcacgtgttgtacatacctgcagtgttgtcatacctgcacgtatgtcatacctgcactgttgttcatacctgcactgttgttcatacctgcactgttgtacatacctgtattcccagcactttgggcggcagaggtgggaggctcacctgagtgtctggagttccagactagcctggccagcatggtgacatcccatctctactaaaaatacgcaaattagccgggtatggctgtgcataagtctgtaatgccagctactcgggtggctgaggcaggcgaattgcttgaacccgggtatgaacaacag

SEQ ID NO: 691091 - DNA, 220 bp, Homo sapiens
ctctcgagctattgagacgtacgtttatcaaggccgggagcggtggctatgctgtgtaatcccagtgctttgggatgctgagatgggaggatcacttgacgccagcagtgtgagaccagcctgggcaacatggcaagaccccatctctacaaagaaaaaaaaattagtgggacatggtcgcacatacctgtggactcagctgctctggaggctgaggtgg

SEQ ID NO: 691092 - DNA, 740 bp, Homo sapiens
  misc_feature (4)..(4): n is a, c, g, or t
  misc_feature (9)..(9): n is a, c, g, or t
  misc_feature (13)..(13): n is a, c, g, or t
  misc_feature (34)..(34): n is a, c, g, or t
  misc_feature (38)..(38): n is a, c, g, or t
  misc_feature (40)..(40): n is a, c, g, or t
  misc_feature (46)..(46): n is a, c, g, or t
  misc_feature (54)..(54): n is a, c, g, or t
  misc_feature (63)..(63): n is a, c, g, or t
  misc_feature (66)..(66): n is a, c, g, or t
  misc_feature (73)..(73): n is a, c, g, or t
  misc_feature (77)..(77): n is a, c, g, or t
  misc_feature (90)..(90): n is a, c, g, or t
  misc_feature (95)..(95): n is a, c, g, or t
  misc_feature (97)..(97): n is a, c, g, or t
  misc_feature (102)..(102): n is a, c, g, or t
  misc_feature (132)..(132): n is a, c, g, or t
  misc_feature (137)..(137): n is a, c, g, or t
  misc_feature (140)..(140): n is a, c, g, or t
  misc_feature (143)..(143): n is a, c, g, or t
  misc_feature (150)..(150): n is a, c, g, or t
  misc_feature (167)..(167): n is a, c, g, or t
  misc_feature (169)..(169): n is a, c, g, or t
  misc_feature (183)..(183): n is a, c, g, or t
  misc_feature (188)..(188): n is a, c, g, or t
  misc_feature (197)..(197): n is a, c, g, or t
  misc_feature (205)..(205): n is a, c, g, or t
  misc_feature (209)..(209): n is a, c, g, or t
  misc_feature (226)..(226): n is a, c, g, or t
  misc_feature (229)..(229): n is a, c, g, or t
  misc_feature (231)..(231): n is a, c, g, or t
  misc_feature (242)..(242): n is a, c, g, or t
  misc_feature (245)..(245): n is a, c, g, or t
  misc_feature (252)..(252): n is a, c, g, or t
  misc_feature (256)..(256): n is a, c, g, or t
  misc_feature (261)..(261): n is a, c, g, or t
  misc_feature (265)..(266): n is a, c, g, or t
  misc_feature (268)..(268): n is a, c, g, or t
  misc_feature (270)..(270): n is a, c, g, or t
  misc_feature (308)..(308): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (340)..(340): n is a, c, g, or t
  misc_feature (353)..(353): n is a, c, g, or t
  misc_feature (357)..(357): n is a, c, g, or t
  misc_feature (367)..(367): n is a, c, g, or t
  misc_feature (389)..(389): n is a, c, g, or t
  misc_feature (393)..(393): n is a, c, g, or t
  misc_feature (397)..(397): n is a, c, g, or t
  misc_feature (419)..(419): n is a, c, g, or t
  misc_feature (432)..(432): n is a, c, g, or t
  misc_feature (447)..(447): n is a, c, g, or t
  misc_feature (454)..(454): n is a, c, g, or t
  misc_feature (480)..(480): n is a, c, g, or t
  misc_feature (484)..(484): n is a, c, g, or t
  misc_feature (490)..(490): n is a, c, g, or t
  misc_feature (497)..(497): n is a, c, g, or t
  misc_feature (503)..(503): n is a, c, g, or t
  misc_feature (665)..(665): n is a, c, g, or t
  misc_feature (726)..(726): n is a, c, g, or t
tganaaccncaanagccaaagttgtttatttgcngctnantcttgnggccaaanaggaattcnacnaaatgtnaaangaaggatgtctcnaaacnanaaganaagtaaaagggccttgttgtcatttctgtnattgnggnggnggttgtnggctttcttggagaaananatctgtgactttcncaacnaatgggccnctggcctnaatnaacaaagtatccctttnccnanaggaaaaaacnagnaaaaaanacanacggnaaannancnaaaaccccctactgttatcccaaaaaatcttattaaanattaaagtgaacnactgantanaaaagtgccngtaaatggggacncaanaatgatttcntgaatgaaaaaaacctttaacntcancccnacttgttgcccccccaccccanaaacttatgaccntcattaagccccacnagtaacnagtttggggaccgactagggggccancaanaaagcnaacccanaaggcnatgacaaaagcactgaggcatcctaaagccttatctgggccacaataagttacctagttacctatacaaactctactccacagcctagctctggaaaatcggggaaaaagagagagagttcagcacccataacacactcctatgccacttcttttgcatttnttcttagccaacagttgagaaagactattttttagcttgtttcacttttccttgatcttcnactttcttaatggc

SEQ ID NO: 691093 - DNA, 1244 bp, Homo sapiens
gcatccatgacagcaaatctccgggggacatcaaacctgaagatttctcgaatggaccacgaccacgcaggctctgtgcggggtggacgactgaccgtttactctgctttgtgaccacggtgccgacacagactgaccattgacggttcggttctatgacggactgactgacgaactggactggcacggcctttggaggaccttctctcccacagactgtgcactacacaccacgtatgccaattgtgttccggaccaccccccatatcacaacgactgaacgacttgaagcggcctgataacagatgattctctgcaactgcaaacgacaacgcgaggacggggacgatgatctgacttccaaacagattcacctacttaccactctggctggaagacaaggacagacggtgcaagcggcacgacggagcgacaggccatatgccacaaccatacatccacagaacccatatcggaagcgactgcgctccaacacactgagcgatgagaccggcatcctgcggcggctgctagacacgagaggagacataacagacgaaaacgcagaactagaaaagcgccccgcacagacgccagacacatccgacaaccaacatcccacacacatacacaacccaccgagccacatcaacagaacaccacctaacacacaaacacaacgacgaaccgaaaaacaacacccgacggcccctggcctaacaccacaggaaccacacagccggcacagcgacagcgcacgcccaccaaccacccggcgcacccgacccacaccagcgacacgcacaacaagccacagggcaaaaccatacagaaacacacacgccgccacccccaccaccgaaaaacaccaccaaaacacacaacccacaacccaccacaaccgcaacccacaaaccccaaaggacgcccaccacagcacagagcagaccccgacgacaacaccccgccccaccaagacgccaagaccacctaaccaacacctaaccaccacagaagcgaccaactgagcaccgcggaaccaacagaaccgacccacaccgccgccactcgaagcacagagaacaccacaccaacagacccgcagacacccccagcagacagtaccacaacacgaaaccgacacacgacaacacagcacaacacgacacaaaaaagacacgaccaaccaaccgccaacaccgcaccagcaacccacaccacccgaccaccacaacaaaccccgc

SEQ ID NO: 691094 - DNA, 1116 bp, Homo sapiens
cgccggcgagtacggtcccgtccaccgtccgcagctggtagccaggctgcccctcgcctcgagctccctttcaccaagcacctgaccacccacattgacaccgtccgagtccggccagccgtctccgactcggtttgccgtttgcatctccacacagtggcgtcctcctgcgcagagcgtgctggctcctccgggggacccgcggtccccacccgtgcatacggggcatcatcaacgatggtcctctcagggtgcgccatcacttgtccgaggctcagcctcgatggtgggccgtcctcctgagcggcacgatcaaaccatcagcgaacacttcgtgcctggcaaatctggctcgccgggacagccgccacacaaacctgatgcaaaggcatacccctgatgagcccctgggacatatccaggcatcgagcagtaccgcttcgaaagcacacgcctgacttgagcgaacgcgacatgtcatggtttcaccgaatagaaacacaaacgacgtcccacaggggccgaagaagctaatgggacactggattctaaccccttgggcacaccagcaatacccaaatgggggcgcaaaccaaccagtgcccaggacacttcaacgggcatagacacaagagagccctaagttccaccccgcgagcaagacagcccacttcacacacgcctaaacataaattcccctgaagacagaaaccccgcggccaaacccaagcaacctgttcaacccgacacaaacgcaaaaccgacaagaccaagggcaacacgcgactgctagcaaccagaacggcgcacaacgaagctccacaaaacctaaatcccggcaaaatacacacagcgttaattacccactgtgaaaacactcgaagggacaacaacaagcaaagaaacaaaaacaccccaacccacaagaaaagcccctgaggaaaaacgggccaaaacacattcgtaacacaacataaattccgccagacaaagaacacaaagtaaagcaccacacacaacaccccgagaacaactaatcacccaaaaaaatatcacacacccaggcgtactaaaaccaaaccagaacacgatcaaacaccaaaccaacatgaccac

SEQ ID NO: 691095 - DNA, 285 bp, Homo sapiens
  misc_feature (132)..(132): n is a, c, g, or t
tttgggggcttttccccccgtttggggggggggttttccgtttacccccagtgccctcacaaaagggccctcctgccccccatggttatggggggtcccccccccccccttgtttgaggtcccgcccggttnacagggatttaaatttttgatattttcccccccccctagaagggaaaccccccgagggccccgactttttttgtttttttttctatccccaggggaagccccccttggcccgggcctataggggcggctttataaaaactcgtctgtccatga

SEQ ID NO: 691096 - DNA, 977 bp, Homo sapiens
tgtttttccaccttggttgggtcttggcttaaaatatcctcatgtgggctaggtgtggttgctcacacctgtggtcctagcactttgggaggttgaggcaggagaatcccttgagccaggagttcgagaccagcctgggcaacatagcaagagatcccatatctgccaaaacatacaagaattggccagatgtggtggtgcatgcctgtggtcccagatactcgggaggctgaggcaggaggatcacctatgcctgggaggttgaagccccagtgagccgtgatcacaccactgtagtccagcccgggtgacacagcaagactctgtctcaaaaaagaacaaaaaaaaaaagtcctcttgcaagaagggacaggaccattgccaattccctctttgccctcaattttcatgagccgggggtaggggctacacggtggcctcggcggggtctgcagggtgggtgggcctgtggcgggtgtgggcaagaggaatacggggccggcagtgtcactggtgcacaatgacaggctgaggggtgtggtgcccagcctggggtcagcaccggtgcgaccgtgcttgggggggctccctgttgagtccccatggggggtgccgggccgggaccaggggtgcgcgcccgtggtcgggcgcctgggttccctgcccaatttgataggggctcccttgaagatgggccagctttggcacatattatgcctaattacgggcgcaagggacccctcgcccgcccaaaagaggtggggccgccgtgtgggcggggtgcgcccacagatatacatcgcgtgggcggcaaaaggagaaccggctcacgggtgggcgagcggacacacaaaccgcgcgaaggggcaaccccacaggagagcgggcaggcggggggggagaccccaccaagataggacaggatccagggagattattactgcgaggggagggcacagccagcaagagtcatcatg

SEQ ID NO: 691097 - DNA, 900 bp, Homo sapiens
  misc_feature (900)..(900): n is a, c, g, or t
atatacactcatagaaggtgacaattatatgaatcctcttttcaagaagaccagttccaaaggagtgaaagggattatttaaaacatcgttagttgcgagttgtagagaagcataagtatatcaatatttatactagttatattatgagggacataaatataaaaatggagagtattctaattgatttccgtgtaatgtgtgtcagtaaacattaaacatgtttttgctattagaatttgttcacatagaaaattgaatctgtatgactagtggaaagaacattggatgtataatttcccatccaattatcaactgagaatactccaatattttccccaaatatcagaacaagaggtgtgactttacaacttagttatttaacagtgcttaattgagcttttgtctaattactgtcccatgtgtagggacttacttcatttgataatattaaagtactttttcaaattctcaggtgataggcaaagcaagagcagatcacacgagaaatgagagagtatacccaatatatacttcctgtgccttctatctgctaatgcaagcaagggaacatagaaactattgaatttacacgagtgctgtctcaattcttccaatccaatgggggcggacaaatacttggaggctcgcacttggctttaagaggatagcgggaagcactgactgatgaaggtcgcaacaaagggaacggatattccggcggaaaggagacggccccggattgtgtaaccagggagtcctaggcttgccaaggtaagcacagaggccgaaattacaggcaggaggacagtggcaacgcgcacgctagggagcgagcgcaaaaaatactggggaaacgtatgggtaacggagcaggtgaactagcccgccagttgttcctn

SEQ ID NO: 691098 - DNA, 123 bp, Homo sapiens
ccgagatcacaccattgcactccagcctgggcgacagggcgacgctccgtctcaaaaaaaaaaatctctagggtatcttttgggttatgtgttggaatttcggtctcttggctggtcccgcgg

SEQ ID NO: 691099 - DNA, 668 bp, Homo sapiens
cgaatgcttgtgatctttgcacattgattttgtatcctgagactttgctgaagttgcttatcagcttaaggagattttgggctgagacaatggggttttctaagtatacaatcatgtcatctgcaaacagggacaatttgacttcctcttttcctaattgaatacactttatttctttgtcctgcctgattgccctggccagaacttccaacactgggttgaatagcagtggtgagagagggcatccctgtcttgtgccagtttttaaagggaatgcttccagtttttgcccattcagtatgatattggctgtgggttagtcataaatagctcttattattttgagatacgtcccatcaatacctaattgattgagagtttttaacatgaagggctgttgaattttgttgaaggccttttctgcatctattgagataatcatgtggttttggtctttgtttctgtttatatgctggattacatttattgatttgtgtatgttgaaccagccttgcatcccagggatgaagcccacttgatcatggtagaaccgactagtcggttctaccatagaacagagctgtgaccacatgccactatatgtgtacaaagtctacatatgttacattcttggaagtcccttaaatgttcccaaatgtcacaagctg

SEQ ID NO: 691100 - DNA, 399 bp, Homo sapiens
  misc_feature (298)..(298): n is a, c, g, or t
  misc_feature (371)..(371): n is a, c, g, or t
aatatatgatgtttacagaatgaaatcacctaatgatgcatttctcagaacatatcatcatcgttaagtgacacatgaatgtacatgttattaatacctcatacaatgtaaatgctatgtaaatagttgttatactgtattgttgagggaccaatgtcaagaaaaacagttgacacattcagtacagtcacaagcatccattttttgaaaatattttcgatttgcagtcggttcaatccatggatacagagctcacagatacggagggccaactgtattgctcttttctctgtttggncttcattttctttttctttttctttttgcttcaaggactaaaactttgggcaatttctatataaaataaaggnttttcagggccttaggttccctccattt

SEQ ID NO: 691101 - DNA, 698 bp, Homo sapiens
  misc_feature (62)..(62): n is a, c, g, or t
  misc_feature (88)..(88): n is a, c, g, or t
  misc_feature (291)..(291): n is a, c, g, or t
tacctcctcacggctcttcccggcgctctcctggctcccttctgccccagctccgtctcggnggcggcgggcagttgcagtggtgcanaatggctgacctcagtcttgcagatgcattaacagaaccatctccagactattgagggtagagataaagcctatggacttcattgtcacatccactagcaggcaagaggcctttgatgcatgttcgtgggacgacaatctgttggtaaacaacgaggatctactatctcactctcctgggatgttcgatgagaatacaccggngaactcacgagtctaaaagaacgaacacgcgtggttcacgcaaattacgccagacttgaatgatagctccagtctttctaacaaccataacaacgtcctatgccaactgtgtggtcattgtgagtacagaatgggtagcgagtatcgtacatgggtctccatactgaagttccttggaagagtacaaatggcctatccatggaatacccaaagtaagcgcagaacatggccagaacgataccaacttttgttttccgaacctgagcaaagtggtcgatgcctatctcagacctgattccctcttagagatagtaaccattgaattgattgatacctggggcaagaattaccggtccttttcgcacttccagtgcggacaagctggattacttcaagtattgtgcagg

SEQ ID NO: 691102 - DNA, 361 bp, Homo sapiens
gctgttctatgaggatcacccgaagcgccagtttctactgaaaactacgaaaaaagttagccatgagtgtgctggcacatgtctgtagtcccagctactagggagtgctgaggcaagagaattgcttgagtctgggatgtggaggttgcagcgagccgagatcacaccactgtactccagcctgggtgacagagcgagaccctgtctcaaaaaaaaaaaaaaaaaaaaaaaaaaagtgatgctctgtgaatggattcaagaggggggtttgtatttttttccctttgtgtggggtgatttgtgtgtgtgaccattgtgtattgtgtttttgtgcgaagtgggtattatagtgtgttgaaac

SEQ ID NO: 691103 - DNA, 234 bp, Homo sapiens
acatcacagctctggtgtatcacgtgtgtgacctctgcacgaggtccttacccactcagtggctttagctcccttatctattaaatggaaatacatcatggacactcattcacaaggttcttgtaatgacttagttcaataaccagaatcgtaaagtatccagagtagtgcctatcactcaggaaatcctagctaccatatcagtaggtttagtgtattctttctttactcttt

SEQ ID NO: 691104 - DNA, 260 bp, Homo sapiens
agcctctgcaggcctctgccacctcttctccaagaggtgcctcctcctatacagttcctaccagttctgcacatgtcttttctgttacctggcatgtttatatctctctctatctataggcaggccttctcgcggtctttaacatgtgttgtttaatttggcgtattatgtttcctaaatggcagactgggtaatgtttgcatagactcgtgacgcactgaactattgaataacagcacagagcagaagctaaagaagtt

SEQ ID NO: 691105 - DNA, 222 bp, Homo sapiens
  misc_feature (78)..(78): n is a, c, g, or t
agttctcctgggacccttctagctgtgggcaatgttataatagggatgaagcgtctgtggttatagagggaataacangtatttaaggttaaatggcctctccggcagtcagcactaaggttctggaccatcagagtccggttaaagtggttattttttttttttggacagggtcgtgctcggtcagggagggcgggaaggcgggggggtgatcggggctca

SEQ ID NO: 691106 - DNA, 513 bp, Homo sapiens
  misc_feature (107)..(107): n is a, c, g, or t
tgttgcgcctcgcgatcgtctgcgccggagcagccgaacaggggtccgacgccgaagatgacttccatctcccccgacggcagcgtgcgcagctggggctggggtgnccgtgggccggaacctgggcctcgcgggaaacccgagccgggcccgtgccgctggcggctattctgggcgctgacggacaggcgaggctgcgcgcccgccccccgcccaggagccacccagggccaattcgctgggcctttcgcgtccggcccaacgtccgggggctccggagaacctggagccgtgtagtaggagcctgacgaaccggaggagtcctggcgccgcgcgggggccgtgggcagctgcctcgggatcccaggcagggctggcggggcgagcgcggtcagcatggtggggccggacgccgtgcactatctccctcgcattcgcctccgctggtggcgccggcactgtccccgccccgcccgaggatgccgtgggggtcaccgcgccttaaagcggccg

SEQ ID NO: 691107 - DNA, 908 bp, Homo sapiens
gagtatgtgtacaattgatctttgataatacagtacaaacccataatcatgtacatgctcattgtcgtttagtgacataacgagagccctagtggttgctctgaatctgtacatgttcgttgtcataaaatgcatacgtgtggatcacaagccactgtgcaacattattttatatccggagaattctgtctctcagagggattgctcttgttcctctcactgtctagtatatcgtactaaactcaagttttcatagctatcaactattaggagtaactttgcaaccttgctagcatcacatggtatgatgtctgtttaatgggatgcacgcttttccccgaccgtatacttagaatgacaaagccatccttgttacagtattgtgactctttccctaaagaccaaacagtgtttctgtggaatttacttgttttgagcgacaacctcctaagtatcaaggtggtatggttgtatagcacatgctgccttctggggattcggaagagcaggttgttggatatccggaatagcaagttacgtgatatagtgctgtcgaacggtactaacgatgcacggtataaccatttcatacaaggccactatagtctattcataaagtagtcttttgaccgttgctctaggcctgaacccgtacgtcaggaatgcttcaatttatagaaacgatactggctattagaggaacgaattaagcttcctaggctgcatcttgtaacgggggccaggagggtgtagtaaaaccgcccccttctggcccgtgttcggactcaggaccagacttggaggcaacctggaaaaacggtccgggcgcggacacgggggaggccaccatattgggcgtgtggaaaaaagaggcaaaaaagtacccaaaaaaggcgcaacggcgcgga

SEQ ID NO: 691108 - DNA, 327 bp, Homo sapiens
gcgagctcaatcaagattttgctctgggggcaagaataaaaaaaagagaggctaggtgtggtggctcatgcctgtaatcccagcactttgggaggacgaggagagtggatcacgaggtcaggagattgagaccatcctgacccatatggtgaaaccccgtctctactaaaaatacaaaaattagctgggcgtggtggtgcatgcctgtaatcccagctactcgggaggctgaggcaggagaatcgcttgaacgcaggaggcggaggttgcagtgagctgagattgcaccacttcactccagcctgggcaaaagaacgaaactctgtc

SEQ ID NO: 691109 - DNA, 442 bp, Homo sapiens
  misc_feature (219)..(219): n is a, c, g, or t
aaaaagtcctatttttttgggtccccaggtgcagcccctcccggagattgtttttcccatggcctcctgagtgatgggccctgcctccctgtgcctcatcctcaggttggttggaacaaagggtgggcaggagccccagcacagattggggggtgctcacagcagggcccccttaatgcaggttggaatgttatccctggggtggggttggaccccacntgatttttttttttcctgcccctccccaactttcattgtaatttatggaccctgcccgcctgggtgttgtgtgtatgtcctgtcccttttttcactattgtttgggtgtgggagggggtggtttttcactgaaaaggggggtacccctaaagcttttttaatgttcaatcaatcagtcattgtgtcccagacatattcaataaacccagattggtccccccca

SEQ ID NO: 691110 - DNA, 121 bp, Homo sapiens
ggtaatacacatgaattagtacacatgacctaactacacgtgactaataataccgctgatctaataatacgccatgatctaatacctgtcaaggcttcgtctccaaacaccatcacactgg

SEQ ID NO: 691111 - DNA, 280 bp, Homo sapiens
gcacgaggatcttgacctggaactcgttctcttcaacattgttcttaagctcgaactgggcaaattttcgtttttacgtacgttctcgaacatataaaaaatttcgtcaaatctttgaataataccgttttcaatgacttgtagttgattacttaaccgttccctgtagatagcttcgcttatagaggttttagatcgtagagtcacgttttcttgtaccagctggcttatttttttttccaagctattaactttaatttttaatatggagttatccttg

SEQ ID NO: 691112 - DNA, 283 bp, Homo sapiens
taattcatcctgatctatcctttcagtgatattatttcagttcacatatagtaaaggaactttgcaatggtatccttccatttctctccttccagactttgtactgtcatcatcatcatcatcatcatcatatatatatgttgtaaacgaatgttatttttatgatacattttgcttatatattacagagatttatgtaataagaaaaagtcttacttacccatgctcataaaaagagcactaaaatcacctagagcttaaggatgaactggctgtcaaaaaa

SEQ ID NO: 691113 - DNA, 249 bp, Homo sapiens
acgctcaggctatgttctcaggatgaccagagtggcgagacagcagcaccacaggtgtcatatacccgagacatcatgctctttaggcagttggagcacctatgatatgcagatcaatgacattgccctacaagcttccattacactgacgctgaagtataccaagtacctgcctcacagttcaggccggtatgcgccaaacgcttctcagagctcagtgtccattgtggcagctcctcactgacttca

SEQ ID NO: 691114 - DNA, 426 bp, Homo sapiens
gattgctcccaacaaacaggtgcttcatataatgagcactttaccttattctcaatgacttctttgcaagcatatggcaaaatacagtcctttggttttagaccccaactgtaaaatggcacaaaaataaagattccaacaaccatcttagtctaaattttcaggtaatcatatagtacatgtatccaaacgaaactgtcttaaatatattccccccaaccctaaagaattaggagggtcatcaaatacttccactggtcatgttgatgacctcaaaagaatggtcgagcacagaaccctaagtccctgcagtatgtaaaaactgcttagatgaaacatttgctatctatccactgaagccagaatggaagattatagcagtcttcctcaaaggaaatcccaccaccaccaattccccagggggca

SEQ ID NO: 691115 - DNA, 347 bp, Homo sapiens
tagattctttgcagtggtaggtgatgtactagggaggcctcgagtgagacatcaggcgcaggaaggtcaagcaggatagccacatcggcagggtcggagccctggccgccatactcgaactggaatccatcggtcatgctctcgccgaaccagacatgcctcttgtccttggggttcttgctgatgtaccagttcttctgggccacactgggctgagtggggtacacgcaggtctcaccagtctccatgttgcagaagactttgatggcatccaggttgcagccttggttggggtcaatccagtactctccactcttccagtcagagtggcacatcttgaggtcacg

SEQ ID NO: 691116 - DNA, 1017 bp, Homo sapiens
cgactcttatcttgtcggggacggtaagcgggacccggtgtctgctcctgtcgccttctgcctcctaactccctacaccactatgtcgctgagtgcatctcgcatcacacgtagggcagcgctggtgtccagattgaccttgcctgctgggagctctactgctctgtgcaacacggtcatcccgagcccgatggccacgtatgccgaatgtgaacaacgacgcatttgtgggagagcgagaatgacctgccctttcatagcacccttcttacagtgtgacgacggggcgactgggcggatacacggtgcccccggagctgtgctttgtaaacttggagcccagagtcagttgatgaagttcgcacgtggcagcctaccggtcagtatcattcgcacccgtgaggcagcatcaatcacagggcgaggaagaatgcctgtcagataactatgcccgagggtactacaccgatttgagcaaggaagatcattgacctgtgtgtatggaccggaaatctcgcaatggctggctgaaccacgtagcaaccagggtacttcagtggcatatcctatgagttctgcagagcttagagtgggcgtgaacctcggtgtcgtaggcgtttcaccgtccctgactcgtggtaagcggtcgtctcatgtgtgagttcattgggaaagaaagtacccagacgcctggaagtgctccattgtacccgagcaaccgccagtgtttacccacagctggtaggttggagaccacttataacctcacaatgctgtcaccaaactgcaactggccctgggagcagctctgatcgtgccttcatggtagagcactgaggccatctgctgtacctcctgtccggagaacctcgatatcgaaacgccaaactgaaagttaagcttgaccggcttataaagccgattgtgactccaacgggggttcccagagatttgagggagcctatgttgcttaaaagtcgacaacggggtcccacccataaacctttgggaaaagcg

SEQ ID NO: 691117 - DNA, 508 bp, Homo sapiens
agccaggggttgacaggttgttgatttgattaggttgaatgggttgtcttgctgccaaataatgctctgctatatgcttctatgcaaaggaacatctctttgtttgctctttttgttgtcttatttcagatggtcggatatgcattaaggtacacgtcatttcataatgttctgacttgacagaaatgaatatgatgatatgcagtatataaccacatagtcaatgtacagtgcagactgacgcatgcaaacttacagtaggtacgcaaaaaatgaggttggagctgatttacaactgtttctgtcgtttaacccgcataagctgaattcacacactaatgacaattctcagtttaaaaaacgcatttatttattgtctgaagtgtctttttttaagctaacttgatttgttcaggatattctgtaatattctgaccatttgtttgacattttgttgttatacttcatcatgtaacactttattgctaataaactacttttcatttga

SEQ ID NO: 691118 - DNA, 1137 bp, Homo sapiens
gtcgcgtatgcacctcgctgctccagcctctggggcgcattccaaccttccagcctgcgagctgcggagcaaacaaaaattcacttcattattcattgcaccccatcaccatcaccttgcaggcgcagccaaagaacaattcacacattttcaaccatgcagggcaacatcgtgcacatcccaggctggtcagtgtggcaaccagcatcggtgccaagttctgggaggtgatcagtgatgaacatggcatcgaccaccaccggacacctaccacggggacagcgaactgcagcgtggacacgaatctcatgtgtacatacaactgaagccacaggtggcaaatatgtaccatcgatgaccatccatggatggatcatagaacactggagaccactggaactcatgatacgactcagagatccatattagagcacagacatctaaagaacccaggacaaccattagatactgaggatcagaacatggaagacaaggataacaaactggagccaaaaggccaaatacacaagaggagcagacacagaagactgaggacgacaacaggaccctgagacatgatgcgctaccgcgcaaaggaaggaccgcagacagctgaagaaatgcacattgaccagagacaaaccagacatgaacacacatcaacaatgagacagagaagacacacaggaggactactgagaactaggggcaaatactccccttagtaccagcaaagaatccacagaaagcaataacaccatggaatcgacatcaagagaaatacacattaccaaaggaaggaagacccatctcaaaacacaaaaaggaggtcatgaaacacaccggtagcataccaaagccccagtacaaatagtcagatcccgttcaataaccgggcatccactagtacccaaggattgagagaaatcacgaaaacatctcttgaagaagtaagaaacactacaattggaccaatttagtgacaaaacaaaaaggagacccactctgaagccagtacactaggaataccctccaaaaacactggagtaagctttaagacaaatacaggaataacgataaagggaggagaaattcttaaacacgaacattttgatattatagcagatgacccgagta

SEQ ID NO: 691119 - DNA, 590 bp, Homo sapiens
cggcacgaggaatccccaggaaagaagaggcatttcataacggaaacactaacagatacgatcactccgagccgctctccaaggcgtcctcatcgttaaatcaacaccaggggttgtgagcgggcaattgtgcccctctgacacccccgctcttccgcagactcgggctccaatccccgcgcgaggagtccctcgagactagccagctcttcctcgagacttcggaagctgggaaatccctgggccagggaaccagggagctcaagccccctcccctttcctgaaaattaatgaattggccgtctgattgtttatttaatgaggtgtgtagtggcctctactggtgctagtgtgagcacaagaatgtcccactcttacaagtgggatgagcctgggggaggggagagaggcgaggggtgaacctgcctccaggtacaaagctgggaactagacccctgcgcccccgacctgccccccgcagccgccccttccccggtggcgccccctctcgcccttctcctccccaccacgcgcgatcccctttctcttcggcaaccggagccgaggcagagaagttcctgcacgtttcc

SEQ ID NO: 691120 - DNA, 324 bp, Homo sapiens
aatccccctcctatctgaatcagatataagtgacaaggcccaagacacattccccaggaggtctgagaacacgtacccaaggtggttggttacagcttgattttatacattttagggggacagaagcttcaatcagacatcaatcaatacatgtaagatgcgcattgcttcggtctgaagagttggaacaactcaaagtgcaggcttcaaggtcataagtggattcagagattttctgattggcaattggttgaaagagttaagtaattatctaaagacctagaatcaataaatagaaaggagtatctggattcagataggagg

SEQ ID NO: 691121 - DNA, 614 bp, Homo sapiens
  misc_feature (141)..(141): n is a, c, g, or t
  misc_feature (522)..(522): n is a, c, g, or t
tagaaacaggtcgggaggaagtatgaggcatggcatgactactaaggaagagcagctattctgtctggggcttctctgcttctaggaggaaagtttggaatttttggctggggagaagggagtggagaattttatccagcnaatcccaacctttacacttatcactagcctcacaggcacaagggcaggacagggcaggacaagtagcacctgtttttgccatccctgcctcctttccctacctttctggccagtctggtgtattccaagggccttcaagtaccggatactcgtgcttttatccttgggattagaggggttcttctttgtctgtcgcaagaccttggagaaggccagcttcatgtgctggtccactgtcttcaataggaagtacctggatcacaagtaaaatgcaaggcagagggaggggtgccgggaggataccatgactcatcctctgcccactggtgcttcagaggagccctgcccacattcccaagatctgggcaggcccgtacccangcgtgtccgtgcaggaaccacatcagatggatggtaggggtctggcaagggtgtttgcctcactggttacctaataacatcagacatagtgt

SEQ ID NO: 691122 - DNA, 108 bp, Homo sapiens
aatagagccagcccgacttaatcagtagggagcagaatgacaagacctattgtcaaccttgctatcaataagctcttcccacatgtaatgccaacatgatcgggaact

SEQ ID NO: 691123 - DNA, 236 bp, Homo sapiens
tataggcgctaggtccaattcggaagaaatgttacaactaaacaacaaaaagattaaaatatgggtaaaggacttagacatttctctaaagatatacaaatagtcaacaagcacatgaaaagatatttagcatccttacttattagagaaatgcaaatcaagaccacagtgaggtaccacatcatacctacaaggataactataatttttttttggagatggagtctcactctgtc

SEQ ID NO: 691124 - DNA, 611 bp, Homo sapiens
  misc_feature (467)..(467): n is a, c, g, or t
actttatagtcttctttctaacaacatctcagctctggcaatgtcagcagcactcatgctggaaggaataacctctactctgagaaaggctttcaactcgtacacgtatatcttctgtcacggttctgtaactgctgtggggtgctaggcatctccattttcaatacttcattagcaactgtttcaatgctgtccaaatcagcactatcgctgtgtcaaaatagtcctgaatagcttgattagatttctcagctccctcattgctcttgtccatttttttctttggtagcatttgtcttcaacagaatgtcttcagcactttgtttagcctcatctgccctcagttttgcttcagagaccatcttggagagctgttccacttcagccagggcactcaggacatcttggtccaagtccatggctttctgccaggcgttgtgtgcaacagctaaccagaacaccacagncaggccccccacacttcctctctccttcgtcagttctgcagtttggcccgccacattcagtctcggaacaggaggccctgggggtgtccacaggtcatttcggcagcggtgaaaggctaggtttgtagttgctgcagtcatcag

SEQ ID NO: 691125 - DNA, 612 bp, Homo sapiens
  misc_feature (449)..(449): n is a, c, g, or t
  misc_feature (469)..(469): n is a, c, g, or t
  misc_feature (509)..(509): n is a, c, g, or t
attagctcttcctgctctccctcatggcgcatgatcagtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtcccctgcacagttcgaggggccaaggcagaagaaatcttggagaagggtctaaaggtgcgggagtatgagttaagaaaaaacaacttttcagatactggaaactttggttttgggatccaggaacacatcgatttgggtatcaaatatgaccccagcattggtatttacggcctggacttttatgtggtgctgggtaggccaggtttcagcattcgcanacaaaaagcgcaggacaggntgcattggggcccaacccagaatcagcaaaaaggaggccntgcgctggttccagcaaaagtatgatggggtcatccttcctggcaaataaattcccgtttttatcccaaaaagcaataaaaagttttcagtggaaaaaaaaaa

SEQ ID NO: 691126 - DNA, 1159 bp, Homo sapiens
  misc_feature (4)..(4): n is a, c, g, or t
  misc_feature (101)..(101): n is a, c, g, or t
  misc_feature (151)..(151): n is a, c, g, or t
  misc_feature (155)..(155): n is a, c, g, or t
  misc_feature (218)..(218): n is a, c, g, or t
  misc_feature (310)..(310): n is a, c, g, or t
  misc_feature (368)..(368): n is a, c, g, or t
  misc_feature (378)..(378): n is a, c, g, or t
  misc_feature (500)..(500): n is a, c, g, or t
  misc_feature (540)..(540): n is a, c, g, or t
  misc_feature (544)..(548): n is a, c, g, or t
  misc_feature (551)..(551): n is a, c, g, or t
  misc_feature (559)..(559): n is a, c, g, or t
  misc_feature (562)..(562): n is a, c, g, or t
  misc_feature (564)..(564): n is a, c, g, or t
  misc_feature (566)..(566): n is a, c, g, or t
  misc_feature (594)..(594): n is a, c, g, or t
  misc_feature (671)..(671): n is a, c, g, or t
  misc_feature (707)..(707): n is a, c, g, or t
  misc_feature (720)..(720): n is a, c, g, or t
  misc_feature (725)..(725): n is a, c, g, or t
  misc_feature (746)..(746): n is a, c, g, or t
  misc_feature (751)..(752): n is a, c, g, or t
  misc_feature (765)..(765): n is a, c, g, or t
  misc_feature (774)..(774): n is a, c, g, or t
  misc_feature (788)..(788): n is a, c, g, or t
  misc_feature (793)..(793): n is a, c, g, or t
  misc_feature (798)..(798): n is a, c, g, or t
  misc_feature (822)..(822): n is a, c, g, or t
  misc_feature (841)..(841): n is a, c, g, or t
  misc_feature (847)..(847): n is a, c, g, or t
  misc_feature (888)..(888): n is a, c, g, or t
  misc_feature (910)..(910): n is a, c, g, or t
  misc_feature (926)..(926): n is a, c, g, or t
  misc_feature (935)..(935): n is a, c, g, or t
  misc_feature (944)..(944): n is a, c, g, or t
  misc_feature (952)..(952): n is a, c, g, or t
  misc_feature (969)..(969): n is a, c, g, or t
  misc_feature (982)..(982): n is a, c, g, or t
  misc_feature (990)..(990): n is a, c, g, or t
  misc_feature (993)..(993): n is a, c, g, or t
  misc_feature (996)..(996): n is a, c, g, or t
  misc_feature (1020)..(1020): n is a, c, g, or t
  misc_feature (1032)..(1032): n is a, c, g, or t
  misc_feature (1039)..(1039): n is a, c, g, or t
  misc_feature (1051)..(1051): n is a, c, g, or t
  misc_feature (1058)..(1058): n is a, c, g, or t
  misc_feature (1065)..(1066): n is a, c, g, or t
  misc_feature (1069)..(1069): n is a, c, g, or t
  misc_feature (1071)..(1071): n is a, c, g, or t
  misc_feature (1076)..(1076): n is a, c, g, or t
  misc_feature (1084)..(1084): n is a, c, g, or t
  misc_feature (1156)..(1156): n is a, c, g, or t
aggntagggtggccttctgccgcaactggtgactgaggaagagtgctctagggacactggccacccccctgctcctgttttcagatctctgctctgggatngggtgcaaccctgtgcttggccgcgatgtggcgagcctcagcatggagcncctngccactgttccccaaagggctcagtggctccatcttcacgaagactttgggccgagaaaaganctggaaggcctcctctacctgcaccagcgtccggtccagcgcagcacggtggctctgggctctcagtgagtttgccccagcaggcagcggtnccagcccacgcagcagcgggctctggctctgtgagctgcttggtcagtgtttccagcngcgggttctnaggcatgcgcgtttgggctgggggcatggcagggtccggctgtgctctgcttgcgggccttgtgcctcccgccgccacagtgcccctgcgctccaacaagttatgtgtgcacatgtgccctnctgctgtgtgcattgtatgtgctcctgtgtgcctgctgcnggcnnnnnctntgcacttngtncnanggccctgccagttaagccgggaatgccnttcgggggggctcttttggtgcagcccgttgcattggtgacgaattgatgtccaccccccagtgcctgtgttccttnagctttcggggaccgtgtgtgggtgttgtgctgggngactatgaaacantgggngtgtgtggggagggccagtgnccgcnngcggggaggttcncccgctggnaagtgtggcatganttctnttccnagagtgcaggggccagggttcctngatgctggggccttgaccngggganttcacctttgttgtactttgggtgagccccaaaaagctttnaggggcctgggctggccctgcncccggctgcgctcctnttctttgangcgcttttnatttttcntgaaccgcctgaggttntccttttcaaggncttaaggnttnttncttttgagaaaggccccaggaccnagggagaccccntcgattngcaacagcccgntcccgangccgcgnnggncngcgcnccagggtntttccggcaccgggaccgaagcaggggcaaaggggagcgggggtttccagggcccgggcggaattaagccantca

SEQ ID NO: 691127 - DNA, 153 bp, Homo sapiens
agcgggtcgcctgcgtcgctccgggagctgccgacggaccggagcgccccgccccgccggcgccgccgcgcgcagcccccaacacaacagaacgctccggcgagaacccacgagcaaacaggcgggacgagacacgccaaagcagcacgaacg

SEQ ID NO: 691128 - DNA, 300 bp, Homo sapiens
ttagtacacttactctgtgccagatactatgagccaaagccacctaagacaaacaaaaaaacaacatacgtgttcctatcacttcaagatcacaatccaggacaggtgcagtggctcacgcctgtaatcccagaactttgggaggccaaggcaggtggatcacttgaggccaggagtttgagaccagcctggccaacatgttgaaacctcgtctctcctaaaaatacaaaagattagccaggtgtggtggcacgtgcctgtaataccagctactcagaggctgaggcaggaaaattgctt

SEQ ID NO: 691129 - DNA, 119 bp, Homo sapiens
gtgacccgcctcacttttcgctggtctcttctgactcgccggacggctggccgacttcccacggtggactccgtgtgggtgactcttggacgcgtgcgtctgctgacgcgacgggggac

SEQ ID NO: 691130 - DNA, 340 bp, Homo sapiens
  misc_feature (119)..(119): n is a, c, g, or t
  misc_feature (199)..(199): n is a, c, g, or t
  misc_feature (230)..(230): n is a, c, g, or t
  misc_feature (234)..(235): n is a, c, g, or t
  misc_feature (237)..(237): n is a, c, g, or t
  misc_feature (239)..(239): n is a, c, g, or t
  misc_feature (244)..(245): n is a, c, g, or t
  misc_feature (249)..(249): n is a, c, g, or t
  misc_feature (265)..(265): n is a, c, g, or t
  misc_feature (278)..(278): n is a, c, g, or t
  misc_feature (284)..(286): n is a, c, g, or t
  misc_feature (301)..(301): n is a, c, g, or t
ctttctgaggaccctgaccactctgttctgttcactgcctgacaaactataggcacttggatattttgtaaataaatagtgagtaaataaattcctcaagacagagttgttttgtcctnccttaaaaattatacctttagaaagctaaaccagttattatactttaaactggcattaagttaaggccttctgctcaggnagttcaaggccattatatgttattctatatncctnngntnccccnncctngggtgaaaaaaatgancccatatggttanctaacnnnttcttaaaacttggnatgtctcaaccatattcaaagttatgtcagtttgaggca

SEQ ID NO: 691131 - DNA, 307 bp, Homo sapiens
  misc_feature (116)..(116): n is a, c, g, or t
  misc_feature (136)..(136): n is a, c, g, or t
  misc_feature (139)..(139): n is a, c, g, or t
  misc_feature (296)..(296): n is a, c, g, or t
  misc_feature (301)..(301): n is a, c, g, or t
ctagaagtgagcactctgagattctcccaagagtctaataaaacccccctccccatcttgggtggatatatgcaagccttgccagatagcagtgagctagtttcatatgactaccntgcctgccgtaggcagctcntcntcgtatacccgtgcaaattgacctgtggatgcccaaggttctgcttatggcagaaaggtccagcaaagcccagctttgtggtacccagacagtgagaagccccaagaaagaagaaactgagagccaaacttagtatttgaggggggaagaatgttanatttnaaaaag

SEQ ID NO: 691132 - DNA, 456 bp, Homo sapiens
ctgtagacaacacgcacaaatgtcacctctaaaggggagggagaagatagaggaacacgtcattaacctctgacctcaagtggctgaaagagagaatgtgatttgggtgtgccatatctttgcattcttcaatgacacttttgtgcatgtgactgatctttctggcaaggaaaccatctggcgtgtgactgtggggatgaaagtgaaggcgcgaccgagaagaatcctcaccatatgctgttatgttggctgtccaagaagtgggccacaagtgcaaggagctgggtattaccgccctatacattaaacttcgggccacaggaggtatgacccagacccctggaactggggcccaatcgggccttagagaccttgtccgctcgggtatgaagatagcgcggattgaggatgtgacccccatatcctctgtaagaactctcagggggggtgcgccgc

SEQ ID NO: 691133 - DNA, 184 bp, Homo sapiens
cgatcagaggatcccgtggtcgagtcactgtactatcttcttttctaatctgccaaatttagcttctctcttcccaaacttacccaaggtgatcaatattcaccatttttttatttcacaagcctaggtatcacacatttcctttgcccacaatcactagaattcaccggaatttccacaggat

SEQ ID NO: 691134 - DNA, 322 bp, Homo sapiens
  misc_feature (98)..(98): n is a, c, g, or t
ccctgtaaaaactgggtaaggagatgtagagacatgggccaagtgctaaatggaggaagagggtgggtggcagggcctaggaagggcagtagccaggntgcccaggagttacgaaatcacctgggccgggaatccgaaaggcgctgcctgatttcagcagcttttttttttttttttggagagggagtctggctctgtcgcccaggctggagtgcaggggcttcatctctgctcagggaaggctcggcctccggggttcacccaacacgcaattctcgggcctcagcctcttgagtagcggggagtacacccgggcgggggg

SEQ ID NO: 691135 - DNA, 641 bp, Homo sapiens
tctcttacgcccaaactccaacatcagaagcttcaactcaacacaaattgcgggcggatccggatggtaaggatgggggctgtggtgaaccaatgttcagttccacaaaggctctgtcgaacgtggagaccatgtgaacggttacttggggagagatgggtggcggagggggagggcgtcagggtgatgtaacccccaaatgaaaggggggtagaagttagcaaaacccaggaaacgtttcaaactggacgtaggttgaggccaatccaccgctgctttcaccaggatccatctggacatttccctcagcgatgatatatcccagaaaggagattgtagagcggtggaacttacacttctcggctttcacgaaagttggttctcgaggaggtgctgaaggacctgtctgacatgaagaacgtgttcttgggcagaccgggaaaaaatcaggatgtcgtcaaggtagatgaacacaaaacggttgagcatgtcccggagcacatcgtttacctggaagacggtatccgaaccaggtggtaggtctagcttggaacaaatggtgaccctctggagaggtcaaaagctgggagagagtgtatggggtaacgattcttaacataatgtattagacccggtggcat

SEQ ID NO: 691136 - DNA, 353 bp, Homo sapiens
gctgagatgctcaagagttagccaccagccacaagtgactattgaatacttgggatggggctagtgtaacaaaggtaataaatttttaattctaatttattttaattaaaaaactgaagtgttatatacttttctgttaaatataagtctattattttggtgggattacagttcacttccactgttgacaatgttctatcttacttgagatgtattataatgtacacagctgattttgaagacttaagaaaaatggatttaatatatctcactaataatttttatgttgattacaagtggaaataaaaatattttggatatgttgcagtaaataaaatgttattaaaattaaa

SEQ ID NO: 691137 - DNA, 105 bp, Homo sapiens
tagtgaaacaggcactggagataaaggtcaggacaggccacgcagaaataagaagagtgaaagttcaccaaaggatagataaacccagtgcgtcacgagaaaacc

SEQ ID NO: 691138 - DNA, 365 bp, Homo sapiens
ccctgcccatcccaggaatctggacactggcgtacttccgtgttaacataacggctttaaaatttttcccgttatgagctttaaagaagtaatttccaaatattggtctttgtggaaaaaatgagaaaagaatcaaggtttccctggtctaagactaaatgtgaaaagtaaagaaaatatagtgagtttttttttttttataaagccaagcttatttaatttggagtatcctttacacagagatgatgctgttcctatatttttgtgttcagctggctttctttaatggaatcatggcctgtgaattaaaattaaaagtattggtttctgaaaccctaaaggctgggaactactgttttaatggc

SEQ ID NO: 691139 - DNA, 445 bp, Homo sapiens
  misc_feature (147)..(147): n is a, c, g, or t
gcgtgatctagaggatcccgggatgaggaagtcactaaaatactcttagaaggatgcaagaaaaaaaatgaataagtatttttgggttcatctatttcatcatttcatttaatttcctcatttcatttcatcctttcatcatttcgntgcatcatttcatttcatcatttcatctcatcatttcatttcattctttcatttcatcatttcatctcaacatttcatttcatcatttcacttcatctcatcatttcatcatttcatctcatgatttcatttcatctcatttcatcttttcatctcatttcatcttttcatctcatttcatcttttcatctcatttcattatttcatcctttcatcatttcattgcatcatttcatctcatcatttcatttcattctttcatttcatttcatcatttcatctcaacatttcatcattt

SEQ ID NO: 691140 - DNA, 1006 bp, Homo sapiens
agcgggcgtactctcctggcccgggttccggaggcttcagtcaagaccctccctcattggccgtagaccccttgtcgcctacccactgtgctctaggatcatgtcatgagcatccctttgcgaagttcgtggcgagatagtccgaagtcgccacttgcgcaggatagctagacatttcagagcaaggcgatttcaatcagcgtctagctactcgtgcaagcttaggaggcacattcacgatcaatcaaagagcctttcgcgtccgcatgaacgtagttcaacgaagcgtactcctcgcttgagcgatcgcgtcagacgttcatgggttgctgtgagccctaggggatcgttgttgagacgaagccataggccaacagcacccatgaggcagtggcataggcagcaagttggagggtccagtaagaaagatgctctctatactgagccaggtggactggcagcagcaatgccaccctcctcgttccaaatagcgacctgcatctggcattggaggcgacgtttaacccagcgaagaaccggttagtgctccttgaaaaggcattccattgaggaggccctattgctaaccttggtggtaggaacccccggaagttaggagccccacgattagcctccttgtagatccgtcgctttgggggtggacatttgcgccatttcgacaagaattcgctctttacgaggtgtcccactgacctcgtttgaataggcgcaatccatggagggaacctgtcgcatgtccttcgttgcaccgaagtctcgtgctccagaaggacgcgcaccatacccttaattggacaggcattacgagttgtgggagtaagcgttcccgagtcgtgccaagttgggtggcaccagtgactgagaaccacccattgacgcttcttttcccttgccccccaagagggccaccggaagagaccgtgaatggtccgggggtcttggttcctcttctttcgttgaattatcgtcctggaaaagggataag

SEQ ID NO: 691141 - DNA, 528 bp, Homo sapiens
  misc_feature (25)..(25): n is a, c, g, or t
  misc_feature (53)..(53): n is a, c, g, or t
  misc_feature (94)..(94): n is a, c, g, or t
  misc_feature (278)..(278): n is a, c, g, or t
  misc_feature (288)..(288): n is a, c, g, or t
cgggggaaaactgatttatggtctnctactaatgctattggttccaattgtgnggacctccgttacgtgcgaaatctcaaattattatagtatnctacctcagagtgcgcagggattaaccgtgtcagtagatgttgttactgttgccatgtgacctgccgttggcgagtgagcccttatacagtacgagccgactccacgggatcactgtccagtcccacattagcagacgtgtgattatcagcaagctcggatgtgtgaccccgagctgatgttcnttcctcccantgaaactgcttacacgcttcctgagagatttccccgagagtccatctagatttttaactgtaatgttcaattatgaatatcaaggttttatccaaaaacaaagcatgagacaggctttggagaggagagttacgatacatttgcaccagcagagagcctcctgatgcaaaaaggtttttcccaacagttggaaaatagctgggccttagaatgaagatcacaaagaaaagcaaatgtgtt

SEQ ID NO: 691142 - DNA, 812 bp, Homo sapiens
acatcacccgggatcaaaagccgggtaaccgaaacttgttgtggaagagccctaggtggatatcaaagctgggcgcgcaccgcagaaattctccgacacgggagagaaccccgtaaaattgtccctatctgtgagaaaagttgccatgcgggagaccaacctgttaatagaatccaagagggtccacgttgaagcaaacccctcatgaatgtccgccacggtggtaaaagttccacctgggcctcgacccttgcaaacttccgaggatcccacttagaaagtaagcccttccaatagcaagtaaccaacctctctttccccattgccatctcccagcccagtcgcaaaaatagtcagctccatcaagagcaatagtgcttaagagtagacccctgtaaatctccttttttctgcattgcaagaggacagaatctggacatggctttgcacatggagaatatcttggattggactgcgcaatggctcagattcttgattctgcctcaggagaaagaatagtcgtcatgtttccactcatccttccgttggacccatcgggcacaaagtctaaattggagatccagttttagaagtgctctctggcaagcatttaatggaattagctgtagtctctgcatatgggaaggtcctcagatcagcccctcaaaatgagttctagagcaggtcttctgttccagaaggggacaagcatatagggcctgtgagctcacgtgtgttctttgtcataggggtggaatactatcttccagtgtcccttgtgtgaaatagacttagcagagtccctttctatc

SEQ ID NO: 691143 - DNA, 584 bp, Homo sapiens
  misc_feature (414)..(414): n is a, c, g, or t
attcgcggccgcgtcgaccccagccacttgcgcacgggtatggtttcagaaactgaacgaggatcgcgcccagcaccagaaggacgacagtttgcatgatgtagggcatgtgcagttcctcagaccttgatgaccagcgtcacgacagagcgctgtgggccaatcccgccatggacctctccctcgatgctgaccagcacgtcacctgcatgcaggttcggcagggcccctttgaggtaccagttgacacctgtcgtcacgactgcacctgaagcccagccaatgagcggcccgcccaacgtacctaccctcccggcaacgccacctgaggccgcagcaattcccttggcgacgttgccgcgcatagtgctgatagcatcggcctgctgccgggtcaggggattggaaatgcanactgtcagcaggcatggcaggtttcgagcctgcattcggtcgtacatatcgacgaccatgctgttgacttggtaatgggcgcgtttcgctttgccaaagtgcagcttgggcaggcgacctcggtcgctttccatgagggggaattgagacagattgaagacaaccctttc

SEQ ID NO: 691144 - DNA, 671 bp, Homo sapiens
tgaaataagcagcctgttgctcacacaaaacctgttggtggtctcttcacagcaacgcgaatgaaattggtgccatcactcggatcaggggacctcccttgggagatcaatcccctgtcctcctgctcttgctccatgagaaagatccacctacgatctctgctcctcagaccaaccagcccaaggaacatctcaccaattttaaatcggatcttctcaggcttagcggctgaagactgatgctgccagatgactttggaagccccctggaccatcacagatgcccagcttgggataactcttacagtggaggaagacaggaatatcaggtctctgagcccaagctaagccatcatatccccgtgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcacctggtgaccgccacgtcctgcctaacagagaacaatccccttgtgactgtaatttcccactagctacccaaatcctataaaacggcccacccctatctccatttcactgactctttttgggactcaggccaactgaaccaggtgaaataaacagct

SEQ ID NO: 691145 - DNA, 800 bp, Homo sapiens
ccactggtgacgtaaaacacgctatataaaaaccagacagttataggatttaagcttggtttgagtagataaaccatgtatcaaagaccaagagagttatagcgatatagtctattagtaaaacctatatcagacagatataggaaggattcttctatagtataaactatatgaaaccaaattataggatttatctttgtttagtaaaaacctgtataaacaaccgaaaaattataggatattgtcttctttttagagagagagattagaaaacgacattaggaatttcactttaaaatgcgcattacaaacttcttaggtgttccaggaattatcaagtgactttaaaatgacttttccaacctgcttagtttaacaaattatattccagttttaatcattgtaaaaaaagcacctggagttcaaaacatgtgaatactaccaagtttctgtccccaaagtcaggcatcactgctagtcttttgggacagatgggacagatgttcactttaatgttttacttgaagttttactgctctttgccatgtggtacaaagaggctgagacatatttaagaattccaagaggatattatgtgtcagaattcagacactgatgagaagtttaaatgtcttgttattggatttggaattcaggtgcactctattcaagtgcaaggatatcagaagtttttgcatcaacaaattttcgagatggagttcactctgtgcccggctggagtgcatgggagttactggaactccacctcctggtcaagcagatctctggctcaggctcca

SEQ ID NO: 691146 - DNA, 214 bp, Homo sapiens
ggtctcagctgctccacatcgctgcaatggatatgatttctttcttttttatggccgcaggtttttcgtttttgtttttgttttttgagacagagttttgccctttcggacaggctggagtgcaatggcatgatcttggctcactgaaacctccaccttctgagttcaagccattctcctgcctcagccttccaaatagctgaggaccatcgtt

SEQ ID NO: 691147 - DNA, 180 bp, Homo sapiens
  misc_feature (161)..(161): n is a, c, g, or t
tttacacagttttgggcccacacccacaacactactgcgtgcttagccattgttcgatccagccgataaaaagaaaaaggcacgcccggcgcccaatcgtccagcttcctcatcattgcccccagcacgccttgtgcgtcatatcaggcgcggcgcccggnattgcttcgcgcaccggca

SEQ ID NO: 691148 - DNA, 1034 bp, Homo sapiens
gcacaaatcgattgagaatagtggccgattcataggagaaaagacatacacatttatttgatcatagttgtacataacagaggagccttcagatgagaatccaaagatacgaagagaaacttcccatttagatgcttaggttcaaagccatggacagccatgtagaaatatgattgaacatgaagggcatgatctaatactgatggactgagtgaagaagcccaggaagacccatcgtgagatacttttggactctctgagcagtgttccttttgatctatggtgatggaataagagctctctggaatggaggtcttatgatctacaatccatgtaaggtggccttttgccccagccacagcatacaatgatggaaatagccaatgtgagttctccagaagtcttagtcctcctgggcttctccgcacgaagcctcactagaaactgtcctcttcagtagtgtcttgagtatttacatggtatcgatcttgggcaatggcatcatcattctggtctcccatacagatgtgcacctccaaaactatgtacttctttcttgccaacctctccttccgtggacatgaagcttcaccacgagcaatgtccacagctccgtgggtaaacctctgggggaaccacagaaaaaccataagctattggagggtgtgtggtccagtactataatctgcccattggctgggggcaaaccgaggtgtgtcctggcctggacaccatggtcctatgacccgcatacgctgaccatcttggacgggcactccatttacactggtcattatgcatccacaggtttgccttgggataagactcggctcctggtggggggctgacaccaagaaggtggggattccaggtacaccatggatcctaacggtgtgtgtggacaatggatcggaccaatctttgggagatgcgcctataatagaacgtgctggtggataccactcatgtgaggagatgtcctgacactggcctggggcggctcggggccaccaggatctaaagaattgccgcag

SEQ ID NO: 691149 - DNA, 144 bp, Homo sapiens
cattcgttgaaggacaccagctgcggaatttgcggctttggcagattgaaatcatggcaggcacaaaagtgatgcgcgataccagttcactggtattaaaaaatatttcagctcttatactctcacaggtagaatgaactgtgt

SEQ ID NO: 691150 - DNA, 260 bp, Homo sapiens
cgggtcctaatcacagggtcgtggggtgatttgggctggcacacgctttgtaaccaccacgggcaaagtctttctgggatcgactggcgcatctccagcaacacgccgggaagattaactttatggccggcctcaatcggcgttccggtcaactccatcaccatcaacgtggcgccattttcatcattctggatcgctcgctgccgggacactgctgggggttgggcagggagctcgccgtcaggcaccacttcctcgac

SEQ ID NO: 691151 - DNA, 912 bp, Homo sapiens
  misc_feature (8)..(8): n is a, c, g, or t
  misc_feature (52)..(52): n is a, c, g, or t
  misc_feature (119)..(119): n is a, c, g, or t
  misc_feature (189)..(189): n is a, c, g, or t
  misc_feature (195)..(195): n is a, c, g, or t
  misc_feature (217)..(217): n is a, c, g, or t
  misc_feature (224)..(224): n is a, c, g, or t
  misc_feature (232)..(232): n is a, c, g, or t
  misc_feature (239)..(239): n is a, c, g, or t
  misc_feature (243)..(243): n is a, c, g, or t
  misc_feature (246)..(246): n is a, c, g, or t
  misc_feature (251)..(251): n is a, c, g, or t
  misc_feature (253)..(253): n is a, c, g, or t
  misc_feature (258)..(258): n is a, c, g, or t
  misc_feature (271)..(271): n is a, c, g, or t
  misc_feature (284)..(284): n is a, c, g, or t
  misc_feature (299)..(299): n is a, c, g, or t
  misc_feature (301)..(302): n is a, c, g, or t
  misc_feature (307)..(307): n is a, c, g, or t
  misc_feature (322)..(322): n is a, c, g, or t
  misc_feature (338)..(338): n is a, c, g, or t
  misc_feature (340)..(340): n is a, c, g, or t
  misc_feature (343)..(343): n is a, c, g, or t
  misc_feature (348)..(349): n is a, c, g, or t
  misc_feature (351)..(351): n is a, c, g, or t
  misc_feature (372)..(372): n is a, c, g, or t
  misc_feature (385)..(385): n is a, c, g, or t
  misc_feature (388)..(388): n is a, c, g, or t
  misc_feature (397)..(397): n is a, c, g, or t
  misc_feature (406)..(406): n is a, c, g, or t
  misc_feature (408)..(409): n is a, c, g, or t
  misc_feature (443)..(443): n is a, c, g, or t
  misc_feature (446)..(446): n is a, c, g, or t
  misc_feature (466)..(466): n is a, c, g, or t
  misc_feature (475)..(475): n is a, c, g, or t
  misc_feature (490)..(491): n is a, c, g, or t
  misc_feature (497)..(497): n is a, c, g, or t
  misc_feature (511)..(511): n is a, c, g, or t
  misc_feature (515)..(515): n is a, c, g, or t
  misc_feature (538)..(539): n is a, c, g, or t
  misc_feature (546)..(546): n is a, c, g, or t
  misc_feature (738)..(738): n is a, c, g, or t
  misc_feature (803)..(803): n is a, c, g, or t
  misc_feature (909)..(909): n is a, c, g, or t
tagggagnttaattctctacttttattatgttctaatacaagtaactttagnatttactgaagttttaacaaataacctaaataaaccaaaacaatgttgagagaaaagtatacatgcnaatgagccaaaagcttaatatttttaaaaccaaatttttaaatacctcagaaactagttatatcaaaagngggagngatcttcaccttcttgccaccnacatccnagataagntatgggnctgnggnggggngnattgngtcccccaaaagntatgtgaaatccnaacacatgggacccngnnaatgngaccttatttggggngaggggctttgcgggngnggngaagnngngggcatattgggtcatggggnactctaatccagngcngggctcccnagaaaaagngnntgggcacgggtacaaacatagaagagaggggagnagnccacttgacaacaaaactgngattggggngaagccactataggnnaagggncagcgggggttgcngggnaccaccaaaagccagggagaggnnagggagnattctttcctagggcctaaggaggaagcatggcactgggacattgtgagtgtggacatttagtctctggaactgttaagagaataaatttctgttgtttaaagccacccagtttgtggtaatttgttctagcacatctaggaaactaatacagagttttttataattaataaaaattaaactcttatttggnatgattttccccccttcataattaaacagtgccctattttacataaaataatttaagtgaaaggnataatatttcatgctaataaaccacatttactcagaaaaacatgaacctttgaaaaaatacaacttaagaaataagctttgttattttaaaattgtagggcttgtnttt

SEQ ID NO: 691152 - DNA, 98 bp, Homo sapiens
ggtggatataccatagtttacagggctgcgcatgttatcagtttgtttcccatactttttttactgttataaaataaccccgtaataaaaaaaaaaaa

SEQ ID NO: 691153 - DNA, 176 bp, Homo sapiens
tagagtatccactctaccacgcatttgttgtttcggactgaggcatgattaagaggacggctgggcatacgtatgcgcgctagagtgacatcttgaccggcgcaagaggacagagcgaaagatttgcaagatgtttcattaatcacgacgaaagtcggaggtccgaagacgatcag

SEQ ID NO: 691154 - DNA, 217 bp, Homo sapiens
atatggactggctgggctacccactacggctctgagttcttcctggggcttgtgtctttccttggccagatacgcgtggcacagccgaggcaacggcggggctgaaggctgcggggccatcccggcctgccagagccatgcccctaactcctcagcttcaaaatcaggggtctcaggacagaggatgctgctactcctgatttccaccttgcaaggt

SEQ ID NO: 691155 - DNA, 141 bp, Homo sapiens
gcccccctttttccccccccctgggccccccaaacaaataccccccccctaaaaggttggtcccccccttttttttttttccccccccccctaagtttggcctttggggggctcccaaaagggtttggtttgccccaatta

SEQ ID NO: 691156 - DNA, 351 bp, Homo sapiens
tcgtgacaggggaggaattgaagtagatagaaaccgacctggattactccggtctgaactcagatcacgtaggacctttaatcgttgaacaaaccgaaccctttaatacgcgtgctgcaccacttgggactgtcctgactccaaccatcgacggtcgtaaacccctacttgattgactactggactctacgacactacggattgcgctgttactccctacgggtacacttgtttccgattggtcaacgttacttggactcaacttgacgtactagtacgttcgcttttgacctggtgacagtcttacgcgtgtacctgctcggacgcgttgggttcctgctcccgaggtcg

SEQ ID NO: 691157 - DNA, 161 bp, Homo sapiens
atttccccaggcaatttgtagaggacctttttagggtcctatatgagccatgtactcaaagcttttaaacctccttgctctcctacaatattcagtacatgacccctgtcattcctggaggcttcttgaaaggggggccagggcccttttcggccacaagg

SEQ ID NO: 691158 - DNA, 607 bp, Homo sapiens
agcggaggaccgcgaggcaagcaccgcggcgacggttccagccaggaaaatgagagcccgctcagagccggcccggagcgctctgacttgcaagcgggctgcgctgcggagcccagtgcccgagtgacacccgctggagagtgcagggccggggaacgcgagccctcggggtgcagctgcaaggcgttgggcagcgcttgcctgcgccgagcgagtctccccttcccggcgctccgccgccccgcgaccccactctaccaccctctcgcaacttgggtcgagtgacaactcccgaggcagaccgcgtggacccgatgccgacctccgcgtgcgcaccccgtcccccggggtgacgagggagccggacggcgcccggtatcccggggacagctcgggcagggcagcagactatggccaatgaagggcagtacagagtagtcgtaactcgcaggctgtcaccgagcacatgcaggcggaagcctggccggccgggcgctgagggacagggccgggcggctgccaggcaggaggcgccgaagccgggtgactgccgaggcgggcaacagcccggggccaccagagcccgagacccgggcagggagtgggc

SEQ ID NO: 691159 - DNA, 271 bp, Homo sapiens
atcgactcggatgctgggggatcctctaaatctagcacgtgctccattgcaacgattgtagggggcgagcgatgtagaacatctgtcaagggaacttgtacagggaggcatgcaccgcagtggtgaatacacgtcgaccaggctccatgtatgcgatatttggacgtcagcacggtgctcatgtatccaaggaacttgtacaggaaggtatgcacggcagtggtgaatacacgtcgagctggaggcatgcatgcatgctcgggtcctggac

SEQ ID NO: 691160 - DNA, 322 bp, Homo sapiens
cagatcggcacgagcacagggctggggattacaggcatgagccacctcgccgggccttacccttatttaaagctgtgaaggctgggaagctggtttcccagacttctggccaagttgggcctgaagcctcagaatacattttctcctggtttttcaaaggggctgggggtttaaatgatcattggtgggtttgtacccatgctactaatgtctggtttctaacaaggacatataaaatttctgggccttacactcacgttgggctttctggtgatctggcatatcagagatggtagctgtcggtagcacggcgctcgtgccg

SEQ ID NO: 691161 - DNA, 485 bp, Homo sapiens
  misc_feature (37)..(37): n is a, c, g, or t
  misc_feature (64)..(64): n is a, c, g, or t
  misc_feature (91)..(91): n is a, c, g, or t
  misc_feature (99)..(99): n is a, c, g, or t
  misc_feature (131)..(131): n is a, c, g, or t
  misc_feature (165)..(165): n is a, c, g, or t
accggcccggtggcttttccctacccaaatccttttnttccccccttcttatcctaatacattnccggcatgttaattctttgccagcatngcccaggngaccccatacacgctgcaaaactgcaaagggncttaggtggccaaactccccagtttcttgttganattttcgagtgcaatttaaagatgttaatttaaaaaactacctgtgctgtagagatcagtaaccctcagggggcagaaaaaaagactgttactgcatcaggttagaaatgtagtacttacctgggcaacatagtgaggcccatctccacaaataactaaaaagttaactggttgtggctgcacatcctgtggccccaagctatttaggaggctgaggcaggaggtttgcctgagccgaggaggttgaggttgaggttgcagtaagctgtaatcacgccactgcactccagcccaagcaacaaaacaagaccttgtcttca

SEQ ID NO: 691162 - DNA, 1519 bp, Homo sapiens
  misc_feature (1039)..(1039): n is a, c, g, or t
cgtgactggcgggtggggttgtcgagcacgttcaagccgttgctgctggctgcgagaaggagagtaggcctgtctcgctctgggtctccaggaccggcgaccgttcctggtcagtcgtcccgaggccgaacgtcattcatccctcgcaccaatgagccatggagcaatccagagaccgtggacaatccatgtgtgaggacgctgagcgacgactagactgggccgacgcctcctcccatcgtgtctccagacaggggccaaggggatcaggcatgggacgagctgtgagcgcatcccgggatagcaccggctgccaacggcacgatcaagctctcatgcctaccttcggaagatcaaacctcatgctacttgtgactgagagtcgtctaaccgtgcggccaggcaaagctgtaccttagtgagctgcatggctcggagccgttgcaactttgcctgctgctctcccgagcaggtcccctggcgacgtaccccctcgtcccctgccatacagcactccccacgcacagcctggacccgcatcgcccacggcaccctgcctgacgcttcgcgaccggcgcgctgccccggcagtgcctccgggcggtcgccctgctcccaagcccacgcacgtagccgcaaccccctggcctcattcgccctgacgagggcagacattggccacccgtccgaagaccggcacgccaacccccttcttatcgcgcggcgccgaagtatgccagtggggcccctcgccacgccactggccttccctctggccctgaaaccgcgtcgactcgttccacttcgctgaccctccacccccacgccgttgacgcccgtcctcttggggcacgcagtcctcgcctttgccctccgcgctggagaatcgcgtccgtcctggcctccgtcccctgtcccttctcgacgctatcgtgcccactgcctttcgcccgtaaccgcccgcctctctggaggtctccatgcgcggactaggctctccaccgtcggcgcctcaacaccggccccggcgccacctctncttccacgacggcgcactcgcccgctgccgacccgcgggctaccaacggcgacgacccacaccacgcaccccactctcacacgtggacgagccccttggcgcgggcttcccccgccggactcgcccctcggccgcgccccccagcgcggcgcccgcgccgcaacacggcgcaacactaccccgcccaccgtgccaccccacgcccttcgacaacgtgccctgcatccaacctccgctctgccgacgaacgtccttcggcccggcgccctggttcggaccaccttccgactgtaccctacaccttgtgcccccgagcgcaaccccttggtctcgcccgggcccctctcgctcccggccccctttcccaaatgcggctcccttctggccttggcacgcgccaacgccgtcggcccgcccttggggcgcctcgcctcactcccaccgcctctgcgcgctagaccttcgcttcgccggcgcctc

SEQ ID NO: 691163 - DNA, 352 bp, Homo sapiens
cagacatcactgtctgggtgatgctgcactgagctgtacagggggagtccgcgcaggggactcttggggctcgggaccatgctgagctttttggcaccacccacagagaacgtggggtccagggtctttctggacctttccagcacatgcagaatgacttcagtggttccattgtgcccttctggcctgtgtacctggttggctttctcagctggcccacacttccctgggctgtgccacttacccacagtggaagtgcccgggatctggactctcttccctttcacctacctgtacacctaacctggccttagactgagctttatttaagaataaaatcgtggtggtggtc

SEQ ID NO: 691164 - DNA, 346 bp, Homo sapiens
ccaagagttcccgaatttacaagtcatatactatacattacactgcagctaagagaagctatgtgctagctagccatcatagaattatttctatgcagcatttaacatagcattaacaacgcatttgaaagcgagttgaatttcttctagaaaagttgagttggctatcttgagatcctatccaaaaaactttgtatattcctaatcccagttatagataaagccttctcaaaggcttttttcaggagcaagtttaacccagttgttgaggcctatatatatagatcacagaaatagaaggattagagcacaaagaagagcagggtagttatatccttcactcgaa

SEQ ID NO: 691165 - DNA, 869 bp, Homo sapiens
gctttcctttaaccaggaggtgcacactacctgcatcctggatgtatcatccaagtgcttttctctgttgccacattttcctcaggttactcaggaaaatgctccagcatgtgcgagacacatgacctgaggttgcatcatagcaccaaaggaatcctcctgtcccctctgggaacattttctgcttcagagggagaggtcactatcgcagctgtctcacaatatccccttgaagggacagcatcagctgccaatacattcacacctttctcttccttcaggaaaatacctatacccacaatgttacctacccccgacatatatcatggccatgatttacggcttctttatcaccatgagagcttcaggttcttctgcagaatggctgcaacttacaattgcattacggcccgacggcacgctctaccatgtgtagctttgtctcctaacgataacatttcgcttagaaaaccacgagtccaaagatctgaccatcggtgaggcagggtttcctccttagacactgacagcattctctgtaccccttacaaatccttatctcctaaaggcagctgaactccgcgacagaacttgcctactgtgagtaaccatacttgggcgagacagcacacaggggcaaggaacccgggagaaacacaacataagcccaacgtgacagccgcacgagataactcggacccccccggaagtgggactggaccgcgaaccgcaggaacagacaaagaaccccaagaggtacatcgatgcacggatagccataacagcacggccaggaacgtgccgacaaggaacactcatctaccacgaccaaggcaacacaactcgcagcaccaaaacacaccaagcac

SEQ ID NO: 691166 - DNA, 944 bp, Homo sapiens
actatactttacaaaccagaaagacattggaacactatacctattattcggtgcatgacacgtggagtcctaggcacagctctaagcctcacttattcagagccgagctgtggccaggcaggcaaccttctagagtaacgagccacatctacaagcgatatcgttacagcccatagcttattgtagataatctgctatcataggtaataccgcagtacaataatctgggaggcattagagcaacgtgagctagtatccgcctaataatcggtgcccccggatatgtgtgattccccggagtaaacaagagtatagcttaccggactacttaccctcgggcctctctctcgtagtcctgctacgtcatctgcgtatagtggaggccggatctggaacaggttgaacagtctagtcctcccttcagcaggtaactactcgcgatcctggagcctctgtacagcgtaaccagcttgctccttagtgctagcaggtgtgtcttctatctgagggggcatcaatttcatcacgaaggaattatcaatgtaaagggccgctgtcgatatcccaatagccagaatgcccgatgttcgtctgatccgtctaatcacagcggtcctacatctggctatgtctcccaggactagtgctgggaacagtatactactgacagacctgcaaggcgttaaaaggtacccattcttcgagcccgacggagggggagacccccaattttataacaacaccgtgagttcatgacaatcgggcaccccggaagttaatatttctgatcctaccaggcgcgggaaaaactcccctattgtattctaatccgggaaaacaaaaaccctgggcacaaagacatggcggggccagcaaacagggggacggggagtgtgggcccatttataaggatactttgcccaatttccccccaatagttcccg

SEQ ID NO: 691167 - DNA, 191 bp, Homo sapiens; identical to SEQ ID NO: 534955

SEQ ID NO: 691168 - DNA, 228 bp, Homo sapiens
cggcatcttcagctttggtcggtcctggcaagcaattgcactggcttgttctctccactgccctttccctctctccttctcctccccctctcttctcttccctccccagcactatcccacctctgtccctccgctttgcagcagcagtgggggctgttgcagggcgcgtcccgtcaccgtacagcctggctggtggtgttgggggtttcctcctaattcttcattttt

SEQ ID NO: 691169 - DNA, 149 bp, Homo sapiens
  misc_feature (17)..(17): n is a, c, g, or t
tctagagcatcccgtangacacaggtgaggacacgtggctttatactaaagtatctatatagattcttctatatagtacagagtggggcaaaacacgcccccatctgctgccttttctattgccctgcaacgtcccatctattacgagg

SEQ ID NO: 691170 - DNA, 160 bp, Homo sapiens
tagaccttgggtttgtcccacctttggactatagtgaataatgtcatatgaacgccagcgcccaaatatctgtttaaatccctgttcaattctttaggtgttatacctagtagtagatcatatggtaatcctatgtttaactttttgagaagacaccaca

SEQ ID NO: 691171 - DNA, 134 bp, Homo sapiens
tactaatctacatgactaacatcttagttcatccaccctcctctccctatgaggctgccctcgctaacggcttattgcccaaatgggccattatcgaaaattcacaaaagacaatagcctcacacacaagctta

SEQ ID NO: 691172 - DNA, 940 bp, Homo sapiens
ctcttgtgcgtacgagggagttcttccgtgattataccgtgaggtgcctctcaatgggcccgtgtgaatcgaactgctatgggcgggtgttcccccccccagcggccgaggggcggagcgcgttttatctttggccccccccccgcccccccccccattgtacagcggcgcgccattcgtcggcgccgcagagttgtgccgccgccccccccatagccagattctctggatggatctgatgcttggggaaaatatgttaaattcaaggaacaggaagggctatcatactggctattatatgggtttcaacacagacatccaaaagaaggaagggctcacattccttaaattaaggagaaatactgcatagaccggccctaatgaccccctaagaccgatcagaccgatctggaatgtgaagcgttatagaagataactgccctcatttcttccgaaatatccagtgttgggaaagaaaaaaggaagtggaatgggtaactcttcttgattaaaagttatgtaatacccaaggccaatgtgaaatattttactggacctcgtattttgaaaaccccatctgtaaaagactggggtgggggtgggagccccacccccggtggtgagcccagttgagaaaatttgaatgtggattagattttgaatgatattggataattattggtaattttatgagctgtgagaagggtgttgtagtttataaaagacttgtctttaatttgccataccttaaggcctttaggaatgaagtgttagagtgtcttaaaatgtttccaatggtttaaccaaatgtatgtgaggcgtatgtggccaaatgttacagaatctaactggtggacctggctgttccttgtactgtttttttctatcttctatatgtttaaaagtatataataaaaatatttaatttttttttaaatta

SEQ ID NO: 691173 - DNA, 278 bp, Homo sapiens
  misc_feature (22)..(22): n is a, c, g, or t
  misc_feature (71)..(71): n is a, c, g, or t
agaggatccccaagcagttaancatgactcagcgatgttggggttgggactgaggagacagtgcgggaggnaaagaaggaagatttgggatgagtcggagtgggaacaggagactagggagggactcactgtgtaaaacaaacgcctggacgtcagggaactacaaaccatttgccccttttacgacaaggattatttagatcttgcaggatggaaaaattgaaagtgctgttttccggctatttggaactactgttgagtctttttaaactgcttag

SEQ ID NO: 691174 - DNA, 292 bp, Homo sapiens
taccccacggactatggggaaattatcccgacgcttaacgtttcattagttactggtttcccagagctgtgatcggtcaataaagatattccgccaaagaccagattcgggtcgctcccatcattgcgcaacgattgagtgcacatggatcacccaagtatctttgatgtgctattcagctgactcattcaggtgagtgtgtctcaatgaaatcactactacaatgggggtcattgttgtcagtggccaatcggtgcaattcagtggtgatgtgattcacatttgtttccaa

SEQ ID NO: 691175 - DNA, 334 bp, Homo sapiens
ccaaaacgtttccctgcgccgcgggctcttactatcccggaatgagtgcgttcaagtaaaaggtctcgttcaaattcagcgactgctgaaattacttgcatcatcatttttcctgttggactggtcaggtcaatgcccccccaatgctaatcaatgcactctgatacctgtttcggtcagttgttccactgttttcctgatatccattgcattacaaccaaggcgatccagttttgtcacaatcaattgatcaccacatttcaggcgagcaagcaaccggttaaaaccaggacgctcactggttgctgctgagccgctaatgtgttcttcgatt

SEQ ID NO: 691176 - DNA, 762 bp, Homo sapiens
gttatgagtaagttgttgatttctaccaaaaagaagcttattggatcttgtttaggattacattagattcatcaattgctttggggaaaatttacattttatgaaattatcccttccaattcatgaaaattgtacaaatccctctttatttaggtatactttaatttctctggaatattttgttttgtctgcaaagctcttgaacatttttgttcaatctaaccctgtaggtttagtatttttgatcatattcaaaataaaactttataaaatttatttttccaattgtttggtgcaggaatatagaaatgaaatagatttttatatattaacccttatcctgagacctgactaaatgcacttcctggttttagtagttttatttcctttgagtttacttgaaaatttttatgtgaataatcatgtcatatgtaaataaagataattttgtttctttgtgttcaagctctgtactttttacatatttttcttcttcttttatgcaatgactaactaggaacttcaaccatgttttctggaaggagtgagtaccgacaatgcttgccctgctcatagatggatagcgtttgatccttcaccattaagagtgatataagtgtaatgtttcttgtaggtttttcatagttgtcctttatgatattgaggaactttccttatatttcaggttttctgatagtttttgatagaattggtactgaatttctaaaatgctttttgtgtgtggtgatcctgttgtcttga

SEQ ID NO: 691177 - DNA, 300 bp, Homo sapiens
gaagggtctcaggttgtggaagcccaagttgagaacaataatgaacaattactgtatgaacaattgttagagacagctaatcacaaacaacctgcgggcacaatgacctcattccacacgtagcacccttcagcaggaccctataaaactttcctccagcccctgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 691178 - DNA, 280 bp, Homo sapiens
ctgcttcggacacaccgtcctcctatgcacccatccacgacgtgcagacagatgcaaagggtactagctgccgttagtcgaatataggattataggtaaagcatagagttgccagagtaccccgcattcccctgcatagcgcctccaaggacagggcggctggggtgtcctttgttgtggttggaggttggtgatcattgctctggataagaggctcccggctgacaccacatgcagctttgcctcacctttctccagcagccgggaccctctggagagc

SEQ ID NO: 691179 - DNA, 908 bp, Homo sapiens
cccgcgcttggcgcataggccggttctaatttacaagaacaccgtggctgaggccggagagtcccttcaacccgggaggcggcggctgcagtgtagccgagacggcgccattgccctccagcctgggcaaaaagagcgaaactcctgtctcaaaaaaaaaaaaactatggccgaaaccaggaagctgcgcgatggctgccacgggcccctctttctcccggccttgtgtccgggaaggtttcccttcctgaagggcagccccggctcacgcaagcggaggagatggcgcgtggacgtgcctggggccggagctcagaggccctgtgggccgcatcatgcatctcccgccaatcgcaagggctggcgcttgacctgaggcctccccgcaaaggtcccccgaggcggcggaggcggcgggctgtgagaaaccgcagaaaaacgctgggcgcgcagggaaccgtccacccccgcgaggagagactttccacagaggcagcgtattccacagcccaagagccacgttcctagggtgatgcaagccccagaaagttcctggcggggcaagctcacggcttgtaagagtgaactctacggtccagaccgggctgcacgaagggcagcgagggcactgcagagcctgcctgccccggacgcggtcaaatctgatacaaggttcgcccagacccaagtctagccctctgggggaaatctccaacattatgtccaagccccgaaaccagacggtgcgtcataccactccccattgagacaatcacatgtgcctagcgcctttacagagaacacatgcttaacagactagggcaaaactggttaggatactgctcctgacggacaaggtggaaaatttggaattcagggatagactgcggcacaacgctcttacgcct

SEQ ID NO: 691180 - DNA, 279 bp, Homo sapiens
  misc_feature (95)..(95): n is a, c, g, or t
  misc_feature (239)..(239): n is a, c, g, or t
ctagaggatagctaaaggcgagtcgggtaggaggaggcaagtacgaaaaggcagagccaacaggtacaaatcagttgggcctctccccaggcggnaccggaggtgggcacggctgcccatcaaaacaacagaacagaaaaaagcccccaggaccctgaggaccccgttccagtacaaccaggacccacagatggagggagctgtcagaagctgggaggacagagttggcagtgacgggncctcagaagttccaggcaggcagagaagcgaaggtttcaa

SEQ ID NO: 691181 - DNA, 581 bp, Homo sapiens
  misc_feature (88)..(89): n is a, c, g, or t
  misc_feature (93)..(93): n is a, c, g, or t
  misc_feature (368)..(368): n is a, c, g, or t
  misc_feature (567)..(567): n is a, c, g, or t
  misc_feature (574)..(574): n is a, c, g, or t
cctctcctccttggccagaaaccttcagaaggaaacagaaggatgagaaagcctcccttgccaggcccatctcacctcccacaccacnnagtnacacattcataaacagccaagcctgctcacaggcctgggcatatgtggctggggagagactgttgccctatgagatggtggaagacagaaaactcttgaatgaaacatctgtaacaagactcccactccctaatcctggagaccccttcaaaaggagaggactctgctcagcgctgggtcagaaaggaagtgcttgccaaccccagtaatgcgctgtcctggagtaagaggactgagatgccagcgtggggcccgtcaggagtcacgtctcaagngaggggtgacccagatttttgcaaagctgtggaagagacctctaattccatgacctaaagtttcacacaacctttatgcaaatccttcgccatttgtctatcctggccccagcaggatgaccctcacatttaaaaggatcaaaatctcaaacattgtgggaggaaaacgccaggcctgctggggagagggagaaggcangactcangtggtgt

SEQ ID NO: 691182 - DNA, 124 bp, Homo sapiens
acatttttgcagccatgtcgaatctagaccatgccaccagccagatgaaagccttccatggttcggctgggcaaggtggctcatgcctataatcccagtcactttagtgtaggctgagggcggg

SEQ ID NO: 691183 - DNA, 423 bp, Homo sapiens
cagctcggtaccgtgccccctgtggaatgcagtgtgtgatggtgaacaccagatgaaatggtggttattttctttcgacaaggacgagtagtgcttgaatgctttcatatatttcggttgtcattatgtgtcactaagttactggtgcgcatattttaaaatgaagttgttacacttattaagcactacagtgtgccttatacatgtatatgtactgaaatatgacttcagtgactttttggacagaacacaaacttctttcattagaaatttttaaaaaatgacttgggcatttgttgcaggagaaggacttgataatctgtggaatttaaatgttattcatgcttcttattttaaaagtgcttcaaatccttcaataaggttctgaaagcttgtccgattggatggttggtattcccagca

SEQ ID NO: 691184 - DNA, 594 bp, Homo sapiens
cctgaggtcatgcattgtaatcatcatagaaggagagccagcctgcctcaaggtcttcaacataaggtgaaaacaagaagaacccgtcttggaacaatctcaaacaagttggggtgtagcaaaccttttcaacccctttgctggttgctggggctcattctaagaacttgttcttagagcagaatctagcacatcatgggagtgggaccaagcgtgggtcgaaggaagggccagagctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaacaccctgaggtgttagtacctagtggtgaaatggatgaggtcatttctaaggtgtgttgcccgtggatctgggcacaatcattggaattccttggagccactgggattcatggctttgtatccaactgcatccaggcctgaggctgctgacgtttgacaccagggccagtagaga

SEQ ID NO: 691185 - DNA, 958 bp, Homo sapiens
caggcgtccggtctgccacctggttctggctgtgatccatgatgtgcacgattgctctggattgaggcgctggctgtgttggtcactaacttctgcaccagtactcctgccagttagggcgagaagttcgaggctgaggtaagggggaaatgaaggaagttctgcccaaggaggtggccgagactattgtgggggagaaaggtggatgaggaggggctgagagaagctgatgggcgaaccatgtgatgagaacaggggacctagcaggtgtattttcgatggagtatgctgttatccatggtacatccattcacatagtcattgtgcaaatgacattcttccaggggatgcctcgagaccagaaacttgagacagaattcttgaggactccttgtcgatggatcgtcattggggcacagggattgaagggtattggcttttgagtagtagtaattcaagtacatgtttgaatttgttcatgtagcataaataaaaaaaaaacaaaaaaacaaaacacacaaaaacacaaaaaaaaacagaaaaaaacgagacatgggaagacgaacaaagacagaagaaaaaaaagacagcacacacagaagagcagaagaagaacgacaggaggacgcgagcatgagcgagggggacacacggaatcaggcatcgacaataagcacaggcagaggggcgcgcccacacaaaaaagacgacgaaaataacgacacacgacagaaacgcaacaagacagaacaaaatcaaagcacaaggacccgacaagcgacaagacgaggacacaagcgaggagaaacacacgaagcagcgacgcacaaccaatccgcgcgcaacaaccaaaggagcaacacagaaaggacaacaaaacggagacgacagaaagcaaaaaagaaagaggagaagaaggaaacacacgcaaaacaggggaaaggaaggaataaacaaa

SEQ ID NO: 691186 - DNA, 882 bp, Homo sapiens
  misc_feature (162)..(163): n is a, c, g, or t
  misc_feature (173)..(173): n is a, c, g, or t
  misc_feature (186)..(187): n is a, c, g, or t
  misc_feature (199)..(199): n is a, c, g, or t
  misc_feature (204)..(204): n is a, c, g, or t
  misc_feature (210)..(210): n is a, c, g, or t
  misc_feature (214)..(214): n is a, c, g, or t
  misc_feature (221)..(221): n is a, c, g, or t
  misc_feature (224)..(224): n is a, c, g, or t
  misc_feature (230)..(230): n is a, c, g, or t
  misc_feature (232)..(232): n is a, c, g, or t
  misc_feature (238)..(238): n is a, c, g, or t
  misc_feature (244)..(244): n is a, c, g, or t
  misc_feature (251)..(251): n is a, c, g, or t
  misc_feature (255)..(255): n is a, c, g, or t
  misc_feature (269)..(269): n is a, c, g, or t
  misc_feature (276)..(276): n is a, c, g, or t
  misc_feature (279)..(279): n is a, c, g, or t
agagatgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggcttttttttnntttttttttntcaaagcacggcnnagactatgtgtnccagnttgaangtcngccttgnganaacagntnacctanagctcnttgacanctgngacagcgtgacctncaccttnagnaactgcgcgaacagctcggccctgtgaccccagaagttctgggataaccctgaaaaaggagacagagggcctgaggcaggagatgagcaaggatctggaggaagttgaaggccaagttgcagccctaccctggacgacttccagaagaagtggcaggaggagatggagctctaccgccagaaggtggaagcctgcgcgcagagctccaagaggcgcgcgccagaagctgcacgagctgcaagagaagctgacccactgggcgaggaggatcgcgacccgcgcgcccatgtggaccgtcgcacgcatctggccccctacagcgacgagctggcccagcttggccgcgcccttgaggctctcaaggagaacgcggcgccagactggccgagtaccacccaaggccaccgagcattctgagcacgctcagcgagaagccaagcccgcgctcgaggacctccccaaagcctgctgcccgtgctggagagcttcaaggtcagcttcctgagcgctctcgaggagtacactaagaagctcaacacccagtgagggcccgccgccgccccccttcccggtgctcagaataaacgtttccaaagtggaaaa

SEQ ID NO: 691187 - DNA, 1487 bp, Homo sapiens
  misc_feature (135)..(135): n is a, c, g, or t
  misc_feature (161)..(161): n is a, c, g, or t
  misc_feature (168)..(168): n is a, c, g, or t
  misc_feature (172)..(172): n is a, c, g, or t
  misc_feature (181)..(181): n is a, c, g, or t
  misc_feature (198)..(198): n is a, c, g, or t
  misc_feature (207)..(207): n is a, c, g, or t
  misc_feature (215)..(215): n is a, c, g, or t
  misc_feature (226)..(226): n is a, c, g, or t
  misc_feature (239)..(239): n is a, c, g, or t
  misc_feature (248)..(248): n is a, c, g, or t
  misc_feature (275)..(275): n is a, c, g, or t
  misc_feature (326)..(326): n is a, c, g, or t
  misc_feature (368)..(368): n is a, c, g, or t
  misc_feature (1327)..(1327): n is a, c, g, or t
ttgaggccttaatgatttaggaccccgggggccccccttgtaatgggtacaaaacgaaagttgtttccggacctcagtttacttggccaaggaccctcagttttaaacctccaacgagtattacgtccttccacnctgcttccaattccgacaccaagacnactctgnattntgagtatangagtcaagtatggcaanaagtacagnaccttaanaacttttattntagtccttcctgncccatgctnaaagcttatatctagacatacggcaanacaaaatgaaacagatctctccttgtacatatataacagctacaaatttgncctctttattgatcttatgtcatgtatttggcttgaaaaaanaacaatcaacaaaacaaacagttacaagggttaaacaaactaaatttttcttctaaatctctaaatgctcatagacagccaacttgcagggcatacacagtgccttgagagtcggtcccacagaaaatacttatgtaaaatgaaacaagaaggatgctatttgtttttcattacataaacattacctgaacttaactaatcaatccacttatttgataaaaatcatctaggaccaaaagcactatcaagtttgctggctgccattttcactctaatcatacccaaaaggcttagaaataattcaaaactagaaagaggcccaagtagtaaggctacctatggctcttgctacaaaacagttgccagtctgaatgtgtgtgtgtctagaaagaatgatagaaaataaagagttcttgagttcaagagaacttcccagaaggaggtggtggccaagaaatccacctgcctgcttggtggcggctcgtgaaggggcaaggccgagaatcttctgaatgttctgtcgaatcgacatagtacagagaatatacaggaaaatgaaggaacagtctgtggtgtcatctcccagcagatttcgatgagacagtccttggatgtaagaaagaaggggtaaaaggaagctttgccaccactctaccatcaaatatggaattgaacattcccattagggcagtaaaacaaaagccaatagcaaacatggattttcattcgaaccattgatagatctctgttgttattcttcagtttctcttcttggtctctctaatttctctgtttctgttgtcgaaccagctgactctgttattgtttccttcttcgttgttccagagtgttgttactctggtttttccacttctgccttcagtctcttgtacttgtctgtcctgtaaaccaggacccaggttatgccctctgcgagcagagccgtgcacacagagatnaaaacgatgaggagagtgtccgcgaacatagtgctcatctcgcaccttcgtctctgcactctcacccgccagggggaaagcgctctacagccaggaaaagtgaagcgaaaacggcttccgtagactccgccaccaccgagtaacagaccaactccccgct

SEQ ID NO: 691188 - DNA, 529 bp, Homo sapiens
  misc_feature (201)..(201): n is a, c, g, or t
  misc_feature (222)..(222): n is a, c, g, or t
agagatgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggaagctgcacgagctgcaagagaagctgacccactgggcgaggagatgcgcgaccngcgcgccccaatgtggacgcntcgcacgcatctggccccctacagcgacgagctggcccagcttggccgcgcccttgaggctctcaaggagaacgcggcgccagactggccgagtaccacccaaggccaccgagcattctgagcacgctcagcgagaagccaagcccgcgctcgaggacctccccaaagcctgctgcccgtgctggagagcttcaaggtcagcttcctgagcgctctcgaggagtacactaagaagctcaacacccagtgagggcccgccgccgccccccttcccggtgctcagaataaacgtttccaaagtggaaaa

SEQ ID NO: 691189 - DNA, 377 bp, Homo sapiens
  misc_feature (182)..(182): n is a, c, g, or t
  misc_feature (233)..(233): n is a, c, g, or t
  misc_feature (253)..(253): n is a, c, g, or t
  misc_feature (315)..(315): n is a, c, g, or t
  misc_feature (360)..(360): n is a, c, g, or t
gacagagtctcactctgtctcccaggctggagttgcagtggtgcaatgactgcagcacctcctgggcttacagcatcctgcctcagcctcctatatagcagagaacagaggtgcacaccaccagatctggcttattttttgattttttgcagagatgaggtctcactttgttgcccaggctngtctcaaactcctgggctcaagcaatcctcccaccttggcttcccaaagtnctgggattacaggcatgagncactgtgctcagccttcatgttcacttttttaaaatgtatgtatttttttataggagatgtngggtcttcactgtgttcgccagggttgtcttcggaacttctgggnctcaaaggcgataattc

SEQ ID NO: 691190 - DNA, 455 bp, Homo sapiens
gcacgagatgaagcagagagtgagccttctgaatttgctggtgtcttgatcctggacttcccagccaccagaactataagaaatacatttctatcatttataaattacctatgctaaggtattttgttatagcagactaagacaaaaattagtgccaagaactggggtgtggccataacaaacacctaaaactgtagaagtggctttggaactggataatgggcagaggctggaagagttcagaggaacaggctggaaaaagcctcttgagatgaatggaccattaagggtgattctggtgaggaatcagaaaaggagagctatagagaaagcctcacttttcttagagattacctccgtggtcatgaacagaatgttggcacaaatatggatggtaaaggccattataatgaggtatcagataggagtgagggacatgttattggaaactggag

SEQ ID NO: 691191 - DNA, 1034 bp, Homo sapiens
  misc_feature (170)..(170): n is a, c, g, or t
ttgcagacaccataaaaactattgttagggtccttcctggcacacatgctataatcttattgctggacttacggccagacaaacacactcagccgtttcctagtccatataccagcttgaaatgggaggctggttgttgatcttatgtcatgtatttggcttgaaaaaanaacaatcaacaaaacaaacagttacaagggttaaacaaactaaatttttcttctaaatctctaaatgctcatagacagccaacttgcagggcatacacagtgccttgagagtcggtcccacagaaaatacttatgtaaaatgaaacaagaaggatgctatttgtttttcattacataaacattacctgaacttaactaatcaatccacttatttgataaaaatcatctaggaccaaaagcactatcaagtttgctggctgccattttcactctaatcatacccaaaaggcttagaaataattcaaaactagaaagaggcccaagagagggcctgaggcaggagatgagcaaggatctggaggaagttgaaggccaagttgcagccctaccctggacgacttccagaagaagtggcaggaggagatggagctctaccgccagaaggtggaagcctgcgcgcagagctccaagaggcgcgcgccagaagctgcacgagctgcaagagaagctgacccactgggcgaggaggatcgcgacccgcgcgcccatgtggaccgtcgcacgcatctggccccctacagcgacgagctggcccagcttggccgcgcccttgaggctctcaaggagaacgcggcgccagactggccgagtaccacccaaggccaccgagcattctgagcacgctcagcgagaagccaagcccgcgctcgaggacctccccaaagcctgctgcccgtgctggagagcttcaaggtcagcttcctgagcgctctcgaggagtacactaagaagctcaacacccagtgagggcccgccgccgccccccttcccggtgctcagaataaacgtttccaaagtggaaaa

SEQ ID NO: 691192 - DNA, 740 bp, Homo sapiens
agcggagctgccacatttgcaaggagtagagatggtctccagctcagctgagatcccccagtcttaggttaaggctgcagcccagcctcatggagtagaagagagagcagaggaagccagagagcccctcaggccagtgggaggaggaggagaaagatgggcaaggggctgggcctgccccaggagggcctcagtggggagaaggtggaagaggagagaaccttgagttctccagtactagagcttttattctgcagtgagagagttgatagtatagcagttacagccagtcttctcctttgacaggcagggaaactgaggccaggagaggtagggcccagcaagttggcacctgggcctgatctgcctttcagctccatctagccagaaaccagcactctccttctcccactggcccgggtcgaccccagggctcatcccggagccttctcccactctgtcgccggtcgtctcgatgattttcatctcatcgccacggaggcgttcccaggttggcggaggggtccagtctgccgactgccggttgaccgtccgtttgctgtggtggcttgcccggaccctcggagtgcgtgcgtgtgtgcattggtactgtttgcacatgtgtgcgtgtgcgtgtatgcgtgcgtgtgccaggcacaggactgcggtgcacgactggcttttcttcctcccgcaggagctgaccgagaagcccggccactgtgtgcccggcccggggg

SEQ ID NO: 691193 - DNA, 990 bp, Homo sapiens
ggttgcagagaagttcgccattgccaccaaggaaggtgatttgccccaggtggagcgcttcttcaagatcttcccactgctgggttgcatgaggagggattaagaaagttctcggagtacctttgcaagcaggtggccagctaaagctgaggagaatctgctcatggctgctggggacatgacatgagtgatcggatggagcgtgccagtcatcgtttgcagatacgacttacgtcttcgtgtttgaatgggattgcccgcattgtggagacccaccagccaatagtggagacctattatgggccaggagactctataacctgatcaaatatctgcaggtggaatgtgacagacaggtggagaaggtggtagacaagttcattcattgcaaagggagtacaactagtaggttgcggcatgtgcatgaacaaactgatgagaaattctacatagcagtaaacaaaatcggaaaccaagagaatctggatgcgccatcctgaacgtgaggtcatcctgatgaatgcgccgccatggtgagctatacttacgcttcctcgaagaagaggatgagctctgatttgaggtgggagactccatggcctcagaggaagtagaggaagagcgccagaagtgtctggacatactcctcaataaatgcctgtgagctgtaccatgcaagaactaatcgggtatatgtttaccaaggaggagtcacttcatgaggtagactgtccaataagctgtgtttctggagcactgtgggtacggccggttgactcccagctggggatgcggcgtccgtgctcgaagtgctggggggaccgccgagcacagatgaagctcttgcgcctaacacccgccccacggcgggtgctccggatccgcaaggccggggcacacgacacctccgacacagccgggaaaccgacactaccgccagaattcacgtgatatcagagagactcactcacgaggaaacacaagaggccg

SEQ ID NO: 691194 - DNA, 853 bp, Homo sapiens
  misc_feature (162)..(163): n is a, c, g, or t
  misc_feature (173)..(173): n is a, c, g, or t
  misc_feature (186)..(187): n is a, c, g, or t
  misc_feature (199)..(199): n is a, c, g, or t
  misc_feature (204)..(204): n is a, c, g, or t
  misc_feature (210)..(210): n is a, c, g, or t
  misc_feature (214)..(214): n is a, c, g, or t
  misc_feature (221)..(221): n is a, c, g, or t
  misc_feature (224)..(224): n is a, c, g, or t
  misc_feature (230)..(230): n is a, c, g, or t
  misc_feature (232)..(232): n is a, c, g, or t
  misc_feature (238)..(238): n is a, c, g, or t
  misc_feature (244)..(244): n is a, c, g, or t
  misc_feature (251)..(251): n is a, c, g, or t
  misc_feature (255)..(255): n is a, c, g, or t
  misc_feature (269)..(269): n is a, c, g, or t
  misc_feature (276)..(276): n is a, c, g, or t
  misc_feature (279)..(279): n is a, c, g, or t
agagatgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggcttttttttnntttttttttntcaaagcacggcnnagactatgtgtnccagnttgaangtcngccttgnganaacagntnacctanagctcnttgacanctgngacagcgtgacctncaccttnagnaactgcgcgaacagctcggccctgtgaccccagaagttctgggataaccctgaaaaaggagacagagggcctgaggcaggagatgagcaaggatctggaggaagttgaaggccaagttgcagccctaccctggacgacttccagaagaagtggcaggaggagatggagctctaccgccagaaggtggaagcctgcgcgcagagctccaagaggcgcgcgccagaagctgcacgagctgcaagagaagctgacccactgggcgaggagtcgcacgcatctggccccctacagcgacgagctggcccagcttggccgcgcccttgaggctctcaaggagaacgcggcgccagactggccgagtaccacccaaggccaccgagcattctgagcacgctcagcgagaagccaagcccgcgctcgaggacctccccaaagcctgctgcccgtgctggagagcttcaaggtcagcttcctgagcgctctcgaggagtacactaagaagctcaacacccagtgagggcccgccgccgccccccttcccggtgctcagaataaacgtttccaaagtggaaaa

SEQ ID NO: 691195 - DNA, 130 bp, Homo sapiens
aattatgggaagagggatactggccttcggcctcctatgatgcagacattgtgaatttaattcaaggaggaggagaatgtttataggcaggtggttatatgtgggaagataatttatattcatgagatcc

SEQ ID NO: 691196 - DNA, 1043 bp, Homo sapiens
  misc_feature (170)..(170): n is a, c, g, or t
ttgcagacaccataaaaactattgttagggtccttcctggcacacatgctataatcttattgctggacttacggccagacaaacacactcagccgtttcctagtccatataccagcttgaaatgggaggctggttgttgatcttatgtcatgtatttggcttgaaaaaanaacaatcaacaaaacaaacagttacaagggttaaacaaactaaatttttcttctaaatctctaaatgctcatagacagccaacttgcagggcatacacagtgccttgagagtcggtcccacagaaaatacttatgtaaaatgaaacaagaaggatgctatttgtttttcattacataaacattacctgaacttaactaatcaatccacttatttgataaaaatcatctaggaccaaaagcactatcaagtttgctggctgccattttcactctaatcatacccaaaaggcttagaaataattcaaaactagaaagaggcccaagagagggcctgaggcaggagatgagcaaggatctggaggaagttgaaggccaagttgcagccctaccctggacgacttccagaagaagtggcaggaggagatggagctctaccgccagaaggtggaagcctgcgcgcagagctccaagaggcgcgcgccagaagctgcacgagctgcaagagaagctgacccactgggcgaggagatgcgcgaccgcgcagcagcagcccaatgtggacgcgctcgcacgcatctggccccctacagcgacgagctggcccagcttggccgcgcccttgaggctctcaaggagaacgcggcgccagactggccgagtaccacccaaggccaccgagcattctgagcacgctcagcgagaagccaagcccgcgctcgaggacctccccaaagcctgctgcccgtgctggagagcttcaaggtcagcttcctgagcgctctcgaggagtacactaagaagctcaacacccagtgagggcccgccgccgccccccttcccggtgctcagaataaacgtttccaaagtggaaaa

SEQ ID NO: 691197 - DNA, 846 bp, Homo sapiens
  misc_feature (162)..(163): n is a, c, g, or t
  misc_feature (173)..(173): n is a, c, g, or t
  misc_feature (186)..(187): n is a, c, g, or t
  misc_feature (199)..(199): n is a, c, g, or t
  misc_feature (204)..(204): n is a, c, g, or t
  misc_feature (210)..(210): n is a, c, g, or t
  misc_feature (214)..(214): n is a, c, g, or t
  misc_feature (221)..(221): n is a, c, g, or t
  misc_feature (224)..(224): n is a, c, g, or t
  misc_feature (230)..(230): n is a, c, g, or t
  misc_feature (232)..(232): n is a, c, g, or t
  misc_feature (238)..(238): n is a, c, g, or t
  misc_feature (244)..(244): n is a, c, g, or t
  misc_feature (251)..(251): n is a, c, g, or t
  misc_feature (255)..(255): n is a, c, g, or t
  misc_feature (269)..(269): n is a, c, g, or t
  misc_feature (276)..(276): n is a, c, g, or t
  misc_feature (279)..(279): n is a, c, g, or t
agagatgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggcttttttttnntttttttttntcaaagcacggcnnagactatgtgtnccagnttgaangtcngccttgnganaacagntnacctanagctcnttgacanctgngacagcgtgacctncaccttnagnaactgcgcgaacagctcggccctgtgaccccagaagttctgggataaccctgaaaaaggagacgaaggccaagttgcagccctaccctggacgacttccagaagaagtggcaggaggagatggagctctaccgccagaaggtggaagcctgcgcgcagagctccaagaggcgcgcgccagaagctgcacgagctgcaagagaagctgacccactgggcgaggagatacgcgagcgcgcgcgcgcccatgtggacacgctgtcgcacgcatctggccccctacagcgacgagctggcccagcttggccgcgcccttgaggctctcaaggagaacgcggcgccagactggccgagtaccacccaaggccaccgagcattctgagcacgctcagcgagaagccaagcccgcgctcgaggacctccccaaagcctgctgcccgtgctggagagcttcaaggtcagcttcctgagcgctctcgaggagtacactaagaagctcaacacccagtgagggcccgccgccgccccccttcccggtgctcagaataaacgtttccaaagtggaaaa

SEQ ID NO: 691198 - DNA, 862 bp, Homo sapiens
tggctgtaacagtgtttatggatgataattccaggctcttgttgaaccctgtgggggggaggggcacaaagcgaaatggggcgtataagggaagtgctggaaaggcgtgcctccgatgaaagtgctcggctcgaagcttccagaacataggcaagggcagggttgaggccttcgggcacacgagccggcgcccagttccaccgcggcccaaagtggagggcggccggcgccctgtgctacgaggcctttttgtccaaagtggtggctctccaacactctccacgcccacaatctcgttcacgtggagaactctcagaggggccgtctctcccaaaaactctcccaaaccagagtgtgtcacatgtgcactttgagtgtgccacaattataaattctcagaagaggcgacagcgggggacacacacagagacagtctcgtgtggcgaggcccttctgggcacactctctctctcgaaaaaaaacaaagagggacaacagacacgagcgaaaagacgtctctcaagacaacaacactaagagacacacacctagaagagtggacatgtgaacaccaaacaaacaagacaaaaccgaggggcggaccgcggtgtgggagagggagagcagacaaccgggggaggctactacaatcttcccacccggacagtgggagcacggaggacagcactcacaaaccgcacctacctggagcagagacaataaccagaacgtgggagtagaggcagagaggcacagatggagaggtaggagcaacacaaaaacaccgggcaccaccacgccaccagcacgaggaagaggggagagacggcccaccacagagcaaagaaaaagagtagggaaa

SEQ ID NO: 691199 - DNA, 218 bp, Homo sapiens
cgcgtacagttgcgggacgtggagggaagcaaagaattctacacttgggaggcttggatgatcttgttggaggatagaaaaggttcccaaagttagccgggtgcgagtggagtgtggacgaccagtgtgaggggtccacacaaaagtatttctttaatctaagttccagtgccattgtgatgaattcttttccggcggggggaattggatatggcggg

SEQ ID NO: 691200 - DNA, 715 bp, Homo sapiens
  misc_feature (101)..(101): n is a, c, g, or t
  misc_feature (112)..(112): n is a, c, g, or t
  misc_feature (136)..(136): n is a, c, g, or t
  misc_feature (222)..(223): n is a, c, g, or t
  misc_feature (226)..(227): n is a, c, g, or t
  misc_feature (481)..(481): n is a, c, g, or t
  misc_feature (630)..(630): n is a, c, g, or t
  misc_feature (645)..(645): n is a, c, g, or t
atcagagatcctcaactacagcaggtatccaagtattcatccttctggccaaagaaactggctacaattctgattctaagagaaaaccttcatgcagccgngaaactcaggnctctggaggggagagccttactcngatactttccacatgcactgcccactgggctgtagtttaaaaccatccaaaaccatcacatggatggctagggacaggactgggcnnccnnataacacaatgaactcagctcaccatgctaagaagactgcctctttccaggcaagattttactggagcaacataaccggagggtgtgattccaaaataccttcctttccaagccccgggttgtggataaggtctggattttggttatatgactaagggcgacagaggctgctggcatctctgggcaccgtcccagtggcttagggttggaggcttcactggcaaaacaatggcactgtttaactagctcgtgtnaaccattcatctacagcaagtagaatcatcagttttgcactgagcaaggaagcacatgggtctcctatgagagctaatgccagaattcacatgctttgtaaaatataggatgaggtttctttctttcttctgccccctccagaggccanatgggtagggtggtncctttgccttctgagtgctggatgtcccagcctcacaagacctgctaagaactggcgtgtgcaagcttgg

SEQ ID NO: 691201 - DNA, 191 bp, Homo sapiens
  misc_feature (38)..(38): n is a, c, g, or t
  misc_feature (40)..(40): n is a, c, g, or t
ttgcctaacctgactgacatatatttgaatactgcggntntctttctttttttttctatttgctgcccttcctggaggcagcgagggccagaattcaactgattgttcccctgccaagccaccaagggaagctgataagctgcttagacccctcggtcctgcttgtagggtcttcctgatttgcaacagat

SEQ ID NO: 691202 - DNA, 822 bp, Homo sapiens
gactagtactagatcgcgagggccgcccttattctattttttctgttgtcacagaacaccaatttgattcatacaatatcaagaacctaccgggctgtttatgggccatgcatatgcctacaggtctagtgtggaaatagtatgctgatcatcatttccgtactttcgtgaccattctctacaatattcagcagtgctggccgacatcgcaaagcatgagtcccttggctctaaactccgttaccgataaggagattacagaatcctgtgtttggtactccaggaagtctggcattatcacaaggatgcttgcgaaacggaggtaacacatctcacaggcaaatttcaggtaatctcatcctggaggcagctgcctactctgcagctgtggttcttccgaccagagaagaagagagaacaatgggaggagaagattggatgttgctgcatggttctgagaaagaggctttcagttcctaggaagcatctgtcggagcctgctccatgggccaatagcagccctttttctccatgagctggctggtgggttcccccctcccggatagcgcctccttccagaaagcaggtgtggtcagcctgttccaccaggctgaggtgctgggtgatgagaagcactgagcgggagtaccggtcagggctttcgtacaggagctgctccacctgtacactggctgtgggcatccagggcactggtggcatcgaccccggataagtacacacggtatccggactcaatgctcgggccaacgccattgcctgtcgctgaccccctgacagctggctcccagccttcgtctaacc

SEQ ID NO: 691203 - DNA, 184 bp, Homo sapiens
  misc_feature (83)..(83): n is a, c, g, or t
  misc_feature (131)..(131): n is a, c, g, or t
  misc_feature (159)..(159): n is a, c, g, or t
tggatgccagtaatctaaagggtgatagtctgtattgtgccatttagttctggattatgttttgtcttaatactatgtctgantaccctttggactacattacctgtttgaaaatagctgttatgtgtttnctttttcatatagcattggtcgattttngtgtaaaacatggagtttctccaac

SEQ ID NO: 691204 - DNA, 394 bp, Homo sapiens
caggtgagccgagatcgcgccactgcacttccagcctgggcgccagagggagactttgtctcaaaaaaaaaaaaaaaaaaaagaaaaaaacagtttaccattctatcagaaaatgttgaccaccctcatatttttggtaaactgcagtaatttttccttaatactttttgcaagcttttgcatgcataagctccagtatcacacttaattttgcttgcttgctctctgaaggggagttcgggatgaccgttacaggcaaagtgggatttttgcgtcccaaaggtggattaagcccaaatttccaggggtttttccccagtttttcttccgtaggggcttggatgttttaggaggggaaagcctttccctggacttcaaaatatgttttcttccc

SEQ ID NO: 691205 - DNA, 308 bp, Homo sapiens
tggtctcaaaggcgaccctgcctccaagggttaaaacggacatcctggataaattgtcctaattggtcctacagcagaacaaggggaaaaaggtgaccgagggctccctgaaacttaaagatctcccaaagcaaaatgggatggcggaattactgctgctgcagatcctttatgaccacctcaccctccaagcttaccacgagggttatgcccaaaaggtgaccaaggatctactggacccgatggtcagacaggtgacgatagtcttgcaccgtgtctttggaatcaaggtgtaactgtcgaaatca

SEQ ID NO: 691206 - DNA, 165 bp, Homo sapiens
ccgttttacggaagccacaatggcactcccctatactactacccacgctcagcctgacgttttggccttgtgtctgctcaatgggaactactcacctcctctgtcggcggcatgtctgtcatggcagagtcttccccctccgtgcccgactcattctccatcttc

SEQ ID NO: 691207 - DNA, 1802 bp, Homo sapiens
  misc_feature (532)..(532): n is a, c, g, or t
  misc_feature (831)..(831): n is a, c, g, or t
  misc_feature (833)..(833): n is a, c, g, or t
  misc_feature (835)..(835): n is a, c, g, or t
  misc_feature (859)..(859): n is a, c, g, or t
  misc_feature (918)..(918): n is a, c, g, or t
  misc_feature (1411)..(1411): n is a, c, g, or t
gatggtggtattaatagtctatcgactcttgatactccatcaacatgtttactgacttataccgcacacatactccatgtctcccctctgatgaaagactctaggtaggtgagatcatgtaacatgacggcctgtcgttggcctgttgtaagacttataaacttacaatgatagtcgctactagctattcgcatatgcacacatacttttaatgtctccatatgagtacgatagtcacgtggatacgacgcactaactgaattccttgttagacactgccctgggcctacattcaagccaggttgagggtgcgtcacacacggtaaccttaggatctacgacactccattctctacatctagcgattcactcgtgcacgttagcatcttacagataatctattaaagctcatgacaaacctcgtcaatttctctaagattagacttgtatagaacattaacttgcagcttccctcagatcgaactttaggttatggcatggcacatttgtagcaatggcacgtatgccaagnccattcacgactgttaaaaatggaatagtctacactgcgacacctcgaacgctccaacgatgtgcatgaatatttttacttttaatgccaaatgcgaaataccccattcttaccatgaatgtttgtatataaatactccacaaagtggaaattcacacccacagcccctcattgtgtaaggcacttggatctccgacgcccaataggccctctatgtgccctatccagaaaccaccccctcataggtaaaacgctcccccatccctctgattgttcggtaggatgcagaacacttgcancntnccctggacgctcgtactgacaacntcaatttgggcacaagttccttaatgggcctcgatcctttcaattctcccgatcgaagnacctaaccctaattccaccttgcatatccttcataccttctcatacgtgcgtccttacgagctcaaatatccttccccctataaaaaaattttcccctttttaatttgatttaaaccaattttcaacccaggcccaacgaggaaagctaatagtcaagtaatttgtcactaactgcttcctttccgggaaaaacccacagaagttataactccgcccaaacccttgggggttatatcactatccacccccggagttgaaggggcgaccccaagcgccaggaaaaaggccgtgtgtatcagcacaagggccagcataaacttatccataatatatctataagaaccccctacagtatagaggtctccccttttccccctatactcacatccgggcagctgaggttatttaccgtctcaaacaccccacagaggtgacaatgacaaaatatagataaatgacaccgctcgagatgatccgcgaagaagaaaaaancaggctaacctaacgaaatgagaacacaatctacaaaacggttagaaagagaacaccatgggaaccaaacataataccagacgagatggagcccaccgaggagaacagcagacgacacacagaaaggagatgcacaccaccgtaaaagaagaggccgcggaatagagagacaggccaccttctcccttcaaccactctcgcgttagatattttattgcatctagtaatacaagaaaaacaaaaaaaaaaagaaaaacaaaaaacaagaaacaaaacaaaaacacaaaacacagaatcaaccaaacaaaaaaatacaaaaaaaacacaaaaaagaaagacaaacagacaaaaaaaaacacaaaagaaaactcaaactaacaaaagaaacaat

SEQ ID NO: 691208 - DNA, 150 bp, Homo sapiens
actgcaccctcggtgtgctccgctacacagttctcacacatggtctcctgtcactccacacattgtctgtggtcaataaaaagtaataaggtatactgattatagtggtatctcaccgtgtccaaccggcaaaacaagtaagcccgtgta

SEQ ID NO: 691209 - DNA, 537 bp, Homo sapiens
cacgaggggtccgctccgagcttgccgagcacctgtgccgccacgccttcaccctcgcggatgaggcccagcaaaatgtgctcggtgccaatgtagttgtggcccagctgcagcgcctcgcgcagtgacagctcaagcaccttcttggcgcggggcgtgaacgggatgtgaccggagggggcgtgcgagccctcgccgatgatctcctgcacctgctcgcgcacgccgttcagcgaaatgtccatggcctcgagggccttggcggcgactccctcgccctcgcggacaaggccgagcaggatgtgctccgtcccgatgtagttgtggttgagcatgcgcgcctcttcttgggcgagcaccaccacacgtcgggctcgatcggtgaaccgttcgaacatgtcatcctcctcgtttcttatccggctgggccgggatccgccgcagtcacctgtggcgctgcgtccaggctaaccagggtgcgcgcgtgcgcatgcccatgttcgccaccggcgtgatggctgtgaccttctcgtaaca

SEQ ID NO: 691210 - DNA, 87 bp, Homo sapiens
acatctgtgtacttctgcgccacgagcctccggacaggggaggtttacgagcagtacttcgggccgggcaccaggctcacggtcaca

SEQ ID NO: 691211 - DNA, 796 bp, Homo sapiens
ggatcccggaagtgcgggcgctcagaggagctgtctaccgggtgattggaggcgggggaggtgggggcggtacagagactctggtgtgttggtagcctgctgaggtgcactctcgtgttatgtcagagaaccgatgtggtgtcgtgatcgtgctgttgattccttagaagtcttggaatcgagggtcatgttgagtattgtgatgaagaatcactggacgatgtagagacagggaaggactcttgtgaattctggtcatctctactgatctgtgacggagggtcacagcagcacaatgccagttcgtgcccctggatcaactccagatcacccagtaagggacccgaagacaggagatgctgagtgacttcaccagcgcatgatattgtacctgtaactccatgatacaaatttgatttatattgggagggggtcctgcaagaccctacatgagaggtggccttgtaagaatccttgttggtacccactagagctctacagtttggcaaactcgtccattcccgagacagaaggcagaccggtattctgtgttataggcaaaccgtgcccctaaaagactaactattctcctgctcctaagtggaggagtacctggaacgcgccagcttcgtagagcaatgacctcgacgtggctccttggcctttgcctcacgataaaattctgggtgccgaggtgatcttttgaccgaagactctacaggaagttgcctggactcctaactgagctatgtcccccgcaaattccgaacgagggggtggccttcaggccctgaag

SEQ ID NO: 691212 - DNA, 192 bp, Homo sapiens
ttctttcacaatgtggggagatactagttgactataccgttgacccttgcactttttctctctacctctctctgggcatttctctgttttcctccctctcctcttcctcattctccctgatgttccggctgcacatcgtgctgggccagatcgaagccaaggtcgaatccacaaggccacggttcaacccac

SEQ ID NO: 691213 - DNA, 204 bp, Homo sapiens
agcggaccacacaatgactgaacggactgacagagtaccttcactgagactgatgggctcataatttggcaaggcgcgctacgaagcatggtgcgcgcccctttgaagaagtgcgagaagcgtacttcatcgatgagagcaaaaactgcgattccagggatcagtatcttgatcgagcaaaccgaggttgcatttcaactacct

SEQ ID NO: 691214 - DNA, 880 bp, Homo sapiens
cccggaggctctgcgtgccgggcccccgcgccttgctgccccatgcagccctgagccccacagcaagtctgccatggtgccgcggggccctgtgtcccctcgtgaggccccggtgggcaggcgtcgagcgccgctggcttggagcctgcgctggtcgccctgtgcctcctccccgcgctggtgctgctggccctggctgggggcccctggcggtgcctggcctggagcgcagctgcagggagacgtcggctgcgctgggcctctcggcggtccccccacatcccgggatcccgggacccacttggccccccgacatgacgccagctacacgcatgactccatgccatggctgcgcgtgggaccagcttcaagccgtcaccgtacagggatcctcgtccttccgcgcggaacgctgctgaggcccagcggcgagacggcggacggtgccgctagactagccagccgttccggcaatgtgagagccgacgtagtccccgctatcaggctatccagcgagcgtggacacccagaggcagcccaggcgacgctccggagtaggcttctagccgcgatcaagccacgacgagactgcctagggactccggcgctgcgagcacgtgcttacgacagggcccaacgggaggcacgctggcccagcgccgtagctgaccgcccagcgaacgcgcggcagtaccacgattcgaacgaacaagccgagatactcgggatccatggtgaccccaagcgcgactagcagcgcagccaacgaaaggggtgaacccggtaccagagcctggacctcactggaagggcaatactacctacatgcacagcacaagaaggcgctgagccggacggaacgaggcacataaggggagca

SEQ ID NO: 691215 - DNA, 148 bp, Homo sapiens
aataccttgttaatgaattgactttcataaattggttatgttggtgggcaagtctttaagctggaaattgtaaattcctccagaaatgtattgcatgcagttaccatgaactaatactacaataaaggatggtcttgtcagggagctt

SEQ ID NO: 691216 - DNA, 100 bp, Homo sapiens
cgtcttaataataccaatgcgctgaagtaatcaggcacagactcaatgtaacattctcacccaggcctgcaccaaagatggtgttgttgtctgaattatc

SEQ ID NO: 691217 - DNA, 638 bp, Homo sapiens
tccatttggcacatggatagaaggaatataatgatatattggatcatgatattccttctatccatgtgccaagatgggtgtaatgtttatttactgatgcttatgttgaccaaagagcatgcagaagacaagtaaaattatgacactactttcgagtacacaaagtgatctgatgcgtctagccaaacaggatatgctttcacaactatgctgatatcagatctcttaatgtcgtgtgtcacacagttggaatttattctgttgccagcatttaagtagtcatggcaagtcctgtttttaagacctttggagactggagctttctgttccattaagtctttgtttatactacaaatgtcacctcacttagttcagatgaaatctgttactctacaaggaaggtgttcatcattaggaggcagctttactaagctggtgctttgcatggtagcaagtgctgccctttatcagcacccatgggtcatagtgtaggctagagttaaggcactggcagacttagggatgctggacagacctgtagttcgttttaagtcatgttcacaggaatttctacaataataaacccatcatctccataggtcagatcgaagtgcattcaatgctaaatagaagtatga

SEQ ID NO: 691218 - DNA, 163 bp, Homo sapiens
  misc_feature (128)..(128): n is a, c, g, or t
  misc_feature (148)..(148): n is a, c, g, or t
cctgcagccttgacctcctgggctcaagcagtcctcccaccccagcctctgagtagctgggactacaagtgcatgctgccacaccagaggctgaggggatctggcggtggagcgctaggatcagacgnccccgcgatgaccagctccnccgtctccagagtcg

SEQ ID NO: 691219 - DNA, 211 bp, Homo sapiens
  misc_feature (1)..(2): n is a, c, g, or t
  misc_feature (5)..(5): n is a, c, g, or t
  misc_feature (34)..(34): n is a, c, g, or t
  misc_feature (189)..(189): n is a, c, g, or t
nnatngaccattgaactttatttttttataatgngatttttgggaaggcacattgtttttttaacagggttagttttcagagcctggccagccaaccgtgtgctagtagccaaccgtggactagtagccaaccgtggactagtagccaaccgtggactagtagccaaccgtggactagtagccaaccgnggactagtggttaccgagctcg

SEQ ID NO: 691220 - DNA, 332 bp, Homo sapiens
tagatgttgccctatttttatttaaaaaggggggactcgagacttaaaataaaaaaagctccttggtcttggctaaggaagggtttttattttggggaaattttgaaaattatagccccttaaggtctcaaaaaaatccctttcgttgttttggaaaaaaaaacaaaaaatttttccccacctttttttttaaaaagggccaaaaatggggggggggggggttttttttttaattttttcccccccccccgttgttttttggggggacatattctcttcccgcaaattttgtgtttgcccccccccggggttttttttccacacctttttat

SEQ ID NO: 691221 - DNA, 504 bp, Homo sapiens
tgagacacagacagtggacaatgccaatgagaaatcagaaaaacccccagaaaaccaaaagaagctctctgacaaagatacggtagccaccaagatccaggcctggtggcggggcaccctggtgcgtcgggcactgttgcacgcagccctcagtgcctgcatcattcagtgctggtggcggctgatactgtccaagattctgaagaagaggcggcaggcagcgctagaggccttctcccggaaggagtgggcagcagtcacactgcagtcccaggcccgcatgtggcgcatccgcagacgctattgccaggtgctcaatgctgttcgcatcatccaggcttactggaggtgccgctcctgtgcttcccgggggttcatcaagggccagtacagagtcacagccaaccagctgcatctccagctggagatcttgctggactcagggccttgcattgtgacagagtgtattcccttctcaataaaggaatgaagtggtcttttcca

SEQ ID NO: 691222 - DNA, 120 bp, Homo sapiens
gatcaatcctccatgagtagtggtggtggcagtggtggcggttatcggcaatcaagaccagagtggtggaggtcggcagccggtcggctattggaccagccaaggaccgttggagccccc

SEQ ID NO: 691223 - DNA, 213 bp, Homo sapiens
tctggcggtccatcagtgctcacagagacgccggtgtggccgaggcctggctgcttggagaggagccgtacctctccgccgagagataggccagagcgtgaactaggtgcgagaagctcatcaagcgccacgaggcattagacaagtctgcagcaacctgggatgagaggtctctgccctggaaaggctgcactaccttggagttactggaag

SEQ ID NO: 691224 - DNA, 521 bp, Homo sapiens
tattaccctagaatgtaaccacacgattaaatcttttagaagtagacacgctcatccaaccacccccattaaaaatataagaggtgttggtctggctacctgatttcacctcgtatagcccccggaaagagttaaccccaatggttttgtagttttaatgtaatggtaaaaataattgagaccccacaagagagtaattttgatatgattatcacttgaaaggagtcttaaatgttcacgccacgtcacacccagattgaatatatttaattagattcgccatatctggtcacactgtattaaagtttaaataaaaatgttctgtggagtgataaaggtctttaatatccaaactatcacccagtcaccatgtttaagaaataactatctaaattatttttcactggctttcctgaaaaagtttacatttcatagaactatggcccaatgtaaaaagacccaccaatacagtaaatggtaaaaaccaacattaaagattcaagttttataaaaaatttata

SEQ ID NO: 691225 - DNA, 183 bp, Homo sapiens
  misc_feature (79)..(79): n is a, c, g, or t
aatgatacccagagctaccgccgccacactgtggagatgtgtgtttgactgtgagagagtgtgtgttgtgtgtgtgttntgccatgacacgtggccccagtgtatagtgtttcagtgggggagaagctgaaagaccaagactcttcccaagttagcttgtctcctctcctgtcaccctaagag

SEQ ID NO: 691226 - DNA, 389 bp, Homo sapiens
  misc_feature (109)..(109): n is a, c, g, or t
  misc_feature (166)..(166): n is a, c, g, or t
  misc_feature (238)..(238): n is a, c, g, or t
  misc_feature (286)..(286): n is a, c, g, or t
  misc_feature (341)..(341): n is a, c, g, or t
  misc_feature (346)..(346): n is a, c, g, or t
cttaacccaaccttaaattcccaacccaaaggcctttttgggggttaatttttttgggggccccaaggttggaacccaagaaaaagaatggaacccccttaatggtttngaatttctggaagggctcttgctttttgtgtaaagccttctttgtgatatctccatngtgtccctttgggcctcctgttctgattgaattccatcaaaagtgaggcattagattctaatcctatatttncctatgagtccattctaatactcttaggttttgttggttccagttganttacaaggagggaggtcagatactgttatctgtgatactaaaccagaatttgacntcctnacaactgaaatttgcattgcttcttaatcaaatccccccggcc

SEQ ID NO: 691227 - DNA, 372 bp, Homo sapiens
atagcgacaccgtacatggcagccggaatttgttggcgcccgacgaaagctacaaagactttatgcaggcagttgtgcgaccggcacgggacatcctgcatgagcatggattgaaaggttttcatgaactgcgggcggcttacgcctgtgagcgctatgagcaactaatcggctttctcgcacccgttaatggtggtcgtgttcatcaagaggatcgagcactcgatcagcgagcccgtaagcagatcagccacgagttgggacataaccgcattgatgtggtgagtgcctacatcggaggtcggcgatgacggccgatttcgacatagcgttgttcctgcgccccgtactcaaagggtacggtgtcgctat

SEQ ID NO: 691228 - DNA, 787 bp, Homo sapiens
aaggtgcctatttaggtccaagggaacatggacacatgatcatgtccactgacatgataagccccggcgcccggcagtacgggaccataaaggtctccactggcacgggtcgctcagtcaacgtaggctgctggatgttgacgaaaggaaggcggcggcggcaggctcacgggatctccgaggtcacggacggatcggccaggattctcacggggtaaaagggtctacactccggggtagggacataaaggcttgtagttccaagttgctaaacgagggagaactctagggagggacaataacagcgggagacacaatattcgagagcgggggaggcctccaagaggcgaggagcaagagcactctctccaaaagaaacgccagcccaggggaggggggcgacgcgggggcgcccaagagaagggcaagaacgggcacccctggggcggcaaatacaaccggtgggacacacccaacaggaagagaacccctcgggcgggcaacagcgaggacacaaacgagcccgccacgggaaatttacgacacaccacaaactatcaaaaaaaccacgcgccccggggaggggaacgacccacgggaaggccaggcgtggcagtagcgaacacacaaaatacctcacaaagactgggggcgagtaatgaaagaggcgctgcaaacaagggggggaaccttactatcagaacaacggggggagcccccacagcgaagcggagcgcgccagactataccaaaataacttcaccggccccgcagtcgcgggggaaag

SEQ ID NO: 691229 - DNA, 162 bp, Homo sapiens
cgacggcatgaatcgaactcggtactgtgtgagtcatcgcttttgacccaaatgcacattttattagcggggataaagagggtgaggtaaagtttatggaactgagtgttagtggactttggcatttccatagctgagcacagcaggtgaggggttaatgca

SEQ ID NO: 691230 - DNA, 175 bp, Homo sapiens
cctaaagtggaactgctccgatcattatttttcagtcttttatctctctgtgacacattctgcgattgtttctattgctatgtctataagttcactcatcttttcttcttagaatagctaatctgacactgtaactatgcagtgtatctatgatcccggagcagtaccacttagg

SEQ ID NO: 691231 - DNA, 453 bp, Homo sapiens
ggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtggtccgagcactttgggaggccagggcgggcggatcacggggtcgggggatcgagaccgtcctggctagcacggtggagccccgtctctactgggaatgcaggaaattggccgggcatggtggcgggcgcctgtggttccagctgactgggcggctgaggcgggagggtggcgtgggcctgggaggtggagcttgcggtgagccgggatatcgccgctgcactccggcctgggtgacagggcgagactccatctcaa

SEQ ID NO: 691232 - DNA, 132 bp, Homo sapiens
ctagcttagaagttcaatagcaattttatacaattaccccagcccaggagtcagcctataacttcaggagtcatgaagcccttgaaggcctcagaaaagctgatctagccaacctccctcttgcctttagct

SEQ ID NO: 691233 - DNA, 775 bp, Homo sapiens
  misc_feature (483)..(483): n is a, c, g, or t
  misc_feature (522)..(522): n is a, c, g, or t
  misc_feature (618)..(618): n is a, c, g, or t
  misc_feature (623)..(623): n is a, c, g, or t
  misc_feature (664)..(664): n is a, c, g, or t
  misc_feature (685)..(685): n is a, c, g, or t
  misc_feature (723)..(724): n is a, c, g, or t
  misc_feature (766)..(767): n is a, c, g, or t
ggggggggttgtactgactgtgcgtggggggggaggctgttcacatacctgcggaagatgaatgccatatgacttggatctgagctaaaggacagtattccagttcctgaactttcaccaagtggaccttttaaaactcaggagcctcttcgaaaaggttttttttgtatgaaaaatgaagttagggggagtaatacccttgaagtatcagattacatttccaggtatccaaataaaatattctcaacactgcgaaacgttcacgatctatttgctactctaaaattacatatggaatacaaggcaatgcagcaatttaagaaacttgcattgctttttagctcaaaatttaactggatgatttgtggggatttgaaaagaccactggaattgagggatatcttagtgatccatcaacaaaccgaagttaatgtggagagccacactttttagaaccgaacataaacgcctctgataactganataggagttgggtcccaatgtaacccccaaatctccatntttgaatataaggcgtgtatttccccttcaaagggcgtgtacacccccctttataggcgcgcgccccctctaacaaaaccacccacccccgatatnttctnccctttggcaaaggagaagaaacgccttaaattcttccccntaaaaagagccccaatattanaaagtgcggcgcgaaaatggccctttttatttttttanngcaatatattttatgggggggggttaagtttctttccccaanncccccttt

SEQ ID NO: 691234 - DNA, 1315 bp, Homo sapiens
agcgtgtggagagcatcgtacccggaacgatgcggggaggcattagggaaggattggtaccgcttatgcgtgtaactcgtcgcctcactgtgagcggctggcctggggtcctcccgtgtccggctcgtaggccggcatgggccggcccgcgccatgtcagttaggtccatgtcatttcctgcgtcgtacgttcatggccggggcttggcacgagctagcatgcatcgcaacagttcgtcagcggcctggatgtctggatgtccggctcgttgtgatcggccatggtgctgcgtagccctgttgtgccgtggtaatcatacacccatcaccaatcgatagggggttttctttggttcaccgaatgggtccctctaccaggcggagagaagaatggttaggtagccatatgggctcgagtagttcgatgcatctcagtatctcttgtagatagaggaaaacatgttgttccgacaagatctctattgtctcacatgactagagatatgagttcactcaggtgatcttgtaaaagacctttcaattgttctcgcggaaacttgaggacaagagtggttacacaatgatagtccctttccttgcaaagcaactgggaaacgcaattggaaccgtactacgccactacgcagtgctgaggcgtgaattccaccaggtgtgtttcccgtttcgagtgacaggtgtaggactcgtgtaaatgttggcccgtaagtaatacggcgcggggtgcctagtcgcattgacccgtatgtaaatcgagtgccctaacgggtaatggggctaccacaaatggccccactgtgaggttcagcgaatgtgaaccttatcaaggttataacgaaaaggatcattgttcaccttttgatcactttcaatatattaaagtccctatgttcatgaaaccgtgaggaaacctcttaggttacttgcagtacatcgagatgggcgtaactcgcgtagttattgagtaagagaacgtgtgatagaatactgttagttaatccacccggtacatttcgagtatcatggcgtacggttaccactaaatttgggagagttttggtacccgtagggagttctatgaggttttttgcctagccctgaggagcagagaacccaggggtaaaagacgttcttaatagatatagtttacgcccggaataagttagcttagcgagtttagtaccctgaggtgtcttcccgatacctttttgttacgttgctacaggtgtatatccgagttcgccgcggatcaacggtagttggtcgcggatatcgttcgactatagtcgctagcgcg

SEQ ID NO: 691235 - DNA, 399 bp, Homo sapiens
cgctgctctcactgtatcagctgactttggtagtccctggcactggtgtttttgtaacggctccatatacacccattgcctgaaccaccaagctggtcacatctccaagcttggaaggtatctaggatactgtatgaatccttggccagttaggagaacgcgctgacatactgctcggccaccgtcagttaacctgctgcatctccattatgttgtgtcatatctgttcccctttgttaaaatagcttcagctttagccttggccttcgccagaactgcactggcctctcctgctgcctgatttatctgttcagccttttctgcttcggaggccaggatctgggcctgtttcttcccttctgccacattgatggccgactctcgggtcccctcagactc

SEQ ID NO: 691236 - DNA, 432 bp, Homo sapiens
actgtcatgtttacagacagtgcagcaaaggcagtggcttggagtgtgaccagagagtttgcagaacaaacgcaccagggaggggcttggatggaaataaccaagcgctctcccccagggcgtcaggaagacagaagaagctggacagaaagagatcaagatttaactggttatgctgtagaccatggcagatcgtaacagaagacaaagcccttaaaagaaatgaaactatcctcattaaaggcctgatggctcacaccatccaggagatctcctctgctaccaactcccagcagctgattcagcggtccttcatgaacaataggcaactgaacaagaaaatgagtttatattgttcaaaagaaagaagaatgcctcttttttcccttgaacaagggaggtggggactaacaaaagattctttgcttgacc

SEQ ID NO: 691237 - DNA, 385 bp, Homo sapiens
  misc_feature (104)..(104): n is a, c, g, or t
  misc_feature (110)..(110): n is a, c, g, or t
cccccaaacccctaaaaagagaataattgaaaaaaagattaatggttcctttcaagttccatgtccctacctcgagggcaagaaaagaaagtttatgagcctanggaatnggtggctcatgccccatatggcctccccagcactttgagagcccaaggcaggaggatcacttcagccccaggagtttgagacagcctaggaaacataacgagatcccatctctacaaaagataaaaaaaaaaaattagctgggattggtggcatccacctgtaggccaagctactcaggaggctgaggtaggaggatcccttaagcccaggagatcaaggctgcagtgcactatgatatgccactgcactccagcctgggcaacggagctagaca

SEQ ID NO: 691238 - DNA, 331 bp, Homo sapiens
tttaaactggctagctccatttttaccacaaaaggggtacttgagatggaatgatggtgagcagctgtattgtcggctatccttcccctttgatcaaatagaccaattagttacatgacccaaaaccatcagaggagcaaagccagaggccttcattttgaaaaagtttcctaactattaaatagtctttattcatctgggtatacagagcattcggaaagtattcagacccatgactatttccacatttggttacgtaacagccttattctgaaattggatacaattcatgtattccctcatacaatctacacacaattgattgacacag

SEQ ID NO: 691239 - DNA, 197 bp, Homo sapiens
acatctgaatttccacgtggcaagttaaaagcttccattagaactgcttgtctgtcagccttatgaacaattctgtgcaggcagggcgcggtgactcacatctgtaatcccagcactttgaaaggtcaaggtggcagatcaccggagcccaggagttcaagactagcctgggcaacattgcaaaaccctgtctctac

SEQ ID NO: 691240 - DNA, 405 bp, Homo sapiens
  misc_feature (282)..(283): n is a, c, g, or t
  misc_feature (304)..(304): n is a, c, g, or t
  misc_feature (331)..(332): n is a, c, g, or t
aaggctgcccccggagaagcctggcctcttcttcgcccaaaaagcaattttccccttaaaaatgttttttaaagaccagggggaaatttaaacaaaacccccccagggttttttccccgccacaaccccgcctgggaattgtcagccttccaaatccccctttccctcctcttttggggttttcttctttcttccttaagcaacttacaatggtgggggtaagactaaggctggggcattttgggggcccggaggtctccgttgcttcttggttggggtttnntgtgatagtgccccccccccntcccctcccattcggcactagaatttnncccactttttttccccccccacccggacctctcctccaggtctcatcttcccaccccaaaaatgtctgtctct

SEQ ID NO: 691241 - DNA, 81 bp, Homo sapiens
gttgaggacacggctgtatattactgtgtgcaagagggaagcccctatagtagtaacttttacggagcctggggccaggga

SEQ ID NO: 691242 - DNA, 185 bp, Homo sapiens
tttttttttttgggggggggggggtttccccccccccccccctttttttttagaggccccccaggggggccaagggttttttaggtttcccccccccccgggggtttggggggcccccttttgggttaaaatttttttcccaaacctccccttttttggggttttccccccccggggggggttta

SEQ ID NO: 691243 - DNA, 130 bp, Homo sapiens
tcctggagtcgggtcatgcagtggggactgcttgtgcacacagattgcttgggatgacgggtgctccaagagttacctgttcctaaagagccaagcgtcccgtccgtggagtcgcttagacagcctccct

SEQ ID NO: 691244 - DNA, 1485 bp, Homo sapiens
ggcgtgatgaaatgctgggacttgtgcccatgaggcaaagcataacttgatatagaaggagaaggaaataccagaattacgaaacaaactgcagaatgtcaatagagaccatacagcgcctcaaagcacacgcacatagcacgcacacaagaaacactcttgggtacacataatgcctgaagaagacaagtgcccaaagtcatgcctgactagatgttacaattatggcagcaggttcccagatggaacttaacagatgttgcaaaagcacacacacattgccacacaccaagccagctacagctacaaaggcaatagcacttagcatcgcaactgtccaaaccaagctcaacccaggcagcaaaccacaggcagcaacacaagcccaccacagctctcagcagcaccagaactatcagtcacagcattgcacatccgcccatcagctcaccgcgttcatcacaagggaccaaagccaggcacaacagcatctccacacaaatcatacaagagaagtcaaacaccagcaatggcagccctcaacacatcattgcagccaagacatatcacagcattcattccccaactcacatctacgcgaaagctgcttccgcatacaagacacacaacctgggcacgcgcagcacagcaccctggtggggaacaagtgtaaataacccacaatggcaaacgacattctagcgatgcaatctcaaggcatccacacggacggcacggaactacaacacgcgacgtgacatcaaaaccaggaagacacccgggtatcacacgccgcacaatacaggggcagcaacacaaaacacatgcgggacacaaaagcatatcaccagaggaccacaggaacaaacaacgaacacagaacacatcacacactcccaaaccgacagacacaacaacaaacacccaacagcgccaaagcacagcgaagctacgcgcacacacggcgacgcacccgcacccggcaccagtgcgacccacgccaccaccacgcgcagggacaagggcacgcccccaacaacgatcaacacagagagagaccacacaaccggcacgcacggacgcaccgatcggcccgcaccacacaccctcaacaacaccgagaactggacgacaaccagcaacacaggcaccgcacacataccgacacgtcgcgcgaccaacacggcacacgcccgaggcaagcccgctcgtacaaatacaaacggacacccacagcgccacacacgccaaacggcacggacgccggccggacagacacacccacacgaagaggcacccagcgagcaagagaaccgtgccaacgacacatcacgagacgcagcgcgccacgaccacagcacgacgagcgacacgggacctcaagcacacaaccgcgcacgaacagacacaaccgggctgacacatgcagacacaacacccgccaactaatagagccgcacagaacatcacaccaacaacccagac

SEQ ID NO: 691245 - DNA, 178 bp, Homo sapiens
cggtgatgtaagctggttggctacacatgcccgggttgcacgaaatgtcccgaggtatttgaagatgttcagcgctgtcacttcacgaggcccaggaagctagaggacgctcaggcggggtctgggaccataggccggtctggtgtccagtgtggagggcccccttgaagatccggag

SEQ ID NO: 691246 - DNA, 230 bp, Homo sapiens
tttggtttgagtgtgacacaggagcctcgaacttcaccaggagacgtatcacccctggatgggtcaggaaactggccagattgcggactgtgagggcactttttatagaacacacggactgaaccagggcgagcaggcccccacatcctgaaaagccaggaaaaccctttttgcttaagccctaatcccgatctcgggttcagcttatgattctgcaccaatgccacttg

SEQ ID NO: 691247 - DNA, 951 bp, Homo sapiens
  misc_feature (144)..(144): n is a, c, g, or t
  misc_feature (148)..(148): n is a, c, g, or t
  misc_feature (230)..(233): n is a, c, g, or t
  misc_feature (247)..(249): n is a, c, g, or t
  misc_feature (264)..(264): n is a, c, g, or t
  misc_feature (275)..(275): n is a, c, g, or t
  misc_feature (285)..(285): n is a, c, g, or t
  misc_feature (303)..(303): n is a, c, g, or t
  misc_feature (308)..(308): n is a, c, g, or t
  misc_feature (311)..(312): n is a, c, g, or t
  misc_feature (315)..(315): n is a, c, g, or t
  misc_feature (342)..(342): n is a, c, g, or t
  misc_feature (363)..(363): n is a, c, g, or t
  misc_feature (367)..(367): n is a, c, g, or t
  misc_feature (369)..(369): n is a, c, g, or t
  misc_feature (372)..(372): n is a, c, g, or t
  misc_feature (376)..(377): n is a, c, g, or t
  misc_feature (383)..(383): n is a, c, g, or t
  misc_feature (416)..(416): n is a, c, g, or t
  misc_feature (440)..(440): n is a, c, g, or t
  misc_feature (445)..(445): n is a, c, g, or t
  misc_feature (449)..(449): n is a, c, g, or t
  misc_feature (455)..(455): n is a, c, g, or t
  misc_feature (458)..(458): n is a, c, g, or t
  misc_feature (463)..(463): n is a, c, g, or t
  misc_feature (476)..(476): n is a, c, g, or t
  misc_feature (483)..(483): n is a, c, g, or t
  misc_feature (493)..(494): n is a, c, g, or t
  misc_feature (497)..(497): n is a, c, g, or t
  misc_feature (502)..(503): n is a, c, g, or t
  misc_feature (519)..(519): n is a, c, g, or t
  misc_feature (529)..(532): n is a, c, g, or t
  misc_feature (534)..(534): n is a, c, g, or t
  misc_feature (543)..(545): n is a, c, g, or t
  misc_feature (549)..(549): n is a, c, g, or t
  misc_feature (562)..(563): n is a, c, g, or t
  misc_feature (572)..(572): n is a, c, g, or t
  misc_feature (725)..(725): n is a, c, g, or t
  misc_feature (730)..(730): n is a, c, g, or t
  misc_feature (771)..(771): n is a, c, g, or t
  misc_feature (951)..(951): n is a, c, g, or t
tattgtaaactttagacacaaaaataggttctctaggccattcacatgcacattaaaaccaacaggtgcaaactacaacaatgcatataattatacaaatgatgccactctgtgatgtttacaggattgctgtccatgcaaggngatnataggcattatttatgaagccttaagatccagaagtgttgttactaccaaacctctgattaacactgtgaagtaagtgtttnnnnaggcagttccatgnnncggctaacatttctntaaagcaaatngctgcctctnagcctagccgtacaagcnatttnggnnganctgaaaatattagtatttcattactgngtgcggctctgtgatgggcangcgngnggngggnncatccnccaaaaacaattacttctccttcatcgctggcncatgctgtgtgccatagccttggnttttnggtntatggntgnttaanttgtttccattcnttttttntgatgcagtnngtncaggnntcacttagtggctgtntatcagtggnnnntnctccaaagnnnaaangatgatctgaagnnactggtgtnagtgagtgccaagatcgaccaactgggcatatgccttgtggaattaattcattccactcccatgtatccagattaagatagtgaagatcattcattctagcatcctaaaaaaggataattaagttatcattttgaagaattcaaaagcaagtnattgnagtcgtttgaatacttactcgatatctgcctccaaacacgnagcctctatttccgacagttgcacaggcatgggcagcacgaggtgaaggtgctttaccagtagttataggctggctccaggtaaatgtttcagtatctaaaatatgtacatgatcattccatcctcttggatgacttgaattccaaaaagatgtttcatcgaattcaaaagttcccaatn

SEQ ID NO: 691248 - DNA, 2483 bp, Homo sapiens
tagaattcagcggccgctgaattctagccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgccgtgtgagctgagcctcgagcacttccaggcgccactggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccgcatccgctcgagggctccaggaaggtggaggaggaaggaagccccggggaccccgaccacgaggccagcacccagggtcggacctgtgagccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagggccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtactggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccaagaccccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccaagatcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggcttgcctttcttagtctgatgccaagcaaggccttttctgaataaattcatttgactttcgaaaa

SEQ ID NO: 691249 - DNA, 879 bp, Homo sapiens
  misc_feature (144)..(144): n is a, c, g, or t
  misc_feature (148)..(148): n is a, c, g, or t
  misc_feature (230)..(233): n is a, c, g, or t
  misc_feature (247)..(249): n is a, c, g, or t
  misc_feature (264)..(264): n is a, c, g, or t
  misc_feature (275)..(275): n is a, c, g, or t
  misc_feature (285)..(285): n is a, c, g, or t
  misc_feature (303)..(303): n is a, c, g, or t
  misc_feature (308)..(308): n is a, c, g, or t
  misc_feature (311)..(312): n is a, c, g, or t
  misc_feature (315)..(315): n is a, c, g, or t
  misc_feature (342)..(342): n is a, c, g, or t
  misc_feature (363)..(363): n is a, c, g, or t
  misc_feature (367)..(367): n is a, c, g, or t
  misc_feature (369)..(369): n is a, c, g, or t
  misc_feature (372)..(372): n is a, c, g, or t
  misc_feature (376)..(377): n is a, c, g, or t
  misc_feature (383)..(383): n is a, c, g, or t
  misc_feature (416)..(416): n is a, c, g, or t
  misc_feature (440)..(440): n is a, c, g, or t
  misc_feature (445)..(445): n is a, c, g, or t
  misc_feature (449)..(449): n is a, c, g, or t
  misc_feature (455)..(455): n is a, c, g, or t
  misc_feature (458)..(458): n is a, c, g, or t
  misc_feature (463)..(463): n is a, c, g, or t
  misc_feature (476)..(476): n is a, c, g, or t
  misc_feature (483)..(483): n is a, c, g, or t
  misc_feature (493)..(494): n is a, c, g, or t
  misc_feature (497)..(497): n is a, c, g, or t
  misc_feature (502)..(503): n is a, c, g, or t
  misc_feature (519)..(519): n is a, c, g, or t
  misc_feature (529)..(532): n is a, c, g, or t
  misc_feature (534)..(534): n is a, c, g, or t
  misc_feature (543)..(545): n is a, c, g, or t
  misc_feature (549)..(549): n is a, c, g, or t
  misc_feature (562)..(563): n is a, c, g, or t
  misc_feature (572)..(572): n is a, c, g, or t
  misc_feature (699)..(699): n is a, c, g, or t
  misc_feature (879)..(879): n is a, c, g, or t
tattgtaaactttagacacaaaaataggttctctaggccattcacatgcacattaaaaccaacaggtgcaaactacaacaatgcatataattatacaaatgatgccactctgtgatgtttacaggattgctgtccatgcaaggngatnataggcattatttatgaagccttaagatccagaagtgttgttactaccaaacctctgattaacactgtgaagtaagtgtttnnnnaggcagttccatgnnncggctaacatttctntaaagcaaatngctgcctctnagcctagccgtacaagcnatttnggnnganctgaaaatattagtatttcattactgngtgcggctctgtgatgggcangcgngnggngggnncatccnccaaaaacaattacttctccttcatcgctggcncatgctgtgtgccatagccttggnttttnggtntatggntgnttaanttgtttccattcnttttttntgatgcagtnngtncaggnntcacttagtggctgtntatcagtggnnnntnctccaaagnnnaaangatgatctgaagnnactggtgtnagtgagtgccaagatcgaccaactgggcatatgccttgtggaattaattcattccactcccatgtatccagattaagatagtgaagatcattcattctagcatctcgatatctgcctccaaacacgnagcctctatttccgacagttgcacaggcatgggcagcacgaggtgaaggtgctttaccagtagttataggctggctccaggtaaatgtttcagtatctaaaatatgtacatgatcattccatcctcttggatgacttgaattccaaaaagatgtttcatcgaattcaaaagttcccaatn

SEQ ID NO: 691250 - DNA, 2423 bp, Homo sapiens
tagaattcagcggccgctgaattctagccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgccgtgtgagctgagcctcgagcacttccaggcgccactggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccgcatccgctcgagggctccaggaaggtggaggaggaaggaagccccggggaccccgaccacgaggccagcacccagggtcggacctgtgagccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagggccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtactggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccggcaggacctgcaggggacgagccagccgagagcccatcggagaccccaggcccccgcccggcaggacctgcaggggacgagccagccaagatcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggcttgcctttcttagtctgatgccaagcaaggccttttctgaataaattcatttgactttcgaaaa

SEQ ID NO: 691251 - DNA, 137 bp, Homo sapiens
tgtcacttgtgtggcaggtgcacatgttccaggtgtcaggaaatgctagctgagtgctgaggccgggcggtagagagcggggctctcactggttttttggtgtctgctgtgttgatgcttggacgacgggtaccgag

SEQ ID NO: 691252 - DNA, 549 bp, Homo sapiens
agcaggaggcccgcagacaggagcagggcccggacgtatgatctggctgtgcccctcctggcggggtctgcagggccgagggggccacccagagctcatgtccacctcccacctgatgccccagcacccgggaccccagaattccctgagcgcacaccctgaaacccccttcgagtcctcctgaggccttcccagccctggcgtggaggctcccaggcccgaggtgggaggctcctccctcccaaagctaaacagggcttccggggaggagaagtggggggagcttcgggctcaactctctcccgggccccacaaaggtgagggtgggcctggcagggaatggccgctggggagcaagcctgcatggcagccgtcagcctcctgcgtctcaggctccagaggagaccccttcagcccccctgcgtcttgggctccagaggaggccccttctccatgattcacccgagagaagcaaggcatggctgtccctggggtccccgtgaggccttggaaggacgtggaggggcaggaagaagccagaagacacag

SEQ ID NO: 691253 - DNA, 244 bp, Homo sapiens
gaccttctctggctaaacatgctgatatcagcaccctaccctatggcgcatggcagagaccagaagacaggctctgaagctggaggtctccatcctggctgtcagagtccctctggccctccccgtcaaggctgcctcgggctcaactgtgagcttacccttatctagcaaattgcactcaggattgaacttggggcatggacaagtctgagcactgagcatggggtttctcccagcacaagtg

SEQ ID NO: 691254 - DNA, 104 bp, Homo sapiens
gagggctcacgggggacgttggccatcgatcacaggacccagtagtgcaagggccatcacgggccaggagcttggtctgggctccttgggacattggaaggctt

SEQ ID NO: 691255 - DNA, 327 bp, Homo sapiens
ctacagcagctatccaagcgcgtgtattcatattaattaaaatttgaaatctgaacacgtcagaccctctcgtatatatcatgggtcatctgacccctgtccgtctcctgtccctgcgttcatgtacggggccttacttaaactgccttcctggcttagctcagatggcagatgagagtgtagtcaagggcctgggcacaggagggagagctgcagagtgtcctgcctgtctagggtggagggacacctcttttgggtgtgtagacagcttggttccctttccctagctccctggtgggtgaatgccacctcctgagatcctcacct

SEQ ID NO: 691256 - DNA, 182 bp, Homo sapiens
catgttggcgcacgtgtcggggtcgggggggacagaaatggattttcttggcaataagcggaccctgggactccggggggcctaccccaaactgaagggcttccgtgaacacccccgtcctccgtaggggggcagggcagcatggcgggatccgtgggtcccgtcatcaagcacttgtggtt

SEQ ID NO: 691257 - DNA, 307 bp, Homo sapiens
  misc_feature (48)..(48): n is a, c, g, or t
  misc_feature (67)..(67): n is a, c, g, or t
  misc_feature (92)..(93): n is a, c, g, or t
  misc_feature (128)..(128): n is a, c, g, or t
  misc_feature (242)..(242): n is a, c, g, or t
  misc_feature (258)..(258): n is a, c, g, or t
  misc_feature (301)..(301): n is a, c, g, or t
cctctgaaaccttggacataagtaaagtgaacaaactgtaatttaaancaggatggtaatcaaaagnaacttgagatctctttataacatgnncattaacttcaaaagaccactggtaaaaaaaaccnatctccaagaccaagtaagttagagaagtcttgattttttagacttcactacggagttctgtacaccctttgccctgatgaatttgaatgggtttgatttgcaaatttggattnacacccattgttttgnaagcacatcagctgaataaagttaaggtttattttatttaganaagcaa

SEQ ID NO: 691258 - DNA, 294 bp, Homo sapiens
cgagaaatagaacctagtaagcccccagtaaagcaggggttgctggttgtcacgcaggtcctcatgtgaggccagcaggctggtctggcagtgtgggcaagccaagtggtgttgtgcagaagaatgcggggagcaggggcaaggaccccaacagcgttcttctggggatcttggccatcgtgccggcacgaggacaaagatcctgatcgtggcgggcgtggtgtacctgtagagccggccttatggtgatcgtgccggtgtactggacggcccacaacatcatccaagagttct

SEQ ID NO: 691259 - DNA, 612 bp, Homo sapiens
ctatattaattcaacatattatttattatttcttaatataataaaatttgaataattctatatttaaaaaaataatcccaccaaaattttattctaaacttacaccaaccaaaaaaaaaagagggcgaaaaaaaaaaaataaaaaaaaactcactacacaaccccaacacaaaaccctcaaaacaaaaaacaataccatataccacaaaaaaccccacaatctaatcaacccctgcgacaaaaaaacaaaaaaaaaaaaccctctttttaaaacaaaaaacacccccaaacccccccttaaaaacaaaaatctttcacaaaaaaacacaaacactctcgcaacaaaaaaaaaaacaaaaattctatcacactaaacaaatccccacaccacaaaaaaaaaaatcctctccattataaaccccaacaaaaacaaaaaaaacacccacactccctccagccaaacaactactccggtaaatatcacacgaccccctccaaaaataaagaaaaaacaaactccctaaactatcaacccatcaagacaaaccccaaccccgtcggtctcttcacaaaataagaaccctctaaacaccatacaatgacacacaaacg

SEQ ID NO: 691260 - DNA, 423 bp, Homo sapiens
ctccctcaccatttgtccacaggaaattccttgtggacaaaggacagacagaactcaaagtcgtcccccgagactcacctgagacaaatgcatatccaattgcttcctctgccctactgtttatgtaaaaatgcagactcactgagccacactaaactgtgtattcggtggaaggctggtcaaggactcaaaagaatccaaccttttgtctcttatctacttctaatctggaagcccccacttggagttgtacaatatgtgtattatataccttacacatattgactgatgtctcatgtctccctaaaatgtataaaagcaagctgtataccaaccaccttgggcacatgtcatcaggacctcctgacgctgtgtcacagacgcttccttaacttagcaaaataaacttcctaaattgactga

SEQ ID NO: 691261 - DNA, 397 bp, Homo sapiens
tgagatagagtctgcagtctgtcgcccaggatggaatgcagtggctggagtgcagtggtgcgatctcggctcactgcaacctccccctcctgggttcaagcgattctcctgcctcagcctcctgagtagctgggattacaggcaccctgcaccacgtccggctaatttttgtatttttagtagagacagggtttcatcatgttggtcaggctggtcttgaactcctgacctcaggcgatccacccgcctcagcctctcaaagtactgggattacaggcgtgacgaccacgcccggccctgaagtttaattcttttaattccacttatacacgagttacagaagcttttgctttgtcggctcctgggttgacaatggcttatacgtttttggtcgacg

SEQ ID NO: 691262 - DNA, 451 bp, Homo sapiens
gccccggcccagcacatcagtgaggtcatcacacaggactacacccggcaccaaccacagcagctcagcgcacccctgcccgaccccatataatccttccctggggcacagactgaccacgatcacatggagacatccgaacgacacaccacagatgaaacacatacaatacaacgaacggacgagaagacacagagaagaaaaagaaaaacagagaaaaataacaacaacaaaaaaaagaagaggacaaagaaggataaacaaataaaaaaaaaaaagaaagacatacaagaacaagagagacagcacagagaagacaagaaaaagaaagaagaaagaaaaaaagaaaacataacaataaaagaatagaaaaaaaacaagaagaaacaagagcaagataaacagaaaaacaagaaagaagacagaacaaaagaagacataagaaacacac

SEQ ID NO: 691263 - DNA, 314 bp, Homo sapiens
  misc_feature (13)..(13): n is a, c, g, or t
  misc_feature (63)..(63): n is a, c, g, or t
  misc_feature (71)..(71): n is a, c, g, or t
  misc_feature (77)..(77): n is a, c, g, or t
  misc_feature (121)..(121): n is a, c, g, or t
  misc_feature (132)..(133): n is a, c, g, or t
  misc_feature (166)..(166): n is a, c, g, or t
  misc_feature (209)..(209): n is a, c, g, or t
  misc_feature (218)..(218): n is a, c, g, or t
  misc_feature (224)..(224): n is a, c, g, or t
  misc_feature (227)..(227): n is a, c, g, or t
  misc_feature (309)..(309): n is a, c, g, or t
tacagggataaangttgtaaagcctgaagctcaatcaactggtgttggaaagtctcaaagggngtgaaggnttgatntcaatggtctagaacatgtactgtaatttaatagaagagatggncgtcttaatanntaatgatttaaaagaacttcccagtccttgcgnagggttcagtccaagaataaatcaaatttctgaacgcattttntgctacatntgtgtntantttgcgatcctcaggtgttcgtgccaaatattctctctcaataagtccttcaatacgtttcttaataacaactggacttggnaagaa

SEQ ID NO: 691264 - DNA, 134 bp, Homo sapiens
tataggtcctcagtgtagtaagaagagtatgcacaaagatacacgctgcactctggtcatcggcgctgaggtagacagagaagaggtcctgagaaaccaggccctggttccagatgttgtcaaagatgggtgtg

SEQ ID NO: 691265 - DNA, 278 bp, Homo sapiens
cgatttccaagtggacttcgatgaccagtacatttgtttctgcatctggggatagaactatgaaggtatggaacacaaagtacttgtgaatttgtaaggaccttaaatggacacaaacgaggcattgcctgttttgcagtacagggacaggctggtagtgagtgggctcatctgacaacactatcagattatggggacattggaatgtggtgcatgtttacgagtgttagaaggccatgaggaattggtgcgttgtctcgaaggccgcttactatttt

SEQ ID NO: 691266 - DNA, 224 bp, Homo sapiens
tagtcgcaacgcaggaatagtacccgcattcccaggctcctgaatcgctggatagtacagcgataaggttcaggctggagggcgttgttcaccccgataagacagagaacgaagtatccagccatgaacgaaatagcagataatacctatgcggggttacggtaatccagccatatgccgccagagacttcatcgcgtcgacgagacgcgataagagacagcgg

SEQ ID NO: 691267 - DNA, 260 bp, Homo sapiens
  misc_feature (3)..(3): n is a, c, g, or t
ggnctctcagctcatgctggagcgtgcggaatctagctagatggtgtggactgttcctcagcctcctcagcttgtgtcttataagatttcagtttggcctgaagtgtatctagcaaatcttgaagcccgagaatattcttgtctatcttctgtccgtctggatgaggctgagcagctgggcctggagggtgggaagaagcagatccagaaacgggaggtcgagggtacgggagctggaaggagaggatcacttgatgcca

SEQ ID NO: 691268 - DNA, 165 bp, Homo sapiens
agacccacacctgcctatcatagatgaaacagaaaatgccctttccctccgtgggctgatgggtgtgaggggacggatagccgatgatccatgctatctctcacacttgctctcactccaaattggtgtcactcagggaggaagggagaaccatgcacagaaact

SEQ ID NO: 691269 - DNA, 159 bp, Homo sapiens
agggagatggcgaggggttggtcaggttccctttctcaatcggggggtggtttacagattggttcagttggtgaaaattcacggagctctatgaacaattataatatgtacatttttttcggtaaggtgtattaaatttcaataaaaagaattcacact

SEQ ID NO: 691270 - DNA, 796 bp, Homo sapiens
taaaaacaaaaactacatgattatctcaatagatgcaaaaaaggctttgataaaatccagcatccccttatattaaaaacccctaataaactagactttgaaggaatgtgcttcaaaataataagtgccatctgtgacaaacccacagccaacatcatcctgaatggggaaaatctggaagcattccttttgaaaaccagttgaagaaaagaatgccctctctcaccactcttattcaacatagtattgagagcaatcaggcaagagaaagaaataaaaggcactgaatagaggaagtgaaactatccctgtttgcagaaaacatgattctatattttaaaaaccccatagtcttggcccaaaagccccttgagttggtaaacaacttcagctaagtttcaggatacaaaatcaatgtacaaaatcagtagcattcctatacacccagcaacttccaaggcaagagccaaatcagaaacacaatcccattcacaatttcccccaaaatagtaaaatattctaggaatacagataacaaggagataaagatctctatgagaactacaaaaactatatcaaagaaatgagagagaacacaaacaattggaagaagcattccatgcttctagataggaggaagaatccatatccattaaaaatggtccgtaacggttaaagaaatttatagattcaatggtattcctatacataacaattaaattcttcaaagaatagaaagacgattttaaaatttcacatgaacaaaaaagagccaattagcaaggaatcctaagca

SEQ ID NO: 691271 - DNA, 967 bp, Homo sapiens
gggtgtgagaggtgcctcgctctcaacggcgagattcttcaagtcaatcactactgtcatcagaccatcccggtgtcctccctctccttcatcacttgaggaatgatcacgtgcaatcatcaatccatttgcgaggaatggctattgagagggcccattcgtcacccggtaggaatagtgggctttggcagaatctaagtagaagtatggattagtattaacttgtaaagagcgaggggaatatactagaagaatgttcattcatctgagtcctcatgcgtgtggtagacgcaagggttgtgttgctaggagccaatgattggtgtctatgggactatttcaatgtgatggggaattttggggatcaatcctatgtacttaggaagaacgagatgctgtcttggtctctgtcgggaggaggctatgtcttttagttaggatgttctataatgtgattatgagtctaacctgatttatggtaggtaatataaactgaatgtgggtcatgggtttatgatggtaatcaatggtcatttggaatataggttgcataagatgcaggtagagaagctggggggggcgaattatagatgatagatttcttaactaagtctttcacggaagtcaaggttatagttaaaatgttgctaaatgtgcttgatggtgttgaatgttcggctgattaaggttcaagatgaacttaggataagagattcggtaaatcgatgaaccttgattgctgaaaagtccacagttggtgtgaataagtctaatgggcagaaaataaacaggggcgggggcgagggtcctttgaaccttttaacatgcgggtatactgggagttttacgggaaaatttggtgtgtccaaaagggggcaaggttcttttaaaaacgccttaaaagaatttcaaagttggtcacatagagaaaataagggtttttattaactgaggtgatgaatatatg

SEQ ID NO: 691272 - DNA, 186 bp, Homo sapiens
cggacacccacagcaaattgtagccatagccgttcgtgtgagttcatttggtgctccgcttgtcggactggcattaggaactgcaccttctctgggacgaccctaaggtacttacctgggggcagactgatgctaacttgtcatgcgtcctcctcaccactggcgacttgaagtgtattgcctttt

SEQ ID NO: 691273 - DNA, 410 bp, Homo sapiens
gacacttgtgttacaagggacctgagtggacctgtctttctactgaatagaacaacgaccgctgacaacagcagactatgaacgacctacatctgtaagatgactgaccatatgccgacgaccagaatatattggacctagatgatcatctccagcctcgtaggtgctgctacactacatataggtgctgtccggtgacttgctgccagattctactattccatcagcacctgttgactagtacgctatcgctgactcaattcgcctgagtattgatgtatcagatatacgacacgagacatgtatcgaccgcataattcggatgaccggctgacttatagctatgtgatcaagacttagagctggactaccgctgagaccgactttcagtaggacatgatgctatagcg

SEQ ID NO: 691274 - DNA, 142 bp, Homo sapiens
  misc_feature (21)..(21): n is a, c, g, or t
  misc_feature (45)..(45): n is a, c, g, or t
  misc_feature (89)..(89): n is a, c, g, or t
  misc_feature (97)..(97): n is a, c, g, or t
aattttaaatacatttatgcnagttaatattgctttgctgatgcnatttgcttatttgatgttaaataatgctattgtaaataaagaantctgttgntattgcatcatttaataaattttaatgcttcgggttttacatggc

SEQ ID NO: 691275 - DNA, 149 bp, Homo sapiens
  misc_feature (1)..(1): n is a, c, g, or t
ntaggtgatatctactctggtcatctgcacatgtgcatgtgtgaatgtgcagaatcccaatcaggatgcagctccctgcaaggaggcaatagttgtccccttaatgaaggatacaatctttttaagactttacacatgcattgcaccca

SEQ ID NO: 691276 - DNA, 128 bp, Homo sapiens
tcgttgggtgaaggtgagtatgttctgaactgggacaggtcttgtctgggttggaaacggattctcaagaagaagaaaagacagaagcttgacttctgctaagcggtacatcgagacggacccagcaa

SEQ ID NO: 691277 - DNA, 475 bp, Homo sapiens
tctcaaaaaaaaaaaaaatcatgatttttcaggtttacaaaagtatattttagacttttttttttttcagatggagtttcactctgtcacctggctggagtgcagtggcgcaatcttggctcactgcaacctctgcctcccaggttcaagtgattctcctgcctcagcctccccagtagctgggattacaggggcccaccaccacacccagctaatttttgtatttttagtagaaatggaattttgccatgttggccagtttggtctggtactcctgacttcaggtgatcagcccaccttggcctcccaaagtgctgggattacaggcataagccaccgagccccggtaatttttttaaaatactggtatttaacgtatggagagtttgaaaattttgatcaaatttgatagtgagtttctgagttaaagaaatggcacagtacatgggcatattgcatgacagtgaggttaaaa

SEQ ID NO: 691278 - DNA, 361 bp, Homo sapiens
accaccgccctatatacctacctttcctctgcctctttcactcttactcatttgcacacattttgtacctcttgaatttttctagagacactgagctattaattttttcatatttttttctcctgatctctagattttgtaatttctatggatataacatcaagattctgtgtccttcttctgacataagctgttggcttctttcaggtgcctttattagactgaagaagtccttttttccagcaccatttattgaagatactattctttcctcattcttgttcttgacacctttgtcgaagattagttaaccttatatgagtggccttatttctgtgattggtaggtatgatgaaggacg

SEQ ID NO: 691279 - DNA, 1020 bp, Homo sapiens
ctatattaaacaactacgacctgatgcaacatatcatctaattacatcaacatctcccgactgtttggtagcatctcaaatatcccacacacatgcgcgtctttatgatgatggtctaccaatctgtctgataacccctgcaatccttgttgcccctatgtctctgtgtggatattaaacccttctattctgttgtacaaacagactcttttttacaccctcggtccctgtaattccccttcatccacgtccctctatcgccgggttcttggcgcattccctcgggacatcccttctctccgccctccctgtggctgcgtggtttcccccgtcaactggatctcgatcagactcccgtctccttgggaaactgtccagcgaatcgcgtctatttccctcttctaaggggagcccccccgcagctgttccacaacaaaagaaggtcgtctccccctgcgcgctgaggtgaaaaaaagcagcccaccaccagcgatttctggcttctgtacacacgatacgcgccagtgtctccttaggtggatcaactgatacatactcctagctgattcactacaacaagtagatgattgcctactctatcttacagaaccacatcatcctatgttacagtgcgaagcaagcgggacaacaaacatacattccaccaaacaaagcaactgttgggtcagattgtatttcgcacaatgtcgatttatcccccgcgctgaagcatgtctctgccgcctgcgctgggtatacaaccggtcatacaagacgttgtgaggtccaacgaatcatgacgagtggactcttcgtatattcaaatcacaattttgtggctcaccgcacgacacttggcgtcccctgagtacgcggggaaaaccacgcgtcgtgtccacccaacaggctggtgtttgtaacaaccccacattctttcttgggtatgatccctgttgaaccaaccaaacattcccacaaaggccccggttttaaaaaaaattaaacgcgccccacataaca

SEQ ID NO: 691280 - DNA, 947 bp, Homo sapiens
  misc_feature (739)..(739): n is a, c, g, or t
ctcagcgattgcatgatagtagtaaactagtctcctggaaataatggatgtgaggtgcttctagaatatgttacagaatttcagacttaacctattaatagataaatggatcttgacttaaggtgacaaaaatgaaaactttgattattgcttaaaaatgctgtgccagatattgtataactagctcctcgtaatacattttggtattgttgcgatttaataatcaaatggaaccttaagcattttaagtgtgcaacatgttcagggagaagtatgctttgagtagtatacatgtctcagatctaagttgtaacaccaagtttgaatacttgtggcttattcttggtttaacttaggaaaactggttaaacaatcccccattggggcctgtcatcattttaagtaggtgacgatgtgctttctgagaaatgcttgccagggtcgggagtcaggctgtacatttcttagtaaagaattgaaatattatgttcaaattcttgagcctttttgccagttgtgtaaaaagcaataatttgacgatgatttctcctgtgtagaattttttgaaaaatacccacaggttggagcatctttcttatgggttgcacgaatgaatttatattttaaaattagattaagtagaatgtgaagtaccatttgcagatgtacctagttttcgttccccataggtcatcttggggtggcctccgattgagtgtatatcttgaaaaccattggnttgctaaataggcacgcaagggcacgggtccacagggacaattctaagttaggaccctgttttgaaaagttacctcattatccccatttgagggccctcgttttccacaggttctgttgaaaagcccggatttctttaacccggggctgtacaacgctgaaacacatggcggggaaaaccaccgggacgtccattctacttcaacacg

SEQ ID NO: 691281 - DNA, 631 bp, Homo sapiens
tagcgcgagggtacgtggatatagggaggatgtgtgcgattggaaattgtgtgtcattgcttctaggccctcttagatgggcagaactaggaaatatattgtacgtatactaacacacatgccacatgcctaatttgtatatttatttagccttactggaagcattcctttttttttgagacagggtctcactctgtcacctaggctggagagcagtggcataatctcagctcaatgcaacctccacctcctcggttcaaacaattctcctgcctcagactcctgagtagctgggattacagctgcccgacaccatgcctgactaatggttgtatttttagtagagatggggtttaccatgttggccaggctggtctcgaactcctgacctcaaatgatatacccgcctgggactcccaaagtgttgggattacaggtgtgagccaccctgcccagccttacatcatcattcttgagatcgcaatttagatagctctaatttcaagagacctttcctgatacttcaaagtgttctgtaccttttccatcttgacacttcgaaccctagtattgaaattgccttgtagtgcattggcattgcccaaaagctgtttatttcctcactaggcgt

SEQ ID NO: 691282 - DNA, 290 bp, Homo sapiens
gtcgcaggtcaactggatcttaaaaaagtagcaaaagcgctgggtgccaagaaagttgagatggccgatccgatggtcgcgcagttcgacgggatacctggttggggggattagcccactggggcagaaaaaacgtctgccaacgattatcgacgcccccgacacaagaatttgccactatttatgtttccggcggcaagcgcggactggatatcgaactggcggcaggcgatctggcaaagatcctcgatgccaaattttctgatatcgcccgccgcgattaagcattg

SEQ ID NO: 691283 - DNA, 285 bp, Homo sapiens
aaggcaagcgtactgacttcacttcttactgaactcatgtcaagctcgtgtagatattttcaactaagttgcttgttactaaaatgagacttaaattaataaacttgcattgtactctcttctttccctggacttccctttaacaaagatactaagaatatgaagtgaagcagctaagagagagacaggaaacttattcacaaactgggtattcaggtctctagcgttcagaatccctgctccaagtgactcaagtagagagctacagaaactgcccttcacttt

SEQ ID NO: 691284 - DNA, 509 bp, Homo sapiens
tataatacagcaaggagacatcaatgtggttcatgctagaaggcgtcacccagtgtggacatgttgagcacattgatggcggttgcacagcctcatataccatatagctttggttattcggttcagtgagtgccggtggctaccagacattgattcatggggcctcggcagtcgaatgaggaaagtctcttcagaggagcatccatgggtgctgttccccttgcagctgtaacactggcggccattctgcggcagattttcaagctccaggattgggccctcgtagcatttggtggtgttgcagcatttcaggaagtggaaggtgtcgttgttgtggaaaacattggagcccgggcagccgggaaggtagccacagccacggaggtggaggtcatcctttggtcgcccttcttcaccttcctggatccagtgagtcccacatccaggcaactgtacttcaggactgacggcactgtaggctctgggtgccggcccctctcacagctcat

SEQ ID NO: 691285 - DNA, 735 bp, Homo sapiens
  misc_feature (24)..(24): n is a, c, g, or t
  misc_feature (141)..(141): n is a, c, g, or t
  misc_feature (143)..(143): n is a, c, g, or t
  misc_feature (185)..(185): n is a, c, g, or t
  misc_feature (222)..(222): n is a, c, g, or t
  misc_feature (252)..(252): n is a, c, g, or t
  misc_feature (284)..(284): n is a, c, g, or t
  misc_feature (288)..(289): n is a, c, g, or t
  misc_feature (347)..(347): n is a, c, g, or t
  misc_feature (353)..(353): n is a, c, g, or t
  misc_feature (358)..(362): n is a, c, g, or t
  misc_feature (422)..(422): n is a, c, g, or t
  misc_feature (431)..(431): n is a, c, g, or t
  misc_feature (470)..(470): n is a, c, g, or t
  misc_feature (508)..(508): n is a, c, g, or t
  misc_feature (517)..(517): n is a, c, g, or t
  misc_feature (552)..(552): n is a, c, g, or t
  misc_feature (583)..(583): n is a, c, g, or t
  misc_feature (585)..(585): n is a, c, g, or t
  misc_feature (700)..(700): n is a, c, g, or t
ggaatagggactttaataggtacngagtttgtttgggataataaaaaaaaagtgagatggggctgggcacagtggctcgtgcctgtaatcccagcactttgggaggcggaagtgggaagatcacttgaagtcaggagtttnanaccagcctggccaacatggtgaaaccccgcctgtcctaaaantacaaaaattagccgggcatggtagtgggtgcctgtnatcccagctactcaggagactgaggcaggngaatcgcttgaccccaggaggcagaggttgcngtgnnccaagatctcaccagtgcactccaacctggggaacagtgggagtcctcaaaaaaaaanaaaaanaaaannnnnggccgggcgcggtagctcacgcctgtaatcccagcactttgggaggcccaggtgggaggntcgcttgancccatgttggacaacgctgtctctaccaaaaaattttanccgggtgtggtggcacacgcctgtggtctccgctaggntgctgaggngggaggatcacctgagcccaggaagttgaggctanagcgagctgtgatcgagccactgcacaccangntgggcgacagaatggggcccagtctcaaaaattacaaaataagaaaagtcccattgttcccaagatggtttcccgcctttaccccagatgtgtgacctgagcaaaaaaacctttntgtacccaactgcctcatctataaaagggggggaa

SEQ ID NO: 691286 - DNA, 1089 bp, Homo sapiens
cgcctgcgcgcctccgccttgtgagctcggggtgtttcggggactgcgtgcacaggcaggaatggcgctcctctcctgccccgcctgacgcccggccagccctgcttcgccctgacctgtttcctcatgactgccccctggccctgcttgccgactggacgtctgccccctgtgtcgtccgtgatttaacactggagaaccctggatcggagtgcctgcgcggggcagtgaggaggtgctgaccctgtgtcgtgtccttgctgacgcctctctgtgccctggcttctggctgccatcgagcaggagaggccaattgaccatctgctagaccccaagctgcaggcatcctgtgccttggttgcaagcctgtgcagcaaccagaaggacctccctgacaaactgcctggcctgaccacaggggacggctggagggctgggcggggggcagtgctgagctgcccggggcaagcacatgccggaagggaactgaacagcccgcaagaaggcgcggccctgccgaactcgaagacacgggaactggaaccagaacagaacaaaaatgggagccagaactttcccaaaaggtggcacaacaagcctgtccggtgacctatggagactcgcccgttggaaaacttgcacgaaagtatgtgaaccaaggcctggacacctaccacatttgaccgtatggacaagtgaccccctttacagagaaggtgaacatcaccagaaccgtaaaagggtgagaattataaacccaaagcgctaactttcacaaggatatgatagatggggaggcacaaaggtttgtgaaacccgtttggggtataaaataaaagtttacgaaggtttccgatttgggcgagcaagtttttaaaagcagggatttaggagcgtcgccattttgggctaacatttggtcgtataagagagattatagtggggagcgaatattataaaagaccaaaaattatgagagaagagaaaacggtagaaaaaacggtgaggattaaaaaagcgcaagagcactgataaaaagaacaggagagccacattatatgatatgggtagaaaaatttggaaacagag

SEQ ID NO: 691287 - DNA, 1141 bp, Homo sapiens
ggcctggccggtgagcaactggctctgctggccatgtgctgagctgtgcgagcattcccccgtgcagctggctgcggcccgtgctgtgcctgctgcactccgacgcagtgctgtggacgtggcctcggccatccaacttcctggtgcctttgacgctgctgcacttgcacctgtgacctgcggtgctgagttctgggcctccagtggcccggcgcagggacgccgtgggtgctgagcggcacctgctggtcctggacctgcgctgcctggagcccgagggcgccgccgagctgcgggctgtgactcgcaaccctgtgcctggcaggtgacgtgctggctgtgctgctgctggctggggagctggccctggctcggacggagcccggcctgcgggacgccctgttgacgcttcctacactgcagccgcttctctgcccctaatggccatggcccttgatgcgatgtcctatcccgataggaccgtgccgccgtccgaccgagcggccatccagggatgcttgggtcaccttaaccggcgatcgggggaggggaccccagggggattttgcatggtatggcttcccgaggcagacccagcacgggaaacgacagaagcccataccgatgtacaccccaaggggggccaagggctagatccgtaaaacctgggccgttacattcccccgttgacgtatcggagcagccgccactgcattgttcagagtaccaacagtaattacaggctcggttattaggagggttcccaagactggcgcctatcaccagggccgtgggtacatgaaagggtggctaaggccaacccatgggggaaggcacacgacgacgggtgtcccacaaataagaggttaccctatacatatcccacagcactgggtgatcaaggaccccgaattccccccgatacgcgataaattcgttggaaattaggccaatttggggggaccaaattcggaggaagaaaatcagtggggagattaacagaggaggttgaaaacgattagggagacccccaaggggaagagcccataaggagttgattaggagcatagtagaggacccattgggacatttgacttttggattgcgtgtgccaaaggggagtggaagtaacaaacagtgg

SEQ ID NO: 691288 - DNA, 489 bp, Homo sapiens
aactcacacatataaacagacatctaacacttctcaacatgaatataaatggttggaaaaaatgtcattatccagtattgtatcatttatattataagaaaccgagtctacactctattgcacaggctggagtgccctggtgcgatctcagctcactgcaacctccgtctcctgggttcaagcaattctcatgtcccagcctctccagtagctgggatcacaggcacctgccaccatgtccaattaatttttgtatttttagtagagatggggtttcaccatgttggctaggctagtctcgaactcctggcctcaagtaattcacccgcctcagtctcccaaagtgctgggattacaggtgtgagccactgcgcccggcctattacggtacttttttagcagaaacctgtgaaagcctgtgagcaaactctatacctcacagggtttttttccatatatatgaaatgagggtctcttggccaggggttc

SEQ ID NO: 691289 - DNA, 248 bp, Homo sapiens
cctaaccaagcctatgaccaaccgctttgtgaaattgtcagtgatggggcttacagtggcacttggagcgtctgctctggctgtgaggaaaagtgccctggaatgggcccctaactgtcagttgaagctttttccttcaaagccagaaaagaccttcctgttacatcacattaaggtctcacccttccatggaaggattggtaggcgtggcatataatctgtcaagggttggggcttccactctgaat

SEQ ID NO: 691290 - DNA, 711 bp, Homo sapiens
tcagaggactcctgcatgcccagaggtacgtgaacacactcctgacactcatcccgcgtggtgctgggtctgcaggaagcaagctgcggcaggaagtgcacaatggggacatggagaccgtcccatggcatctgtcgcatcgctgtggacctgggcgaggaccactccgcgggccttgctggaccaagtagagcactggcagagtttcctgacactcgtcaacatgattatgttctgcacaggcatcccttggccactatcctgtcaatgagaccgaccagctccctaagcctcaccttctggtacacactgcaggatgatattctagtcctttgaggcagagaagcaggctgtataccagcaggtgtacgggccagtctacttccagctggtggatgtgcttctgcacaaggcccagtacccttctgatgaggaatatggattctggtcctcagacgagaaggagcagttccgaatttacagggtggacatctcagacacgctcatgtatgtctatgagatgttgggggccgagctgctcagcaacctctatgacaagctgggtcgtttgctcaccagctcagaggagccctactcctggcagcacacagagggcctcctctacggattcaatccatcgcagagaccattgacgtcacctattctgatgtggtgcctggctcattggctcatccagggatagatcagctg

SEQ ID NO: 691291 - DNA, 1257 bp, Homo sapiens
gctgcgatcaagagagcaccatggctcctacattggaccttgtgagcaccccacaccctccccccacctgtgcccttgtgcctgccacccagagccaatgagggtgctgctcagttgcatgggcctccgcagctggacagagagtgggtggagtggagggacagacagaatggccaagggccgatgtggtgtgcagaggtggggagtgtggcgaggatggggacagaaagcgcacagaatcttggacacaggtcatctattcacttgtacaaagatgaatgtgaagaccatcaaagcaatgacaagaaaaaatgatggaagaaagaaaagtaacaaatacaaaagaaagagatgaagataataacagtaaagataacatgcatggaatgaaaaagagatagacaaatacgtgatgaacagaaaaagaacaataaaaggaaaaaaggggagcagcagaggacggcgcaagatgcacacgagaagaggcaccagaaagcaacgcaagcgccgagaagaagacaaggaaagaaagaagcgcactcgcagacagaagtccagaaccgaggaacagaggaaaccaagacgacgcgagagagcacgaacagcaagcgcagccaagagagagaaaaaagcgacgcagaagagacagagacgaagaagacaaacagacaaagaggagaaaagaaggaggaggacgaacgggcgagaagagagaacgagagaaagagaaagagaagagacggaaaagagaaacgaagcaacagacagaggcacgagaagagaaaaacacaggcgcacgagccaagacaaaaccgacaacaagcaagaagagaggaccagcagccaagagacaagaagaaacaaaagagcacagaagcacacacaaaaacgatagaaaaagccagaagcggagaagcaagaaacgaaagggggagagaggacagtatgagtcagcaaaacagaggagaggacaaagatgagaaaacagtgatagaactaagtaagagtagaggacatgcacgataagtagaaacagaagaaaagaaagaaagaaagagagagagaaaaagaagagagtcagagaaaggagggcacgcacgaagcacagaagctagaacggctatgagaacagagaagcataagagaagcaaaaagcggaggagcaagggtaggtgagacaagaagtagcgagaagaaacagaaaaggagagaaagtaatagcaggagcaagtgcagacatctataatagctggacaa

SEQ ID NO: 691292 - DNA, 194 bp, Homo sapiens
atacgtataaatatcatgcgatgactgggcacagtggctcacgcatgtcatcccagcactttggtaggccgaggcaggcagatcacccgagcccaggagttcaagaccagcctgcgctacatggcagaaccccgtctctaccaaaaattagccaggtgtagtggcccatgccctgtggttccaggctactccag

SEQ ID NO: 691293 - DNA, 115 bp, Homo sapiens
tgtttttgtagatgtgatccatgcacactgctgttttccttcacacttcatttccatgtagataattcccccttgtctgtgaagcgtgagattaaataggtctttatctctttta

SEQ ID NO: 691294 - DNA, 956 bp, Homo sapiens
  misc_feature (764)..(764): n is a, c, g, or t
acaaccaacaaacagtacaaaaacaggaaaagcatggcattaaatagaccacaaaaaggatacctgactattgtatgagagctgaaaaagaaggcagaatatcatcctgttcaaactcaaattctttgacactctgcgcaaacacatgactatgaaagtgctgtgagtactgatttgggggttacaaaaaatagtaggtgagttcacaaatacaaaagctgaaaacaaggaggatcgactgtattttcgtagacaatctaatctcagaagatttcagttcagacaaaaatcatgataattactgtattacaaaagggcactagataggggggaaagagtaaaaatcacaattaaaacaaaggttcaaaattctgcagcaaccatatccagttacactttaatatgtttgcggcagactacattattgttcccaactcatcacccctccctatatctaaaacctttccccaagacaatgcagttcctcctgctagagatcaggtatatttatctatactatcaatgttagccatggacaaggtatgtgctttggctgactgaatgttagtggacatgatagaagcaatggcttaaaatgtacttccagaactggagtttccttgtgattctatcactgtgacaaaaacacattctcaggtagtccactgatccaagggggaacaaacacacagaaaacatacctagactctatctgcagctcgcagcctcaccaagccaggaacagtcaactcacagatatgttngcaaaaataaatgtttttcgtaccttaagttttatataattattgacctatagttaactgatatacaatatacattaatcttaaaatatcattatcccattaaaaatatttacattaaaaactgagaccactttctttcctccttttttttttttttttttttttttaaattaaagagccggggggccccag

SEQ ID NO: 691295 - DNA, 654 bp, Homo sapiens
  misc_feature (64)..(64): n is a, c, g, or t
gggaaatggcgcggggtccgctatggcggcggcagccgagggcgtactggcgcaccggagtganagcccgcccgaggacgatgccgccgtgcgagacagctgaggaatctaaggagcctgctgaagctgacatcactgagctctgccgggacatgttctccaaaatggacacttacctgacttggggaactgtaacgggcaccagtgagagactattaagctcctggaaaatatgaataaagtcaccagcttgaagtatcttgaagtgaaagatattgctataaacattagtaggaagcttagaggatcttattgaccagaaatatgctggactgcaggcttatctggatcagatcatgtgtcattgaagagcaggtagcagctctgtgagcaggcaggttacaagtgggatgcgtattcaaaaaaagctggaagccaagtacaagaagctggagaagcgatgagaaacttattctctatgggacagagtcttttttttttaatgtggaagaatgtcttgtaaaacctgaatcctgaggttgatgaattgtgaaaatcctcaaaaggaaattatgctggtcatcacaggaaacctctcaaggttcgagtaacactggaggactggggtattcctgaaccttcttggagacagaa

SEQ ID NO: 691296 - DNA, 495 bp, Homo sapiens
aaggcacagttcagccctagatctgcagatgctgtcctcggggtccccctgtttgacccggaggcaaagtggcctgttgcctagtcctgcctcagcgtgtctcgcctgcaaatccgggacctaagtggtggaggagaaagcctggatagtcccagagcttcagccccctttgtcaccttggcgtgtcccgtgctgcccaccgtttacttcctgtctgtgtgcctccgtagccccatgggtcctgtgttcctgtgtccctgatagctctccaaggtgactgtcctatgatatatccctttgcccacacctgcccaccagtattatttatgctctgcttgccggtgatggccgtgagctcacagcattcccagggtgatggctggtgcccttgcgaggagccctctgctggttccacactactccctacctaccctcacatggttcatggctatggagacttttgctgtcaataaatagtttggtttgaggattgca

SEQ ID NO: 691297 - DNA, 753 bp, Homo sapiens
  misc_feature (340)..(340): n is a, c, g, or t
gaccttacacggttaccagagaccatagataataattctgtgacttctccacttcagtctcttcagtcatgagaacatggttcatatcactggtctctgttatgtgttcttcaatcaccccaaaggttcgcgcagtaagtattacttgagcttcttcctttagtcagtccacaattatcttagatgcatattcagacaatgtgtccatacgttcttcgtgtactgtgactacagcgagtcatagagcagaacaaggtatgttcgagaaagcgtgcgggcagcgttactaaaggagatcctagttagaagtatattcaagcatggaaggtcgttacagcantagttaaagaactccaattactagacatttgattgagatgtattatgatgcttaactttagacgttttgatggggctcagaacaaagctgatgcggaatcgtgaactcagttgcttgtgatatgacttcttccttggtggcttgtcttggaggatttcattgaaacatgcccgtctcttcatatttcgggactttctgtcgcatccagccagtgtttcagcattgatagcatgtttggatgataaattgaacatgacgtccagaagaagcgtgaaaggtggattgtgcaagtttgattagaaatgcatgactgtgtgccaagattgattctaaatgaggtcatgtggttatgggtgcaatgcagtctcacccatatcgagcaagtgattgctgagaccatggagccttgctta

SEQ ID NO: 691298 - DNA, 222 bp, Homo sapiens
cctagggatgcacttcttgggatcttccaaatactccatcagtgtatcctctccccagatgatgcatttgctcttattggcggctgagtcagagtatccaggggcctgacctgtcttccacctgaaaagaccatggagatttggcccaatcttgtgctttcctcccttttcaacagtgtagcactgggaacacttcataataaaaatcttcttgcctttctc

SEQ ID NO: 691299 - DNA, 1043 bp, Homo sapiens
gttgcacaggagtgagacactctccctctatcaatcacggtgtgcatgggtcgacatagatgctagtcgtattaaggagtctccaggcatacaggagctgtacgtgctatgctcacgtagcactgataggacacagataagatttaacggattctgctatgtagaagttcgatgaagtggcttcccttaaggaaggcttggcacaatacgatggatgcaacgtagtatggtgcgcatcgtgtcaagtatcgtcgctgggactattgcataggaaggacatgcacaaaccacagtcattagataggtggcttaggtcattcatgcatggcagggtgggaacctagcatggaccaggaagggcgtctcaagggtagtgagcgtccgtcaacgggggccaagtggaggagcgtaaggtccgccccgagagccaggacccgggccgtaaacgagagcaccgcacccactgacgcggaggccaagagcggtgaatatcacaaaagcaactgagggccactgacgccacgatacactgagtggtgacggtccccgagagagcacgtggggaattataacaaaagaaagaaaaagaacccaaaaaaggaataggaaggggaccaaacgcaaagccaccgcacgaacggaacacaaggagaaccataccgacaacctcgtagaatacgccaatccggacaaacatggtccggccagaagcggaccccccctatccagaggccaacaaggaataacgccaccagaaaaacccaccaccaacgatacctgcacacgaaaaatccctataccgacggaaaggggataggacacccaagaggacccatataatgcgacgcaacgcgcaaacacgcatcccggaaaaccacaacaacaccaaagtgggaacagcagcacacacgagaccaaactaggaacagacaccatggacagaggcagttgagcggcaagggcgacaatcgacgcggccacgcacgacaggggaggaacccagaagcccagaggcacaccccagcacagaccgtgagagcgga

SEQ ID NO: 691300 - DNA, 159 bp, Homo sapiens
tgtctgtctatgattactctagggaacttggcagctgagtgataaaaagactgcagagtgttgaaaggtctaactcaacctactaggtggacaaagcccacatctgcttaatacacttgattgggagagctgtggaactgcccgtggctaaatccgccc

SEQ ID NO: 691301 - DNA, 555 bp, Homo sapiens
tgcctggagggatcattagcagagaatacttagagaaaccacgtgagagatgccactacagtccagtgcaatgtacaagaagataacttaaggcagacaggaagtaagaatctaaaggacttagttcctaactataagctatgatcttagaagaggggattttccgctggctggacttacagtataatacaagataaagtaacacagaatagatcagtccgggttagagggagaggggaaaaatcagtttgagacagttggatacaaggtatctgtgaaaatccaaagaaccaagtaggtaaatgaaaaattcaggtctcgggttcaggagtgatctgaagatacagtcagaaagattggaaagaccgggcgccatggctcacgcctgtaataccaacactttgagaggtcaaggtgggcggatcatctaaggtcaagagttcgagactagcctggacaacacagagagatgctgtctgtacaaaaaaatttaaaatttagctgaacatggtggcacacacctgtagtcccaactactccagcgtgctgatacaa

SEQ ID NO: 691302 - DNA, 891 bp, Homo sapiens
caccatcctctgcattgacttgggcactgacatggttcctgccatctccctggcttatgagcaggctgagagtgacatcatgaagagacagcccagaaaacccaaaacagacaaacttgtagaatgagcggctgatcacgcatggcctatggggcagattgcgaatagatccaggcccctggcgatggcttcttttacttactcatagtagatcaactggctagacaacgcgattcctcctccaccttcacctgtcgggcctccgcagctggaccacgggatgacctgctggatacaactgatagtggaaacacagctcacgagatccgtcaacagagacctaatgcagacagcaaggacacctccgtggagtatccacctgccaacacaaaccactatctatcgcaccacgctatcgtaggatgagtgcacgctgcggccgacttggtcactcttgctcacacctaggaggccccttcgcgtctaaccgaccaccggagatcgaccgacagcacgagatctatgcatcatttcttggcccctacttacagacagaacgacagattcctaggcacaggtcatcctctttgcataactaagccccagcaaacatgcgctcgtcccgatcttctcacccatagtatttccaccatctaacatacttcacactaggacacggttccctcgttgcctttcccccattactcctacatattccatcattccacaaatcatacaacacaactccacgaacaatccatacatcaaccgctgaccgccctagaccagctatgccttgcacaaaagcaacctcatcaaataaccccccacgccatcacacccggagtagcacaaacgccaaacatttcacatctgaaaccaactccaaaa

SEQ ID NO: 691303 - DNA, 880 bp, Homo sapiens
tgggcaccccattaaagtgcagtcccctccggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaagaaagagagagagagagggggcggcgcgcgcgcggcgactctctctctctctctcgggtgggagggacaccggggaccccacacacacttatttatattgtagaagaagaggaggagccagtcactcatcaagatgttgtgggtatatttaataatacaaagaggcgagcgcgcgtggtggattaatatacaaagccaaacaatagaagagcgagaagtcgaacaatatacgttggagaagagatgatgttcatcattgatgagaataaagaatagacagactccctgttatcaccgtgagtgggagaggaccagagagagatatagagagagtgaggtccgatattatgactctagatataagagaatgatagtatctgaccgcacacgctagtcaggagagctatgatatatgtaataaatacaaatataataaaatatagagataaagaaggagatgaagagggggaggttgcactaaacaacaccccctgcatctcggttcttattattgtacttgttaggcagagatcgggtcgtagacacatgagtctaaacctgacagggaggtgttgtaaggtactgagcgaagaaaagaagcatgagatagattttctacactatttacgatcatcagtacgctaacctaattgatgaaaggtatgcaacgcgagcagtgacgagtaagtaaaacataatgactcgaaacccggtgagggga

SEQ ID NO: 691304 - DNA, 1467 bp, Homo sapiens
  misc_feature (177)..(177): n is a, c, g, or t
cggacgcgtgggtcggacccacgcgtaccggccatatttcacctccgactaccataatcatcgcatatccccaccggcgtctaaagtattgtacgctgacttcgccacagctccacgtggaagcagaatatcgagaatagatcatgcatgcaggtgacgtctatgagccctaagganttcatcattttctatgtacaccgctaggctggaccatgacgtggcagtctgtattagtcaaagctcgatcatctatgacactcagtgaacgtacacgtacagcgtacgtgacgttaagataagtcgtcacctgctcagctatgtgcgcgtaatcaagatggaggacgctggtatttgcctatccataggaggcttcatgcgacttgatttccccgtattctcaggctgacatcctaggaccaaagcatagggccaagaaatccatgatcactatccatattcgatcgggcgttacatcgtaagactgttctatccacacagacactgttctcaggtcgtactccgggacattgcccctgacgttactctggcacgaccccggatgcgaatacaccgaggatgaaaactagtccttatcatctgtaggactcgattcatatgctctgaacgagcagtgaatgatgtaataatttccatgaattggggaagcccttcgcttcggagagaggaaaagacctagaatagtagatagtgagcccttccattaatacctgggagtgagctatactgggcttggccctcccaccctagcaacaccattgccgaagaaaccggggtatacattaaaagtcctagagccacatactgggaccggaggtgggaaccccccaaaaggggggttcagggggcctaaaaccacaggtgggcctccccaagaaccttttgtgccacaaaacaacaccaccgacgacggagcaaccacaaaacaggggcaacaacgcagcttcagaaacgagcacacaaaaaggcggggggcgcgcgcgcgagcagcaaccacccggccgcaagaggggggagcacacacagcgtgcacaacaaagaccgcatcaaaagcgagaccccccacaccagagccggcaaaaatcaataacggcggcgagggcccccccgaaaacacacaacagcacgtggagacacgcaaacacgcaggcggtagcacatgagtacagaaacaacacgggggcggcaggaagcacagaagcacacacagcaccaaataaactccgcggaccaacacacacaaacgggcgtcaacgacacaagcggccgtcacgaaggcgactataaccaggcaatagtaaacgaaagactcagaagaccaggcgatcgacaggccatgcgagcagcaacaaatgccagcagcagcaactcacactctcccctattcccatccgagccacggagagagacgaaagaagagcgacggcaatcacgccacaacaactacta

SEQ ID NO: 691305 - DNA, 246 bp, Homo sapiens
ccccccttttttttttaatgattttttaattaaaaaaaaaaccccccggaaaaagctgttgggggggcccagtggcccaaaaaacagcttcaaaaaaaattccttggttttatgatccccgtttaacccccaattccagtggggcttggaaacatcctttgtacccttgtaggaaaaaaaaaagttttggttgtgaaaaaccatttgcctttgggtaaaaaaaagggcccccgctttttttttgta

SEQ ID NO: 691306 - DNA, 469 bp, Homo sapiens
tcatgaggagcttcgatgaaaggtgatgcttagctgagattgaaggaagaggtatataggccataagaatatccacttctgctccacgaaggcaggaaccatatctggggattctgaccaatcacctttaagctttttttgcttttacgttttcttttttctttttcttttatggaaatggagtctcactctgtcacccaggctggatggagtgcagtggcgcaatcttggctcactgcaagctctgccttgtgggctcacgccattctcccacctcagcctcccgagtagctgggactacaggtgctcgccaccacacccagttaatttttggtgtttttagtagagacgggttttcaccgtgtaagccaagatggtcttgatctcctgaccttgtgatccgcccacctcggcctcccaaagtgctgggattacaggcgtgagccaccgcacccggtctctctattga

SEQ ID NO: 691307 - DNA, 444 bp, Homo sapiens
  misc_feature (111)..(111): n is a, c, g, or t
  misc_feature (151)..(151): n is a, c, g, or t
tcccactgtatgtagagcccaaggactttttgtcactgctatatcccaagaacctaaaataaatctggcatgtgttaagcgtacaataaatatttgttgaactaatgaatnggagaaattacagtcgcaaaaaacttgggcccccaaattngggggcatgaatggcttctctgggagaaataccttgaaggggggcaagagcagaaagaggaatatcagacgggacattcttcaagtcgagtgttgatagagtcttggactaggctagagcaacagaaatgaaaattagtcatttggtttgagatacatttttggaaggaggatgaacagaatatgcaggtggactggaatattgaagagaggggctgtggtaaatagcctccaaaatggccccaatggtccttgccttttggcattttgtgccttttttgtggtcccctccca

SEQ ID NO: 691308 - DNA, 192 bp, Homo sapiens
gacaagcagcaatgatgcagattcgtgcgccgcttgcccttgccctcacaatataccccatgcgtatcgatgagagcattcacctccagctgcggcataaatatggggaccagatttcgcgcttgccgacagtgtgacccaccaatctctatcaccgacactttgcagttactcctgctcctcgattccgtc

SEQ ID NO: 691309 - DNA, 738 bp, Homo sapiens
ggtagagggacggagtcttgctccgtcgcccaggctggagtgcagtggtgcgatctcagctcactgcaagctttcttataattagtatatgttttttccattattttattttacctatcagcatctttatgcttttatacttatactttatacttaatgtatgtatcttatttacagcatattattgggtattggatccaatctgatcatttctggcttttaacttgaatgtttaatccatttttctttaattattaatatgactgcctttaagtttaccatcttgctatttgttgtccacctgtctttatttttatctcctctagactaattggtattttcattgtattcttattttatcacttttttcgagcttttggctcttcctttttgtttggggcttgttttgttttgtttcctctagagtttataatatttttcctaaacttatcagttgatcttgaattaatcactttacatattttatgagaaacttactatggcgtatttccatttcttccctcccatcctttgtgttgtgctacaatacattttggttttgcatgaattacagtgtaccaacatgtattgtgaaagtttggctttcaaataactgtcttctattaagttaagaactgatctttttttaaatttatttgcttattctttatttctgacactatccattcttggtaacattttaatctgaagaactatttactgttcctggtacatctg

SEQ ID NO: 691310 - DNA, 289 bp, Homo sapiens
ggacctcgaggaatcaaggggcaaatatctataaaggagggaattgcaggccaggcatggtggctcatgcctgtaatcccaacactttgggaggcaaaagtgggaggattgtttgaggccaggagtttgagacagcctgggcaacatatcaagacccttgtctcaacaaaaaataaaaaattagctggacgtggtggcacatgcctgtggtcccagctactccagaggctgtggtgggagaattgcttgagcccaggaggttgcagagctgtgataatgccactgcatt

SEQ ID NO: 691311 - DNA, 106 bp, Homo sapiens
  misc_feature (42)..(42): n is a, c, g, or t
atacgaattgaggctcgtacccttctcaccagcaaaggacantagtccatcactagtatgccaaagacggttgcagcccccacaaaggctcccaagaactgggctt

SEQ ID NO: 691312 - DNA, 292 bp, Homo sapiens
  misc_feature (63)..(63): n is a, c, g, or t
gttttcaacttaaaacagaaaactatgtcgtgtgtggctgggcgcggtggctcacgcctgcgntcccagcactttgggaggctgaggcagcggatcacaaggtcaggagatcgagaccatcctggctaacacggtgaaactcaggtctctactaaaatagaaaaaataaaccaggcgtggtggcacggcctgtgaatcctagccacttgggaggctgaggcaggagaatcgcctaacccaggaggcggaggttcagttagccaagagttcaccactcactcagcctgggtga

SEQ ID NO: 691313 - DNA, 325 bp, Homo sapiens
gcaatattgtctggcagtgccccgattggcccttggtccccacatagattatcctatttggtttttcctccaatagtcttggttaataggcagcaggtcagatgtctccacagttattaactccatctgatcttactaaggttaatggtatggaacacctgggacaaatacaatctttctgccatcatccacctgcacaaatcctctatcttcaaattcctttaaccatatcattcatcctcatcttgatagaaggatatcccctctctctattaaagagacgtccaatgcatcatagattttctttaactcttgttgggagctt

SEQ ID NO: 691314 - DNA, 1650 bp, Homo sapiens
cggcacgagggttgccgctgcgcacctggctcaggtgagctgccccgcccccgcccggcgcgagccccaggtcctggcagcagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 691315 - DNA, 909 bp, Homo sapiens
  misc_feature (550)..(550): n is a, c, g, or t
  misc_feature (552)..(552): n is a, c, g, or t
cggcacgagggttgccgctgcgcacctggctcaggtgagctgccccgcccccgcccggcgcgagccccaggtcctggcagcaggtgagtggcggtcgccatcagacccgcgactgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctccagggcacgtctttccagaattcaaagagagcgatgccatgtttgctgccgagagagtgagtgtgggcggccgccaggggttctggagtcgggctgctcaggaagcgtgaaggggagtgctgggagcccggcttgtttgagggttggtggctgagctctcgtctgtctgggacctgaggatgcctgtgtgtcctggncngagcgtacagctgtctctgcagggcgaggtggagacgtggcttgagggcctttagagtggctagggggctcgggaaaggaaaacaagcacctttgatgaggaaggaagtcccttcctcaggcctcggcagcttcaccccaggccacgccgctgggaagggccgcccggggcattgctctcgctcgtgctggggtcctctctgggtccgttgccttctgtggggcaggggaggctctgtgcctctggggctggtggggcgggaagcgtgtggtcctgactgctgcccctcctcaggccccagactgggtggacgctgaggaatgccaccgctgcagggtgcagttcggggtgatgacc

SEQ ID NO: 691316 - DNA, 1585 bp, Homo sapiens
  misc_feature (1171)..(1171): n is a, c, g, or t
  misc_feature (1274)..(1274): n is a, c, g, or t
  misc_feature (1365)..(1365): n is a, c, g, or t
  misc_feature (1394)..(1394): n is a, c, g, or t
cgtgccccccagaatggggccctgccagatgatccccgtgtctcttttgtggggcgccaccccagttgggccacccttttcgtgggggtgtcccacatgctattttgtgtcgctgagaaacctgttgtttcccccacccgcgtgtggtgtgggagaaatataaagtggggcttttgggagcacttttttgcccaccggggggaatatctctccaggtgtgtcgcgcaacagggctcccccatatgtggggctgctcacgcggtggtcctccttgcccaattgggccccccgcgtgttggtcccccccgttgtattgtgtcgccccccgagggtaccacattctttgggacgccgcccaaaattgtgtgggtggttacacaatggggaatgccgcacaacgtggctccccaatgagaccccctcctcgttgttggagatcccccagggtgttctggaatattgccctccctcccctcggggttgtggcccacatttgggagaaaaaaatgggcgtctcacccaatttgtcgcacagtttatcccccccactagggagaacagttgttccttgtcgcccccctttttggggtcggggccccccccacacggcgcactacacgcccacagtgggtgacaccccagggtggctctccacggagagtatatttgtcacccccggcggccctcattttgggtgtgttttctcccggggtgacacatttttgcctggcagatgtgagagagagaatttccccgcacacaattgttgggggtgtcacacaatgtggggcgcagaaaggccccctcttgaggccccctcctttggggcgcgctctccaccacacgctgcccactctgaatttgggcgtcttttctctctcctgctggtctgtgcccacaccacactgctgagagggcccccccctcggggtggagatagtactctgtctgtgtgtgtccagcactatggggggagtatccccgcgcgcctaaaaaaaaatatatattgcgcccgccgtgtattatggggtgtgtctctctctcgcatatgcgccactatggaacacacacgcaacactcttctcacgctcacgcgcccggcgtacccgacataaattttctcacgtgtgagaagtcttcgtgacgacacacaagtctcacacaaagtggnggacaccacagcgagagagttgtgtgtctctgcgtgtggcttctgttgcacaggagacacacaagggcgtgtcacacttccacacacacaattgttgtgcccntcttacacctctgagtgttgcctctggcgactactccacacacacactccacatgccacaggcgagacacatttggtggccccacagaggnctttgagacccaccaagtgccgcagagcncactcgagagtgaactctctcggggagagctctaaagttttgagagaaagaagaaacgtcctccacagcccacaggtggagaaggtgggcgtccactagacccccctttgtatgagaacaccgcttttttgtaaaagggatcccgccccccctccctccgtttttttttccattaaagatttagaaagata

SEQ ID NO: 691317 - DNA, 670 bp, Homo sapiens
  misc_feature (311)..(311): n is a, c, g, or t
  misc_feature (313)..(313): n is a, c, g, or t
ccttcacttgggtgcacggtcactgctgcgttgcagctgcccagagtgaggaaggggctcccggaagtcttgcaggccaggtgggagcaggcagtgactatggcttcatctctccagggcacgtctttccagaattcaaagagagcgatgccatgtttgctgccgagagagtgagtgtgggcggccgccaggggttctggagtcgggctgctcaggaagcgtgaaggggagtgctgggagcccggcttgtttgagggttggtggctgagctctcgtctgtctgggacctgaggatgcctgtgtgtcctggncngagcgtacagctgtctctgcagggcgaggtggagacgtggcttgagggcctttagagtggctagggggctcgggaaaggaaaacaagcacctttgatgaggaaggaagtcccttcctcaggcctcggcagcttcaccccaggccacgccgctgggaagggccgcccggggcattgctctcgctcgtgctggggtcctctctgggtccgttgccttctgtggggcaggggaggctctgtgcctctggggctggtggggcgggaagcgtgtggtcctgactgctgcccctcctcaggccccagactgggtggacgctgaggaatgccaccgctgcagggtgcagttcggggtgatgacc

SEQ ID NO: 691318 - DNA, 1681 bp, Homo sapiens
cggcacgagggttgccgctgcgcacctggctcaggtgagctgccccgcccccgcccggcgcgagccccaggtcctggcagcaggtgagtggcggtcgccatcagacccgcgaagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 691319 - DNA, 601 bp, Homo sapiens
  misc_feature (599)..(599): n is a, c, g, or t
aaacagatattactaggagacgttataaatgggttaccgctgatatatcggactcagccagtaaatgtgcagataacttcagataatacatccaatgactgtggaataggtaggggcataagccagtgaaacagttagtaggttgcactaatgaaccaagcacaggtgtatttacctcaggtagggtctggaagtaccaaggcttgaggagcagctaattcttaatgttccccaaaacagccttccagttggaactggtggaagtagtcagcagcccctccttctaactcattttgttgtgtcaagagatgttttactataaaagagttaaaggagggagctgaaagaggggaaataaggtgagaatattcctgggacacaagaggcggatcagcgagccctgccaacagagacgtaatatgttaggcagtgcacagagggattaagaccatgggctgtggcaccaaacagacctgatttatatcctggctctgccacttaggtcctgggccaattttaaatggaattaaaacaatactgatttcatgcagtctttgtgaggagaaaaatgagaatgcatacttaaagtgggtagtcanca

SEQ ID NO: 691320 - DNA, 1746 bp, Homo sapiens
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 691321 - DNA, 1926 bp, Homo sapiens
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctgaaaaaaaaaaaaaactaaaaaaaaaaactccggggcctttttcgggggcggacaaacgggggtttggaaggggccatgggcaaagttttcctggacccgttttttttgccaaggggaaatcgggggcgcccctaatgggggcgatattcgaaaagccggttaacccgtttcgggaaaaggt

SEQ ID NO: 691322 - DNA, 2050 bp, Homo sapiens
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtggtgcggagcaggcgcgggagggtccggggctagcggcgggttagagatgggcggtgcccgggctccaggctgggacccctccgtggggagctctgcggcaccacgctttgtgaatgggccctggggggaggttccgctgcctggggccccgatgcggggagccgcccttgaggcccccggagccacggaatagctgtcgcagggcgtggaacccgtgggcagccgcaggtgtgctcttgggggccaggacgccaggggcttccgaggtgttcacacctgcaaaccgccccgacctggcccccagactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 691323 - DNA, 467 bp, Homo sapiens
acacatgaggatatatattgttaccaattcaatgtaacagtatcacaaatacacacctacatatgactggctttcaaaatataaaaaaaaaaaatcaccttagtactagacattatactaaagttagtggctagcttcacaaggtcataatgacaaaataatttaccaaataattaaaaataataataataataattccttttacaaaatggtacagtaatacctctaaggaaccggaaaatactaaaatgtactttggctaatacaactaaaaggccattctttcaaaagaatagggcataattcatttcagaatcaactaaaaaaaacagaaagcataacagaaatatgcatagaatttaagtatactttgtctagccttcttttcccattctacccacataagcaaggagaatgcaatttatataatcttcccagatgagactcaatagcactacaaagaagat

SEQ ID NO: 691324 - DNA, 1595 bp, Homo sapiens
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 691325 - DNA, 742 bp, Homo sapiens
ccacgcgtcgggctgctgcggtttcaggcggctgcttcggtgactaatgacctatgtgacagagttgttaagaaaaaagagaaacccgcgctctccgggggtgagaagggactgactctgggcgtctctgaagatggctcgggcttctcttgggcgcgccggggggaccctgacagtgaccgtctgtgacgcgagtagtctccccatgcaccgtgcccgaagcggacgtgccgggggatatttcattctcgatctgttgacgtggttcccccggtgcatgagcagagtcggagttgagactggcttgttgctggcccagcgccgtggtgcaggaaggcgatcacgctgtgtctgggtggccggagccggagcagagcctgggttggagtgagtgcctggaacgtgaactggacctcaactcgagtagcagcaaaagaccagcgggctggcaggcgggggaggctgcaggctcatttcccacacctcttcccaggccccacgtggcccgtctgcggagcggttctggccccttccgaacagagcggggacctagagccgggggacgctccgcccgctgcaggggatgactctggggtggggggagcgccgaaccggggcgcgcagggtcccgtgaactgtgagtactgggagtgaacggggcaggcgagcgggcgatagcacccattgcatgcatcctgacacataactgtcgaagagcagaggaaaaaagagatcacagtgc

SEQ ID NO: 691326 - DNA, 2035 bp, Homo sapiens
  misc_feature (1469)..(1469): n is a, c, g, or t
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtatgcccgcccagccccactccccaactggagaagctcagcacagggcggagtgggggcaggcacanggcacagggcctggaggggctccaggtgttgaggactcttcccggcaccgggagcccctgcacggcctctgccctggaggtgctcggccctcggtctgcctgggaacttcctgggcctcacaggccatcacagcagggggtgagcaggggcagcccctggcagtgggtctgggccaaggctgtgggtggccacctcaggcgtctcggtctccccaccccaggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 691327 - DNA, 535 bp, Homo sapiens
  misc_feature (310)..(310): n is a, c, g, or t
taaggacgtgggttggggaagaggggcattgtggagggggcgcttgtggagtgaggctgtggaaacgaaggcaggacaccaggtgggggagcttccggctggggagtgtgggtcttctgctcgggctgctcttgctgctgcagctctggcttgggttgtccttgctttgctggggttgggttgggctgtgcacggggagcttccgccagcttgggtttctcatcgcctgcctctgtttttgaatggagggtggccagttcctcagcctccgctgtacgctgcaagaaagcggaggaagctgtataatggnctgatggtgctggggcgctgtaagcctgtgagggcctcggggtactgcaggatgagctggtaggcgtcaggatttccatggcatccagtggaatcctcattgtggctgtcgtcctgcccctcctcatcctcatccttgtaacccagcttcttctggtgcttgatgagatccaagaatggcttgacacagcagggtacatttggtgcgctgtcagtccacgtgctt

SEQ ID NO: 691328 - DNA, 169 bp, Homo sapiens
actcgttgtgccccacggtgcactgacccaccctgccataggcttcctaagggagcccccaacccctcccctcccctcccctccctggtgcttgctattgaaccgcgctgtccagctccatttctgccctggcatccctgggcccagcaggtgggtcgtcgttgtctgg

SEQ ID NO: 691329 - DNA, 1586 bp, Homo sapiens
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 691330 - DNA, 137 bp, Homo sapiens
aatgccctgtttatagttctttctcatcacgacctgcacgtataccttttccaccaccaccagctgcggctttagttatgacaggataaccaattttctttgcaccttttttcgcatcgtcaatattatgaactaaa

SEQ ID NO: 691331 - DNA, 115 bp, Homo sapiens
taagggtccaagctggtccagagaagatcccggctgtcctagattctgagcagtggaagctcagctgcttgccggacctggaggggcacggaggggcccgcaacctgggccaagg

SEQ ID NO: 691332 - DNA, 289 bp, Homo sapiens
aagcgaggcgtgacggcgagagtgcccccctcccagcgcctggagatggggaggagcggcataggcttagggtagcagctgctgcgagtctccaccgcgaccaaagcagctgctgctcctgtgcccaggcccagcctatgctctgtggccatgcacctagcatgcacctagcgatacagtggcgactgcttcagggacatgagcaccgagcgcaggcggtacacatctttgcactgatagctgagcttgagggtgaagtcacatagatggaccaccttctccgactctg

SEQ ID NO: 691333 - DNA, 111 bp, Homo sapiens
aatattctgggctgctgctaaagcataatctggaggtaaatttataggataaattgacaatgttttttttctgttatttagcaagtctgaaaaagatttagaagtgataga

SEQ ID NO: 691334 - DNA, 417 bp, Homo sapiens
  misc_feature (411)..(411): n is a, c, g, or t
tgagacggggtctcatgctgatgcccaggctggagtgcaatggtgtgattatggctcactgcagcctcaacttcccaggctcaggtgattctattacctcagcctcccaagtagctgggactactggtgtgcactactaggactggctaattttttgtatcttttgtacagatagggtttcaccgtgttgctcaggctggttttgaacttctaggttcaagcaatcctcccaccacagcctccaaaagtcctgggattacaggtgtgagccaccataactgggctggaattatttgtacctggaccttgtgttttgtttttttgccctactatcttttctaaataaacatatccatgttcctggagatagcagtaatatacaattatggtaaaatagagcctttaatatgnactccg

SEQ ID NO: 691335 - DNA, 167 bp, Homo sapiens
  misc_feature (164)..(164): n is a, c, g, or t
atgtgggggcgaggcaggaggactgcttgagcccagaagttcaagaccagcctgcgcaacatggtaaaaccctgtctctacaaaaaaattaaaaagccaggtgtggtgttgtgtgcctgcagtccccgcgtacttgggagacgtgaggtgggagactcacccanaag

SEQ ID NO: 691336 - DNA, 383 bp, Homo sapiens
cggtatgacgagcttcggtatgacgagcttctgggtgtaatcaattggacgaattcctgggaactgcggatatagcttgccacagtatcttattcaggtaattggcttcctgggatgtgctgggagtcagcttgcacaagttaagtccttgaggaagcggctgccagtgaaagagccaagatggagtccatctggcgctcttagctaagggagagtcaattcaggtggaaacaaggctgagtgattaaaggaaagggagagtctaaaaacagggttagtaaaaaccaggttggacactacattccccacttgtgttttgggggaatcaaatcattgattcctcagttataacaagggggttatattgagtcaagctcgtcata

SEQ ID NO: 691337 - DNA, 814 bp, Homo sapiens
  misc_feature (2)..(2): n is a, c, g, or t
  misc_feature (352)..(352): n is a, c, g, or t
  misc_feature (356)..(356): n is a, c, g, or t
  misc_feature (399)..(399): n is a, c, g, or t
  misc_feature (412)..(412): n is a, c, g, or t
  misc_feature (414)..(414): n is a, c, g, or t
  misc_feature (439)..(439): n is a, c, g, or t
  misc_feature (449)..(450): n is a, c, g, or t
  misc_feature (467)..(467): n is a, c, g, or t
  misc_feature (490)..(490): n is a, c, g, or t
  misc_feature (505)..(505): n is a, c, g, or t
  misc_feature (538)..(538): n is a, c, g, or t
  misc_feature (547)..(547): n is a, c, g, or t
  misc_feature (587)..(587): n is a, c, g, or t
  misc_feature (637)..(637): n is a, c, g, or t
  misc_feature (639)..(639): n is a, c, g, or t
  misc_feature (671)..(671): n is a, c, g, or t
  misc_feature (697)..(697): n is a, c, g, or t
  misc_feature (812)..(812): n is a, c, g, or t
tntaagattggtttataaggcttaaatatttctgtcatagttaacagttaacagcaaataaaggcaactttacaaaatcagtgtttccatacagtacaggactaaatgtggcaactctgcattggaaaattaatatttcctcaatgcaaatatcaaatctgcagcaccatttagcagcttccactaaaaactcaagctgcagtatttattacaagctctactcagaacacaaggctacctaaatcaagcattagagaaaaacagtggagtcattcaggcataatatgtcagatttggtacaggattaaaatactaacatttttaatgtcctggtttcaaattaataaattcnacancaatataaaaatatacaaccagttgaaaagactgtactgcagntgctcagaaagtnanatctcgctctcatatgtatgcaggnatgtattganngtcaggatttctgggtngctgcggctggtctttcggtagncgtccaggctggtgngatgttcaatgtcacgcaccctagctgtgtgcntcttcatgngttcttctacccattttgattcgtcctctgagctattgcngctctcctcgttgtcaggccggtgaggcaggatgaaggaggacacagagngngggccgtcacacttgtcggcaggctgagtganatccagacagctggtgatgatgctgnagtagtgagttggaacaggaatggaactgccttccacgtactgttttattttgtcttctgtgtcatgtaagccatcatagtcatagtcgaagattggtccacttatcacgttaantc

SEQ ID NO: 691338 - DNA, 1680 bp, Homo sapiens
tctgagccacgcgcccatcgggtacctgatgtgcacgctgcctgggctgtcactgtgctgtttctgctgtgctgagctggaacatgactgcgatgtatgtgtgatgcctgcactgtatggcctgggctatgtgctggctgatgcactgtgctaactggtgctgacttgtgtgtgtgagctgtgctgctgtgttgcttggtgttgcttgctgtgctgtgcctgattgcttggcctgcctgcctgtgtggtgtgctggtgttcaccacttgcatgcatgtgatgctgttgtgtttgcgtcctgagtgccatgctgtgaccttgcgcactgccttctacctccgttgtgtgccacttgttgtgtgtgcctgatgtgccctgtgcaatttgtggtgtgccagattgtgctgtggtgtgttttttgtggacagctgatggcgatgcctgctgtgcctgtggagtgcgtgcaatatctctgtgtgtgtgtgctgatgtgacctgccttcctgatgttgtggctgtggctgcctgtggatgtgcaatgtggatgctctgtgctgtgctgctgggtgtgtgtgcatggctttgcctgtgggcctgctctggggtgtggcacaatggtggccccctgtggttacaagttaaaatctggtggactggccataccagctgggctcccaagttagaacctagaataccacacccagagagtttggattggtatattaccctgggcaagccgttgggcgctgggcttaccaattcctggccaccaataccaaaccacctggacgaaaagcccccctgggggtatggtttcaccccaccagtgctgcccttttctcatttccagaaatggacattttaagtttctggatgggggtattaaacgaagaaagatttagcactggacaactaggtacatgtgggtttatggaaaggccattagggctttaggacggacagtgtggacacgcacggtttcgtaggttctcttactggaccccacaaggccccagttatacacagttggtatccctgtgggccaagttgaccgttattcccttaatacaacacgtaacaggaactgtggaattttgagaccacagtgggcgaacactgtaggaaggggttccacgggagaagttatgctatggaggtcccatggacgggaaagagcccccttttgtggaacgtttagaacaaaatatacattaccaccgaacaagccttgtggtggaacgcggttatgttggccgccaatggaatttcccaattggagtgaacttggctcatgtggaagccctttttttgggcggacatcaaacagggctttcgctgaggcacattggattcccgggaccagtttgcggggaaacacccagtgcaacggaaagggctcccaaataaattccaggcccaatgcaaccaagaggattggtgcaggtggtgtgggaagcgcccccggggaagtagtagagcccccgagtgaagggagcaggtggaaagaagaaacctacaagtgcaacagcaagagatccccccccggccgaacaggtgcaaacgagtctcagcaaacaggccccggcggtgggcgccaaacagaaaccggtagcgacgtagcagagcacgaggggcacgacgacagcatagaaagtcgcactcacaagtgcagacccccgg

SEQ ID NO: 691339 - DNA, 522 bp, Homo sapiens
cggcgagtccgggtcacataaagcaaagatagtgcaacatatacagtacgggaagtctagacgttacagagcttttatagtggaagaagcgatttactatccgagacagatcaagacaatttttatagctgaagggctggttcagctgggttgggagggatgaataggaatggatctattccataagtaaagtcagatactgatagcatatcataattggttctcattcaccactgtattgccatatagtctaagcaatagataattgaatgaattccctgattcgaatgctaagatatggtgacggtgatgggggtcgaagtccttagccatgagagagtatagctatgggatggcttctcttcaggagcaggatgccatgctaggatagccattcctgtcttgcataccaaataagaatgggtctcgtctccaggagagagaagcattacatgcaagacattctgaaggttgagtctgactttagtcaccatttttgaaaaggtggtgtggctttacaaa

SEQ ID NO: 691340 - DNA, 207 bp, Homo sapiens
  misc_feature (145)..(146): n is a, c, g, or t
ccctcttggttgatggctgtctgagccctgacatgtgcttgggcactggtgggcctgggcttctgaggtggcctgcgtgcctgatcaggaccctccccgctttgctgggcctctcagttgaacaaagcagcaaaacaaaggcagnnttttatattgaaacgacttagaacgcctggaataatcaggctttttaaatgatgtaattcc

SEQ ID NO: 691341 - DNA, 565 bp, Homo sapiens
gcacagatagaaaaacctctggcccatttggataaaaacttgtagaaacctccagctcactcagataaaggaacaagaacgacctagcatagaaatgcctttgtttggccaggcacggtggatcatgcctgtaattccaacaatgtcggaggcagctgtgggcggatcatctgaggtcgggagtttgagaccagcatgaccaagatggacaaactctgtctttactaaaaatacaaaactagccaggcatggtgctgcatgcctataatcccagctacttgggaggctgaggcaggagaatcgctagaacccaggaggcggaggtttctgtgagccgagatcgcaccattgcactccaggctgggcaacaagagcaaaactgcaaaaaaaaataaaaataaataaaaaaagaaagtacatctcaaaaaaaagaaagacaagaaaaagaaaaaaaagaagcacttttgtctttgtacagtcagtgggctcccaggaaaatgttccttctctttttgttggcatgggcactaggggatctggtgcattccagtcgacactctcgttt

SEQ ID NO: 691342 - DNA, 681 bp, Homo sapiens
gggagtaaggatccacctgctctgcgcaggcccggagaccccggggcggcttcccacgaacctgcggagggcaactggccgaccgacccattcattgggaaccccgtcttttgccagagcccacgtcccctgccacctctagctcggagcggcgtgtagcgccatggagaagagcaacgatgaccacacggcatacgcttgacatgctgctcatggcgtgggcctgctggcctggggctccggagctcctggtgtgacctgctgtgctgggacgctgcacggcgttgcgcgggcttcctgcggcggccaagcgctggtgctgctcaccgtttgtccggggtgctggctgggcgcgggcctgggcgcggcgttgcgcgggctcagcctgagccgcacgcaggtcacctacctggccttcccccggcgagatgctgctcccgatgctgcgcatgatcaatcctgccgctggtggtcctgcagccttggtgtcagggcgcccgccctcgctcgatgcccagcctgcctcgggcgtctgggcggcatcgactgtctgacctactatggcctcaaccacaactgagtgccatcggctgctcgccgtggaccttggcgttcatcattcaagccaggatccggtgcgcagaccctttaagtcccagcgacctgggtgctggaggacag

SEQ ID NO: 691343 - DNA, 163 bp, Homo sapiens
acgtgtgcattggtggtacatactggcctcgctgtccaccttccagcagatgtgatcagcaagcaggagtatgacgagtacggcccctccatcgtccaccgcaaatacttctaggcggactataacttagtatgcgtaacaccctttcttgacaaaacctaac

SEQ ID NO: 691344 - DNA, 190 bp, Homo sapiens
gacgtgaacaactcaaacgtcttatccttcacggagaaggctgatgtggctgaaaaagcctgtgtgcagtgaccctagcaacccacacctagccagcttgggaggaccccacctatgtcctagctccgaaacggcacaaaaaatgcttctagtagctgcattctgcaaagggaaactgggctcggggaac

SEQ ID NO: 691345 - DNA, 163 bp, Homo sapiens
tggtttagcggtctgatcccatgttgctgtggctgtggtgatgcagctccgattcaacccctagcctagaaacctccatatgcctggggtgcggcctaaaaagacaaaaagaccaaaaataaataaataaaatcaatagtggtttaatggatgatacactcac

SEQ ID NO: 691346 - DNA, 428 bp, Homo sapiens
  misc_feature (158)..(158): n is a, c, g, or t
  misc_feature (306)..(306): n is a, c, g, or t
taaacaaaacacccaagggtttttttggatggacctcaaggggaaacgggatggggaaaaatactgtttctgggaaaatcaccccctttcctcctataaggggcagtgctctcgaatctcgagcactcctaattctttaattattctcctagtagagntaatatggctcctcacgtggtttttaacagaaaaaaaaaaaccaccaacattaaaaactccttgtgacaatccctgtgtgtccaagtgcgaaaatataaaggtgtctccattcctctctttgggttacaacccccaggggacaatttntaactataactttctggtggcacgcgagtacccgtgttaccacctttgttgggagcacaactcgtgctcttaaagatggggggaataaatctctcctcttaaacaaacaacaaacaagaggg

SEQ ID NO: 691347 - DNA, 337 bp, Homo sapiens; identical to SEQ ID NO: 502349
  misc_feature (36)..(36): n is a, c, g, or t
  misc_feature (320)..(320): n is a, c, g, or t
  misc_feature (327)..(327): n is a, c, g, or t

SEQ ID NO: 691348 - DNA, 556 bp, Homo sapiens
cggaacgcgtgggtcgagaacacaggtgtcgtgaaaactacccctaaatagccaaagatggggcaaagacgcgacaatagactcatatcaacattgtccgcttccatttttgggggaccaacgtagattcgggcaagttccatcctactacctgggccagtctgactctactaaattgcgcgtggccatcagatcagagaaggaaccagttgacccgacaagtgttgcacgaacaggaaggctatgctgacgaacttgggacacatgggggtctcccttttcaaaatggctattttggcccctgggtggctccatattgcggactttaataagcttgaataggcgtgagccgttgaaccgtgggtaaatcaccaattggatgatctcgctatggtggacaaacttgtgacgacgcagcgaaaggtacataattgattgaccttacttcacttggaatggccccccaaggaaccaccatggaagcacgttttaattccaaagaaaacacaattggaattttaacccccgtgggcaatccaatttcgttccaaggggc

SEQ ID NO: 691349 - DNA, 320 bp, Homo sapiens
ttttctgtttttatttttagataaacagagcaaagtttattgaaatttcaagctacatttggaaaatcaagatccaaatcctggaaccgtacatcaggataaggtttcaaaaagtggaaagtgttcactcttacaaaacccgctacagacaagctttccgggcaaagcttccaggctccattggattcaaggcaaccccctttttatgcgttatccacagttggacaccaatcttccggtcactttgaaggtttccaccattaattcaaaaccgaaccaaaaaagttttccaatgacactgtggaagccggggggggggg

SEQ ID NO: 691350 - DNA, 634 bp, Homo sapiens
  misc_feature (455)..(455): n is a, c, g, or t
tacctgacctgacaaaactctttacactctgtgtcagaaagagaaaaaatggcagttggagttttaacccagaatgtagggccctgaccaaggccagtggcctatctctcaaaacaactagacggggtttccaaaggctggcccccatgtccaagggtcctggcagcaagggccctgttagcacaagaagcaaataagctaactcttagacaaaacctaaacataaagtccccccatgctatggtgattttaataaataacaaaggaaaccattagctaatgaatgctagactaactagataccaaagcttgctctgtgaaaatccccgcataaccactgaagtttgcaacaccctaaaccctgccaccttgctccccgtatcagagagcccagttaaacataactgtgtagaagtactggactcagtttattctagtaggcccaaccactgagnaccacgctaaacatcagtagactaggagctgacgtggataggagatgctcggcaacccctgcaagtgactctgagaagagacaagccctgctccatcacaacccgaagctgactggttcaaactggccgaacatgagaaactaatggcggactcatttccccaaaaattgggatggaca

SEQ ID NO: 691351 - DNA, 941 bp, Homo sapiens
tgctgttactggcctggaattttgggatgcccagccaggctttctgtcgcgcggggtctcccgagatggcggctatggggcgctgggagggtgcaagctcctgcgccgtgctccctgtgtgatgcccggttgtcgtgagatggggctgccctgggaggggcgggtctactggcacgtggagggtgccggcccgttgttcgcggttccccgtgtcccagtgcaggatgtggtgctgcagacgccgtgatctccgtaggggttggggctgggggctgcggagctgtctacatcggactcctccgtggtcagcccgttaggagccgcctcccctctgcccctccgaagagacgagcgtgccatgacaggcctggggaaggcccctctgccccgtcaggggttgaaaagcaaagctggaaggattcggagagggttggggccgtcttcctcatccttccttttctcggggctcccgtggcgacgtcatggcaaattcccaaactggacggatccggctcgggttaccggtccagcagggccgagcctgttgccccaggcctggcccctggggtcctcggtgccggctggagggggctgtgcacctctgggggcggggttcttgctccacgtgccctcggcgcgggacttgtgccctcgtgtgggcacgcggacccggcggggtaagggctaggggcccggattactcttgggccaaggattcaaggtccctgccatgggtaaggcccccacgcattccagtcttcggaaacccgggctcttgaagagggcgcaagtaggggccccagtggagctgcgagaaacccgcttctacaagcctattggttccccggccttggggaagagcccaccttggacattggagagcccgccctcaatgccgaagctttcggaaacaatcttcgggacggaagttaattaaccga

SEQ ID NO: 691352 - DNA, 224 bp, Homo sapiens
tgctgaccactgatggcagccacacacactctaaccccaacacacgtggaacaaggcttcccccaccaatcacagctcccagtggaaaaatctcaaccaccaactgagggacgttctacccccgactcattcccaggtaggcctattccacagaatgcattcagcattaaaaactgggcaactccatctgtatgacagctgatacctaatcaccacgcactctc

SEQ ID NO: 691353 - DNA, 793 bp, Homo sapiens
  misc_feature (329)..(329): n is a, c, g, or t
cttttagaagagtgtcttctatttcagacattgttgacctgaaaatctcttaaaatctgtctgccatcctgtggtagtgatggcctcacacaggggtggcagtgctctagcagaaatcccctgagagactcagtcgagacctgtgtttgtatatcatttattggggaagaaagggagagctacacctcactagacatttccacggccatactcattatcctgaaatcccagcagctttatgtacaatttaccaagtaattttaattactgctatttcttctatgtacttgatgggtggttttttttttctcatgagaatgtcatgtgcntgatgccaccttggtgcattcctcttctctttcagcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 691354 - DNA, 766 bp, Homo sapiens
  misc_feature (761)..(761): n is a, c, g, or t
  misc_feature (766)..(766): n is a, c, g, or t
aacaagagcgttttaattagatcagatttacattctgactggctcttaaactagcaaggtgacctagggaaaggggccagggtttccctctatcattcataaatgtaattcagggcccctttttatccccaataccagcatacagaaactgctgtaaaagaagaagttgtgggtatttttttttttttttggtctggaggaatggggacaccaaaactcatttggcagcagaggtgaggtaaggccatttgtattgtctgttctgttagtagtcatacatgccacttatccctgccccagtccctgttaggagtgttatgtgggtatactgaacgtggaccttccccgaatccaaagaatccagatgctttgaataagatcatggaccttccgggttctacatcgccagatgttgttcatcttctatcttttgttttgcgaaaattggttttttatgtgtattggggttattctgtggaagaaataagctgtgggtcaagattaaagaactttaaacaacttctggcatgtggaataaacacgatctgaaggaacaaaattttcatttgactacatttttgatccaatttgcacccagtgtttaagttaatcacagtgcttggcagtttgtgttgctggatcaaggctttctcactgaaaaccatgtgcttcagaggttcataattcctctttcaccttccatttcacattagttaataaattatgagagaaaacattgtggatccaagttatgtttgacnttttn

SEQ ID NO: 691355 - DNA, 6216 bp, Homo sapiens
ggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaacccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccatgttggccaggctggtcttgaactcctgacctcaagtggtctgcctacctcggcctcccaaagtgctggaattacaggcgtgagcatcacgtctggcctaatttttttaatcgaatttatttttgtaatgatagatgcttgtcttattcctagggaaatatttgaagtaattgagatgctgtcacctaaaataatcaaaaggctcctgattcagttaaaagaattcatttaagtacagagtgtaagcgagctacaccaaagaatggtgattagcgctcccagggtggggaaaaatgaggattgtttatataggcaaaatggaggtgccaaacagaattataacattttcggaactaaggctcatttaaagatacaaatttgattggctactattgattacacttgaagggatttgtttaacttccttttgtaaagaagtaacagtcataaggatctctcatctcccagtcatttagtctagttttgaataaagaatagggggtctggttaatatatacatctaaacacaaaagtcagaaagaataaaagtagtgatgttacacgagccagctgtcagtgcttaacttttccctttggcctaatgcatttggaaggtcctgaaattgtattttctttttacattgcctatgtatgtgtaagtcttcttcaggtcagttcacgctgttaaatatacgtgcgtatacatacatactatgtatgtgcgtttatgtgtgtctgtgtgttttttttttaacagacgaagcttcacaaaagatgtctaaggtaagatcatacttcatgtatctacagcataaggagaaattgctttatgttttcagactgttgacagtcgggacttatatgattcattatttttaatacaactgatacatttgattcattaacacaaagagttctaatttagttgtctttttttttttttttgagacgggagtcttgttctgtcaccaggctggagtgcagtggcatgatctcagctcactgcaacttctgcctcccacgttcaagcgattcccctggctcagcctccggagtagctgggactgcagacacgtgccaccacgctggctaattttttggattttagtaaattcggggtttcaccgtgttggccaggatggccttgatctgttgacctcgtgatccacccgctttggccccccgaagtgttgggattacaggtgtgagccaccgtgcctggcctaattgtcatcttaaaagcttggagctttctcttttttcaggcttctactttcttttctctacacacatcagtaacagtccttttggcccccttagttcattcccagcagaccagataatttagaattctgataatttattatgatgaaattgatggggctcttagacttgataaattggtttaaatcagcctttgcaagttagttcagagataaattagtgctaaagaacatattctgagaaaagcagaacttgtggttaacattgcaagattattatttctgttttttttttatctttgaatcctgtgggtgttcattactgtccaatgcaaaatcatcataccagtttttgcattttataccagtgttagcatggaacacagataagcaaaaaaaaaaagtcattatttcaccactcaggaataaccactgttaatatgttacatatattctttttcacctgtgtgtgcatttgactatacatttacaaaatgtaatcctaaaggaaatactattttgtatcttgcctttttcaattaataaattgatttttaaaatttcttctcattttcagtatgccactgtctagattctggttacttctgctattcttgccttctcatatctctgtcctctctctcatcagatacccttctgtcaaggaatattgatgcttcagtgtagtcatctatgatcttctcattctgtcttttctttcttggtctttgacactagatactcaacatcccacccctaatttgcctgcctcacccttgatgaaactctgttctatagagctagaagcacagcaagagagatgcttttttcctcgatacttttcagaaatgcattgcacctaatacctgggagaagctattctttagccaagtttgttgaatgaaaccattcattcaaagtactgtcagctgtagcagtactttgtaagcttgactgattttcctggaactccatagtctctcaagtcgaaatttgaaattgcattaagatgtattaagcatgtatcttctatgtattgttaaattcctaaacagaatactgattaacaaaatgttaattttcagtcgcatacaactaaggagttatactagataagtttttctttttttaatgctcctagttgaatactactggttttctgatagaagtatgactttctggaagtgtttatactttttaaaaaatttgtgaaaactgataacctatgtttgtttcatgtctaactgattatatcttaaaagcaactactaaggtgtttattagtttgtttgttttttaatcttatttagcaacagccaactcagtttataaatccagaaacacctggctatgttggatttgcaaacctccccaatcaagttcaccgaaaatcagtgaaaaaaggttttgagttcacactgatggtggtcggtaagaaattaatctatagtctccaacttactaaataaatatctcccctttccaatctctggagtatgataacgtgacctataaagaaagaggaaaatttggcagagtcaaataacttgagaatttgaacaaatatatgtgtattcattagaaaatttttctcaggagcaaaattatttttctgtcactttcttatttatatgtagtgaaagtttactcattgtgtcagctaggctccaaaatggcccccagtgattcttatctcctggtattcacaactttcttgtcccttcctgcattgaatagggttttacctgtgtagccagtaggacattgtggagatgaaagtgttgtcattttctaagactaggtcataaaaggcattatggccccccaccttgactcttctcaaattactcactctggaggaagccagctgtcatgtcaagagaacactcaagcagccttacagggaagcccaccaagtaaggaaccaaggcctgccaatggctgtgtaagtgacccgtttcagaaatatcctccaggccaggcatggcggctcacacctgtaatcttagcactttgggaggccgaggcaggcaggagttgaagatcaggctgggcaacatggtgaaaccctgtctctacagaaaatatgaaaactagccaggcatggtggcatgtacctgtagttcctctcacctgagtccaggaggttgaggctgcagtaagctgagatcatgccactgcactcaagcctcaagcctgggtgaatgaaaccttgtctcaaaaaaaaaaaaaaaaaaaaaaaaatccaggcatttacagtgtaacattcacaatgtctaatgtctaatagaaaattgtgtggcatcaaagaaacaaaaactgtacataatcaggagaaaaagcaggcaatagaaacagatccagaaatgatagaaatggatctcgatggcaaagaagaactctattacttaaaggaaagcatgaatataataagataaaggaaagatacaacagaaaaccaagtggaacttctaaagattaagatacaaccgaaataagaaattttcatgataagcctgacagcacattatacactgcaggagaaaaagcacagtagaagcacagtaagggaaaagctggaaaaaaaaaagaaattgaatgtgccctcagtgtcctttggtacattgtgaacagtctaatatatggattatattcacagagaagacaggaaagcaaaaaaaaaaacttgaaaaaataatgcctgggaatggtccaattttccagcaaagtttataattgccaggtaacggggtaccgagcctg

SEQ ID NO: 691356 - DNA, 112 bp, Homo sapiens
  misc_feature (3)..(3): n is a, c, g, or t
tgnaggtgagagggagctgcatggatcggctgtggggctcgaaaggatgtggcatcgtcctcattagagctcagcagtcgcatcaactcgaaggctgcacatcgtccaggag

SEQ ID NO: 691357 - DNA, 2389 bp, Homo sapiens
tctgaaaatgtggtgagtttagtgactagcagaactgataattgaaaacctgctttgcattctatttgtcaaaaataaaaaccaacctctaaagtacattcctcacatttgtgaacagttatgtttctaattatatgatgttcaagttctgtagtctcatagacctggattcaaatcttggccctgctctggatagtactctgaccttgggcaaattagagtttctttgagtaccctcaaagatcatactgcaaacatagtagtactgtaggtactaaacacagaatgatgtttgtgaggtacttagcccagtaccaggccttatgtaaacacttaaccgattgaatggtgtcatatgaataaggtcatgacaaggtttttctttttatttaaaggtgaatcaggtctaggaaaatcgactctcataaacagcctattcctaactgatctgtacccagaaagagtcatacctggagcagcaggtaaaaacattcttatgttactgtaagtgtaattctacatgaaagatgctgaagactgcctaattaatattttatgtcttagctgtgtgttttgtttgttcttgttcagctttgaacacaaggaaaacacttttatggggtaggtgtgctgcaccgaggtccttggatttgggttgtagactttctttgacacgtatccatggatccatcctctcttgagtttgtctgtaaaatgtaataagtagtttctgcctatattaaatatttgatggaaggattaagtgagaatgttttacatcaaaaatgctgtgtaactagaagattactaggatagatgttcgaattcatctactgtcagaaagttccagcacaggacaccagcatccacaaatgactgttgaatgaaataggcacacatagtgagagcctaagacttgggctgctgcaagaatatgtagccctttcagaatatttttgaattcagtttttaaatgaattcgtaaattgctttctttttcccaggaacagaaattataatttttaacatttgtgtttttaaccttccccagtagcacaataatcttagctttaaccttcccctttctgacttctctgggatctttttttcttaatccccatggtatctttggagaacctacctctgtagagaggcagtagactctgaagtcacctgtcgtaagaacgtgagctttcctcttcacatgctgcttatattccctattaagtttgtttcttttctagaaaaaattgaaagaactgtccagattgaggcttcaactgttgaaattgaagagcgaggggtcaagctacgcctgacagtggtagatacccctggctatggtgacgctatcaactgcagagattggtatgctcccccatgcccagggatctgcatttgtttacttaatatacttcataaatttatagatagtgttaatgagtgattattaagtttgggattgctgtatataataaaacacctagacaatttaaagcgtgttaaatgttgactttttaaataaggaattttatagagagtaatttttttctggtactctactgtaatttgagatcgcaaagccagtcatccatagactgctagtataaatgaaacacctggatttgagccgtggttggtgaccgagatactgtagtacatcctttctatgtggaaggaagtgaaacctgttagagagtgggttgagtcgtagtgtctgtaaatgactgctcattggcatcattttcacaaataaggaaatgaagaagtagaagatagagcagtctgtcacctgtactgtgcaaagaatgccacttttgttgtacaaactccctcctggttctattcctgtcaacataaagcatcaggtttccaccactagatgaaaaggggaaggttctgttatctttctcctacatttaggaatttctcccttcttacatgtgaaagtgctgtactgtttcccagctcagttaaatgctgtttcccagctcagataaacctgttcttgacccatgttctctaccaccctgttcctctgccccttttcacagtcacgttcctgaaaagaattggcagccctggctgggtgctgggattacaggcgtgggccaccgcgcccggctgtgcgtctgcacattgcaaattcacttatttgttcttgattttcccagaattgttttattctgtaagggacagggtctcactctgtcacctaggctgaagtgcagtggcatgatcatagcctgctgtaatctctaactcctgggctcaagcaatccttctgccccagccactcaggaggctgaagcaaaagaatcgcttcaacccaggaggcagaggttgtttgcagtccagcctgggtgacagagcaagactccgtctcaag

SEQ ID NO: 691358 - DNA, 306 bp, Homo sapiens
gagagcactgatcatatggatagatagggctataatgccctcatcttgctgcatctcttctaggcctctttagtggtgaagtgcatactcccttctgagaattgctggctctaatcgtgttgctctaaattcgacgtccggtttctatggattgtttgtaaccagcttttgctgcaactgttactctgattaatatcttgctaatcataggttatggaaagactgtgtttctgtttaaaggctctgttagaaattactgatgcacacactgtattgtaaattcttatctctgtatactatacttct

SEQ ID NO: 691359 - DNA, 313 bp, Homo sapiens
gccaaacctcccctttcccttgcccaaggtgaatttggttgggcctccctggcattttcctccccgggagggggaagaagaggaagaggaagagggggggagggggaaggaaggggttgggaaaccagaggggggggaagagggggaccttctccctttggatggatccccaggagaagccaagcctcaggtccgtggcttttttttcccccgcagcagcccggcccccggggcccccaaaagccggcttgaaggctccgggggccaggcctcttcaggttttggggtggggggccccctggggccccgcgga

SEQ ID NO: 691360 - DNA, 702 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgggatgcttccccaggccacgggactgggattggtacctaaaaacactcataaatatagggaggggtgatgggggatatttaagttgggaatgggtgtattaataaaacccttacacattaaagggggttaaaggtggctttttagggatttttaggagggaaattttttgtggccctcccgggaaattgggaagccgccgggtttctctcgggttggtttt

SEQ ID NO: 691361 - DNA, 746 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (33)..(33): n is a, c, g, or t
ccaattngncnttggccggggggtcggcgcctnttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattggtcacgttcctgaaaagaattggcagccctggctgggtgcgatggctcatgcctgtaatcccagcactttgggaggctgaggtgggctgatcacaaggtcaggagttcgagaccagcctggccaacatggtgaaaccctgtctctactaaaaatacaaaaattagccgggcgtggtggcgtgtgcctataatcccagctacttgggaggctgaggcaggagaatcgcttgaaccctggaagcagaggttgcagtgagccgagatcacgccactgcactccagcctgggcaacagtgcaagactcagtctcaaaaaaaagacgaattgcagccctgt

SEQ ID NO: 691362 - DNA, 349 bp, Homo sapiens
gccgacacgcccaggccgacgagatcgcagtccggctgtgtggaatagccctggaagttgcggtgcagcaggccctggcgcttggcgacggccagcgggtcgtcgggcagcgcgaaatggtccatgccgatgtaggcatagccctcgccgagcagcgcgctgatcgcaccggacagcatggccagcttgtcgccggccggcggcagcagctcggccacgatgcggcgctgcggcttgaagcgctgcggcaaatgggcgtaggcatacatcgcgatgcggtcgggccgcagctcggccacctggccgatggtgcgggcgaagctggcgggcgtctgcagcggcaggccgt

SEQ ID NO: 691363 - DNA, 391 bp, Homo sapiens
aattatcaagtaaagtttgctcattcttgaaattgccattgttgctacacaacagtgacattttatcaatgttctatttttttttttcctaaaattattttcttcctggccaggcacggtggctcacgcttgtaatcccagcaatttgggaggccgaggcaggtgcagcacacgaggtcaggattttgagactagcctggccaacatggtgaaaccccacctgtactaaaaatacaaaaattagccaggcgtggtggcaggtgcctgtagtcccagctactcggaaggctgaggcagtagaattgcttgaacccaggaggcggaggttgcagtgagccaagatcatgccattgtactccagcctgggcaacaagagtgagactccatctca

SEQ ID NO: 691364 - DNA, 2933 bp, Homo sapiens
ggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaacccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccatgttggccaggctggtcttgaactcctgacctcaagtggtctgcctacctcggcctcccaaagtgctggaattacaggcgtgagccaccacactctgccagcagttttcttactgttttcattatgattggttgctgaatttcatatgcctcatcagcatctattaatgcatgattttttttcccctatactgtgttgttggattaatattggtagatgcttttgatacattcctggaatctaattgctagcaaatattgtattcaggatttttgcatttatatttgtgagtgagattggcctatggcgttcattcattcctttgttcctttcttatgtctccatctgggtttgttattaaaactgtgctgtcttcataaaacaaattgttttcccttttctctatagaggcttggaatagttaaatgactttggtcttgtccaaggttagatggagttcaactctaacgtcaagtcttggtccttttcattggtatgtctttaatcagctgcttagtgatacttgttttagtcagattttccagtttttggttctgtattggtaatttacagtgccccttttttctgcattttcagatttggggccattttgctacatgtagtcttctctgtcattattttagctacttttctatatttgctattttttcctgacttgggctcgtgaggcatctgtctctgt

SEQ ID NO: 691365 - DNA, 1027 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggagtgagtgtctcgccggtgtaccccgcacaagttgtgggccggccctcccgaggagctgcgggggacgcgccgctcgtcccatactctcgggcggtggtcggctggctctggggtgccggcggggcggtgtgggggaggggcggccgagcccaggctcttcggcacttatcgtgggctcccccgtcccgggcggtcctagtgccggcgacagtggctccgacacgggcaggcccgggcgcgggagtggggattccggtgaccccttgttgacctgcgggaattcctctgcactgtcgtcggtgctgggcctcggggcgtcgagtgcggtcgaggtcgggaggtttggtgcttggagggaggatacaggtttaggcccgacaaacacttagagcttgtgtggccatcttgtctttctaacggtgccatttcctccctgaggcgtggaggactggccagcccccaaacctccaagcccatcggctggatgccgtggataagcgaggggagagcgactaggccctgtctgcgggtaccttcggcgaggagaggcgacgaaggtctgcaccagcgaggcacggacaggcagcagggggtagggtatagggttggaggccgccgagttggcccggggatgaggagcaaacctgtggcttccgtggtctcagtggagtcccaactgtgacctggcctactggcccagacaaacctggcttgcttttttaccttttcggtctaattcttgtcagtgccaccagaccttgtcctctctccgcggaaacacacgaaccaactacactgaacttcttgtagttcaaacttctgcacctttggccattgcccaaactcttaaatctggctacttcccaccttaaatggcttctcttaactagtctgtgcttgtgg

SEQ ID NO: 691366 - DNA, 765 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggaggactggccagcccccaaacctccaagcccatcggctggatgccgtggataagcgaggggagagcgactaggccctgtctgcgggtaccttcggcgaggagaggcgacgaagcatacagaaactgctgtaaaagaagaagttgtgggtatttttttttttttttggtctggaggaatggggacaccaaaactcatttggcagcagaggtgagggtccaggtgaggcgtgaggggtccgtggggcagggtgcgggaaaagggtgcctctaggggatattccatgtgttggccacgtggggtgggttgtgaaattcaggatactgtttaatggggtgattaaggacgaagtttcacaaaaggagtgtcctaggcaacgagccaacttcgagtttataatctccgaaaaacccgcgggctagtgtgggcattggcaaaccttcccaaattcaggtttcaccgaaatctcaggtgaacaacagggtttggagtttccacccgtgaggggtggctcggggaaatcgggctctaggaaaattcgacttctcataaacggccatatcctaacggatcgtgtcccaaaaggagtcatccgggagcagcagttttggacccgggaaaacccttttgtggaaaacactgga

SEQ ID NO: 691367 - DNA, 1471 bp, Homo sapiens
  misc_feature (32)..(32): n is a, c, g, or t
  misc_feature (371)..(371): n is a, c, g, or t
  misc_feature (438)..(438): n is a, c, g, or t
  misc_feature (466)..(466): n is a, c, g, or t
  misc_feature (535)..(535): n is a, c, g, or t
  misc_feature (553)..(553): n is a, c, g, or t
  misc_feature (565)..(566): n is a, c, g, or t
  misc_feature (573)..(573): n is a, c, g, or t
  misc_feature (606)..(606): n is a, c, g, or t
  misc_feature (610)..(610): n is a, c, g, or t
  misc_feature (618)..(618): n is a, c, g, or t
  misc_feature (627)..(627): n is a, c, g, or t
  misc_feature (649)..(649): n is a, c, g, or t
  misc_feature (829)..(829): n is a, c, g, or t
  misc_feature (837)..(838): n is a, c, g, or t
  misc_feature (873)..(873): n is a, c, g, or t
  misc_feature (890)..(890): n is a, c, g, or t
  misc_feature (902)..(902): n is a, c, g, or t
  misc_feature (906)..(906): n is a, c, g, or t
  misc_feature (914)..(914): n is a, c, g, or t
  misc_feature (1471)..(1471): n is a, c, g, or t
gagcccatggcagggtcgaggccgggtgttantcggtgcgaggctcacatcttcaacggaagtaatggatcatgctgatctataaagggggtgatgaatatgacaaccactgtggcaaggagcagcgtcgatgcagttggtgatgatctcctgcaatcgatcgacgaccgctagcggacaattttaaccctgtgtctgaggagcgtggcaaagtccaagatagtttctacctcttatgagagttggatagcagtctggccgtgttcaccaggagatcgtcccacctcaggtgtgggttccatcttatcttgtcgacgttctgcatcagctggttgctgtttatgtcgttggggggttcctataccagcgantggtagtgggagccaaaggaatggagcagtttccccacttagccttctggcaggatcttggcaaccnggtagcagatggctgtgactttgtctgncgttctaaacctcgaaatgtgcctgcagcatatcgtggtgtgggggatgaccagcggggggaggagtcngaagaaagggatgaccantttattaccaanngtagatngcactttatatgtccagcctcttcctcagtccnccanaccaaagntacacagcnaggtttctcaagcagtctcaantccagtccctcatctcacccttactattgctcttgcttgccagttggctttagatttgcatcttctcactagtaaaactgccttccctttgttccttattttctgttgtttttctcgtagagaggtacagtggtaagtcagagttaatataatagggccggtgaaaacagaggctttgcnttgtctcnngacatcagaagttacaataggcatatgggcaaaanggtgtagcaggctcacnggccgttggttntaanacacattntcacaagttgtgagacactggatttctttaattaacaaaaaaatgcagagaaacattatttatacaggggtagatgctgtcagtgttgcagttctggtaccctatagtagcctccatgagaatcgggaataccattgcgggttggaactacttggcagggattacttgggttgacgccaagtactctcggagagactgagctggaggatgttcaagacatggctctcccacctctgaggttaggaccggacaatgtgaacttcccatacaacggcattaaacgggaccacaactcattgtggcaccgggggcgacgtcaacaccggcgacgggcgaaagacgggggcgaacgtcgccacatgccaaaaggcgactaaaacaagctacgaaagagaaggcccctgcacaggcccaaaagagacaaacaccagggggcagagacgacatacatagctaagagagacaccgccgagcgcacgacaaaacgaccccagcaggcgtcaccaaagaagaagacaacacaagaacacaagcaacaaccaacacacatactcggn

SEQ ID NO: 691368 - DNA, 951 bp, Homo sapiens
tcctgcctccggtcggcgcaggcgggtgttggcccgggctggcctcgtggccagggtctctctttcgggcactggcgggctcgctttggcccactggtggtcgcgtgcgccgggtctcctgtcgcgccattacaggccgtgtgtggtcttttggtctgtgcatcatctctcctggaggcctggagtcgtgcaggtctggcggcaagggtcctgtccggagctgtgcttggcaggcaatcccgcgctttggtcccgtgacacccattgatggcagaggccattggtctttgccctaggaccagcgtccaagtgagcaaccagttctcatgcatgagtcctcaaggcaggttttttgccgtgttcaccgttcatccaaaatggtttcatatccttgtattttctctccgcccaggggttacatggaacacctgaggtgaatgacagaagccttgatggatcggaatctttgtttccgcccaggctccagcgggttcctgggcacgtttccaggcaagcagcatttctgcaggaagtggagggaaggcatccttgtagggtggaggtcgctctcctcttctgaatgtgtagtagtggccactttgatttgttggcggaaccagcccaccttcgggtgttgcaggccaaacttctccttgggtccaaaccggccacggaactcatgttttgatctcacacctacacacaatccgggaaaaccacagcaaaacagcgtcagtagccagaaggtccgtcctgaggccgcctctgtcagcctgccagcttttgctgttccactcttataagcataagaaaaccgagctcataaggtaggaactgtggcgaaacagggacaagccgccatcttggtaaaggagaagaggctacgcttgacctccccccccacccccagcctctatatggccaactgccgtgggaggagcacggcgcttg

SEQ ID NO: 691369 - DNA, 142 bp, Homo sapiens
caccccaggcgcttgtatggggaggctcagtatcctctacagtcagggggaagaaggcccccggaaggtgcatgtacaggtagctaggtggaagccacaggatcctatcatgagggaatagtcaatgccaacaagcgcctgg

SEQ ID NO: 691370 - DNA, 665 bp, Homo sapiens
  misc_feature (226)..(226): n is a, c, g, or t
  misc_feature (308)..(308): n is a, c, g, or t
  misc_feature (322)..(322): n is a, c, g, or t
  misc_feature (504)..(504): n is a, c, g, or t
tcttaacaaacccggtcctggggtgggtgtgggtttaatactaagttgaaatgatttcttttacgggggaaggcgcttgggtgaagttaggccttatttctcgtggtcctttcgtacagggaggaattttgaagttagattagaacaccgaccgtggatttacctccggtctcgtgaacctcagaattcagcgttgaggcacttttaatctcgttgtagacacaanagcagacacccttttaatataaggcggggctgtgacaccacattgtggtgaatgtgtctccgtgtatctccacacatctcgnagggtctcgtatanaaccccctatatgtgtgtgtgtgatatatgtgggacctctctatagaaaatataagggaattgtggccgcgtgttatatctcccccatagggggtataaccgtgtgtgccctgttggtgctcacatgttttattggggtatacacattggatgttatcagtaagttcccgctttggatctgnggtggaatgtctcttagctatggtactggtctccggaaggtaggggttcctggctcccgaggtcgccccaaccgaaatttttaatggcaggttgggaagttttaggacctcgggggtttggtaaggtaacggtgtggcattaataaattaaaggtccccta

SEQ ID NO: 691371 - DNA, 126 bp, Homo sapiens
acccctcccagccccccctaaaaaacctaatactgttgcattggggattaaatttcaacaggaatttgggaggcgatccaacgttcaaacctatagcaggggcctgaacataacaatgaatatatg

SEQ ID NO: 691372 - DNA, 1969 bp, Homo sapiens
  misc_feature (478)..(478): n is a, c, g, or t
  misc_feature (561)..(561): n is a, c, g, or t
  misc_feature (1562)..(1562): n is a, c, g, or t
gtgactcctctaatcgttcttgagtgacccactactaatgaccatggtctgtcccacttagactttagacgccatgtataggagacttacgtaatactattccagtatactggctgggagcaccccttagatttgtgtgtccggcttacttaggcgtgtcttacagatgctcgttctgccttatcttccggcatatataccatcttctcactaatcgcaaggtcgtacgtttagtaagcaggacaggaatggtaccctatcgtccctgtctatagggtcaagcacggagcacttcgtaagcgtgtaaagcattcgtacatcgctattacagccattcttttgcatgactatcatttgtactaacacactacgcctacgctcaccgtgttctcctaactcgctcgcgtttgtgtatggcattgacgctcctgtacctattaggcaacattcacagtcatcgctttggcacgtcacttgnccagacgcggtactatacacttactgtgagtcaactgagtggagagaacatacgcgatggccccctttccagcgacatgtccngcgtcatgtgcaagagccacattaccaaacgtgtatagcggtgatttttgaatttccttctcgaagttcagccctagaggaccgcattcgttcagagtgtaggttcctacctgtagtttagaccctttttgcaccagtggaatccatgtcctgtgaggtataggttatgcttccaccccatatttaaaaagccgccctttccgtacctttagacgaaggacaccttattaacgagtattactacctcctaatcttttacccttttgatccacgctaaagtgtcttcggaactcaaggttattatgtttccggtggccactcaaaggggcctaaccctccaactatgtgggccttgccgagtttcaaccccttggattaaaatattccccgccacatgggaccaatattatcctcagcggcgtaaggcggcctttgcaaggtggcccaaggcggcatagtggcaatcccaaccttataagctacaggacccatttacagtggataatttctcctttccacagaagaggatattaaaccttattagggaaggcaaaccccacagggcgccttatgtgggggcccacaaacaactttaaggggctgcaagacttttgtaaaaaaacagcaaaccatttgttctttatagagacacagcacatttcaatgtcttatggtgggacccagattatggggatatacaggtttggtttagccccctatcccatggactatgaggatatccagccccaagagccttatatattgtgccggtggaacacggccgtttggtctgatgagcaacaccggaaatctccacccaattgtggaacggccaatcgtgtgctgtaacacggcgcgacattggcacagcggcacctactcccatggcaaattacagcgcatgattgtaggttaccacacccgacccctcaacgacttgacgcccacctctaaccctaggtccccctgatggcaaaccaataccatcgcgacgtcagtanaggagacaccccatggatgccgtaccacaacaacgaacggacgagtcacccactccacacgggcggcgacagccgaccgctctctataaacacgatctctccgccccaccccaagcgacaagtgcgaccacaaccagatcctatcacacctcgtcattcccccccgccgagctctccttccgtgctgtaacaaaccagacggtgccctcaccacacgcacaaccgcaccacaaactatctaggcgccccgcccacgcccatccccgaccgcatacacacaaccgacttgcatcgcctgacgcaacacgactatccgactgagcacacttacccccacggaaagccaccctctcctaagccggtgatcgactgacgacagctcagcagtccacctcacctgaacgcac

SEQ ID NO: 691373 - DNA, 719 bp, Homo sapiens
  misc_feature (660)..(660): n is a, c, g, or t
agtttgtgctgtgcactggagccactccaatgctggacgcttcactcctggaatcttcagctaaccagtatccaggcagccttccgggagccacggcttggcttgtggttactgaccccaggggcatgaccaacagcctctcacgggtgcatctatatgtgaacctacctaccattgcgctgtgtaagacagattctcctctgcgctatgtggacattgccatcccatgcaacaagcaagggagctcagctcagggggtttaatgtggtggatgctggctcggaagttctgcgcatgccgtggacccatttcccgtgaacacccatgggaggtcatgcctgatctgtacttctacagagatcctgaagagattgacacaccgaagagcacggctgtgctgagaaggcggtgacccaagggaggaattcagggtgaactggactggtcccggtccttgagttcactgctactcagcctgaggttgcagacttggtctgacggtgtccagggtgccctcttgtgccttattcagcaattcccctactgaagactgtagcgctcagcctgccaggaagactggtctgagactccccagtggtcagggcaactgaaatggtaggagcaaccactgagctgtctttaggctggtcctggcatagnggtgcttaaagggagccatgggaaacaggggtggagtgcaaagtaaacgatcagtttgt

SEQ ID NO: 691374 - DNA, 133 bp, Homo sapiens
agttaatgaggaagtggagaggggatttgcacattagggaagaactgacttcttgaaacttgcccaggtgtgacatgcgagccagacacgtaatgatgcaggactgtcattaaaagttgattgatcgctgtga

SEQ ID NO: 691375 - DNA, 455 bp, Homo sapiens
  misc_feature (51)..(51): n is a, c, g, or t
gtgccggtggaagggcccaatgcctgcgcccctggggccctcattggaggntgagcatccactggactcttgtagcccgctttgtagactgatcagtagtttgtgacatgacgatgtttgagtaaagtagaccattttttgcttcatatatcctacaacgtgctgggatcaggaggcagtggtgggtccatggcatttgacccagcccgacgcccttgtggtctccaggcggtcatgacccatggcctgacccggcttggtcagcccggcctggccgtgttttcccaggttcacacccagccctggcccctttttgcccccttgccaggaaatttgagtcctccttaacgtttttcaaaattgtggttttgttttgttttttttcattcatttgttttttaatttttggcttccgttttttatgggcccctaattgtgtgtgttttaaaaattta

SEQ ID NO: 691376 - DNA, 812 bp, Homo sapiens
acctacagcggggtctttttaaggcgttttccccaaggaagttgtaaatatagctacccctgttgatatttttctggggaaaatttcccccccccccgtggtgtaaacgacacaaaactcaggtctcttcacacgggggtgccacccgtgtgtacccccacaaacttcattgacgtcgatcactcactttcttcgacgatcaatgttggctcacagagttttcattcttccacaccccacgcgtggtacaataagatgtgcgcctacaagggtgtcgaagccttgccatcaacccctggtggcatatctacccttggaaagtccccccggcctctcgggcatcaccaaggcctttcgcgaacctgtggttttagagggagcaccccaccactgggggtccacgctgtttttagagggcactacgacgattgacggtgtttagaccatccacccgtccacgcgagtgttccgtgaaccctccctggagtcccagcaagtcgattccttgccatggagactctgtgtcccttccccccaagaatacttgcgcgacttggccacgcgcattgaccgcaaatcatagttcatcgctctcggaataatccatttacttatagaggattctcgacattttcatggattatattggcagggcgagccactctactctcaaatagacaacatcgtgtaatatggaggagagacccacataggaaccttacgctgtgttctaggggtaggtcttctctttcccgcccccgtgagcaaaaaaagatacatgaaaagttgtgtgccgccgcccaacaaagaca

SEQ ID NO: 691377 - DNA, 121 bp, Homo sapiens
  misc_feature (92)..(92): n is a, c, g, or t
  misc_feature (110)..(110): n is a, c, g, or t
gacgcgtggtagcctagacgtctggggatgcttctgtccacctgtcctgcagaggagtcgtttccagccctggcgtgcgcccaaggatgggnttgatggttttcaaaaancagggaaaacg

SEQ ID NO: 691378 - DNA, 283 bp, Homo sapiens
tttttttttggggttttccccccctttttttaagggggggggcccacatttttccccccgggttgggccccgggttttttttttatggggccctgggggggggcccccccccccccccccccccccccccccctcccggccccgggggggggggggggggcccccggggttttttttttttggggggtttttttccccccctttttttgggggggccccccgggggggggggtttttgggcttttttttttttttttaaatttttttttttttttggggggga

SEQ ID NO: 691379 - DNA, 457 bp, Homo sapiens
  misc_feature (54)..(54): n is a, c, g, or t
  misc_feature (68)..(68): n is a, c, g, or t
ccaatgcaatgtaaatgctatgtaaatagttgttatactgtattgttttggaantggaatttttttantgttatattgttatttttcatttttttctatgtattttcaatcccacagttgaatgaatcagaggatgtggaacccacagatacagagagccaactgtattgcctatttgaaaattgcactgggcatggtggttcacgcctgtaattccagcactttgggaggccaaggtgggtggatcacctgaggtcaggagttcaagatcagcctggccaacatggtgaaaccctgtctcgggaaacccctgtctctactaaaaatacaaaaattatctgggcatggtagtgcatgcctgtagtcccagctatttgggaggctgaggcaggagaattgcttgaatcccagaggcggaggttgcagtgagtggagacagcaccaatgcactccagtc

SEQ ID NO: 691380 - DNA, 225 bp, Homo sapiens
ttttttttcaagctttgtctgctttatttcactacattaagttaagtcaataaggcaaaatctagtaacctgtcatctcatcaaagatcaaggagtacctctctgtcccaaaaggcacgaaaaagggtgttcttcacaaatcatagcatgacacttagctcattattgctgatatgctacttcatacatagaataaggtctagtctcgtgcgtttctgcgccggg

SEQ ID NO: 691381 - DNA, 648 bp, Homo sapiens
cgtcacatccggtagagttagagcccgtgcggaggcggtgcggagcatttcggctctgagcggtgggcgaccggcgctgtcgtgcaggggctgcaggcggagcctccttaaggaaggtgctaagaggttggcagatttcgattgaagcactatcgaccggtgactagcagccaggagtcatgagtcgacagcggagagcaagaactacggagagcgggtgaatgttgaagaaggaaaatgcgggaagtcgtgcatttgacaagttttataactgagtatttgaagctcaggaataagtgaagctgagaaatttgaaaactatagcagacaagactgccgatgctagttatcagagcagaagtcccacttgtagaatatggagcaattggtgtgaagtggggacggatgaaagaagtcagaatttgaagcgaagatgaaatgatcaaggaaagcaagaaatactggttgggcgctcggtcgccccaaagaaaagattgagttaagaacactcttggtgggccgcgggagcccagacctttgtcgacaactgtggtcacagggcgttgcaccaagaaaagtccggtcggcacaaacggggggggtccccacctgtaaaaaggcgggggcacccgcgcggctctacccatc

SEQ ID NO: 691382 - DNA, 160 bp, Homo sapiens
cacgaggagtgccttgccctatgtcacacagctagaaggtggcaaaatcaggctgggcatgcatggatgtctgactccataccctgtgccctgggctgcttggctcccaggacatgccaacccctgcgtcagggctgcctgacataactcaaggatggtc

SEQ ID NO: 691383 - DNA, 1035 bp, Homo sapiens
catgagagttgagagggtgaggactctgtcgcctgcgaggaatttgctcacgtcgcggatcccccgtgctgccgacatcagtgtcgtcgcaggtaagacacccagagtccatcggactatatcgccgaagcagtgtatcacaagcaggaactcccgcgaagagcaaccttccgggcaaagcgaccatcagtcatatccgctacaacccgctgcaggatgagtgggtgctggtgttcagctcaccggatgaagcgggcctggcagggtcaagtggagccccatgcttcgtgaagacagtgccccgcacagtgaccctctcaacgcctctgtgtcctggggccatccgagccaagcggtagaggtgacatcgccacaggtacgagtagcacgcttccatgtttgagcaagcgacgttcccagtactccatggcagcctgagtgcccccagatccatggacccagttgatcatccccttttccaagcaaagtctgctcgaggagctctgtaaggtcatgtgcttccaccccgtggtcggatgtaacgctgccactcgatgtctggtcccttgagatccgggctgttgttgatgcatgggcctcagtcacagatggagctgggtgcccagtacccttgggtgcagggtgtggtcaggagggagttgacattggtgtcttgggactaacagagctccgtatcctatctgatagatctttgaaacaaggtgccatgatgggctgtatctaacccccaaaccacactgacaggtatgggccacaagaatcctgccagatattgcccaagcgttaaggagcagatctcagcgaggcctattagagtcagcatggagaagacccttgcttaatgggaagtacagcacgccagggacatactccaggggaggatcagttcaaggtactaaaccagtgagcactcgcgtagatctgggtccccttactgtggaacaatgggccttaccatagaaccagagtgcttggcccagcaagcgtttcatgaggataactggaccagacacg

SEQ ID NO: 691384 - DNA, 598 bp, Homo sapiens
  misc_feature (112)..(112): n is a, c, g, or t
  misc_feature (369)..(369): n is a, c, g, or t
ggcagttcggcggtcccgcgggtctgtctcttgcttccaacgagtgttgtgagactggaacgagatccaggggactctcttccagcctccggaccgccctctctggatttcncgttcctcgcgctgtgcgacctccggtgaccagtcttctctggccgatctcctgcttgctgggggaccctgcacagcaaccggtgttgttgtcgcgtttagactccgttccttttggtggggggggcccccggccccaaaaaaaaaaaaaggccaaaatccgccaaatttggaagcctcccaggattcgtcatgaagttattcgcacccgaacggttgggaagtgcagccctgtctagatcatggcccctttggtgntttcccaaaatttttggtgaccgtgcaggtccttccgtatcaaccttacccctttcttttcctttccttggggggggccccttttttgttccccccctttataaaagtttttatcctccgcggggaaccccgcggcgagacttagattggtgggcgtcccttggggggggacaaaaaggggggccaggtttgaaggccccaaatttttttccgttatccccccagggag

SEQ ID NO: 691385 - DNA, 411 bp, Homo sapiens
tcttgctactgataatgccctctgacccaactgcttagtgtgtttcatcatgcatgtattttttttgcttatgggatggagtttccctcttgtcacccaggcgtgtgatctcggctcactgtaacctccgcctcctgggttcgagcgattctcctgcctcagcctcccaagtggctgggactgcaggtgcatgccaccatgcctggcttagtttttgtactttttgtatttttattttattttattttattttttagtggaaacggggtttcactgtgttggccaggatgatctcgatttcctgaccctgtaatcccaccactttgggaggccaaggtgggcagatcaccaggtcaggaattcgagaccagcctggccaacatggtgaaaccccgtctctgctaaaaatac

SEQ ID NO: 691386 - DNA, 1049 bp, Homo sapiens
atttataggtagaggcgattaaaactaacgagcctggtagagtagctggttgtccaaggatagaatcttatgtctcaacttaacgattatgcaccagcagaagcctctaaatccccttgtaaatttaactgttagtccagatataggaacacgcctctttggacatctaggaaaataagccttggtagagagagtaaaagggagttgtaacacccattaagtaggcgcataaaaggcaggcacaccagagttaaagaagagcggttcagaggcctctaagctacccatttactctaaaaagaatctcctacaatcagtagtaacatgaaactctttcacaccgcaattggaccaaatcgttgatcatcggcctaatagaaagaaggctataggtgttaagtaattaacgtaacatgaaagagcagtgctccatccgccataaagcgcgtgcgtctagattaaagagttattgaactgacagaattaaacagcccaatagtctaataattcaaggcatgcttaaaaagaatagaagaagacccatcatacattaagaaacaaaaaacaaatgaatcgagagattacacacacagagcaggtggcggtggctgaatgaacaagaattgcccctaggaggggtgggccctgaggaagaataagcgtctctcgtcggaagagggacgaggccgacagaaacgggctcctgtttaataacacaagatgatgaggcgggctccccaaacggcttggccgggtggaagacaggggacaactggacgtcatgcggaaagacgcaccagaccctgctggggggaggactgggtgacgaccgtcgcaacagaggataaacgagcggaggaaaacagacccccacggggcttgtactgcgtcaccacaaagcgagttatgccggcgcgagaaagaggccacccgccagtatgcagaaaaattactagacggagcgacgtaaatagaaccgccgcaacgacagacgacgcgcacagatgcgaagccaccgcgcaccaacaacaaaccaccaagcaaactcc

SEQ ID NO: 691387 - DNA, 320 bp, Homo sapiens
acaaacgacctggttttataggtactccagtacatactggatttagcacgatggtcacgttgacaaacctgtaagctcacggaccacgggaacacatctatgtacattcagaactaatctaagttcactttcaagtgacacgtataccacattatcaagtagtacaattactttataacagaatattcccaattcctttgtcctcttccttattgctgtcattcattttacttatccatcagctgtaatcactgacacattgtagctattatttgttttgaacaaactgtagtctgtcagttaggaataagaaaaagatt

SEQ ID NO: 691388 - DNA, 1604 bp, Homo sapiens
  misc_feature (886)..(886): n is a, c, g, or t
  misc_feature (915)..(915): n is a, c, g, or t
  misc_feature (919)..(919): n is a, c, g, or t
caatgggctgggttggtgccgcccacacatcgtggagcgacgcctgtctttttgcttgttattctgctacacccaaagagtaatgtatcattgttgggggacgcgatgaaaatgaataaaactccgtgtaacatcccgttgtctgtaataaaaaaacggcgtttgtgcatagagaataatcttgggggggaggatacccccccctgttgtgtatcattaactgtggagggctccacatgtgggggtcagaagtttgcggggcgcgcccaacaagaggggtcgctggcaatatttcctcctttgattaaaggccctccccctatatatttaagatggacaggcgctcatcaaagaaaatggtctcctttggtggggaagagggggcccaaagtttgatgaacgcccaacgatcgtgtaatttcagtccggtgggaagagaccgttgttgctctaagcaaaaagcgcggtgtaatggtaatgggccgtgtataaacacaaaaaaggggggcgcgttcataaaccacacggtttagtgtacgccccctccatgttggaatacacatactgtccccaacatttgggggggtgtatcaccatatggggggttgatataccccaccatcattatctcaacaggaagaggaaaattaatcattaatagaagggttgcaaccacgcatgggggtaggaaccccacaggatgaacccatcaggatgaggggcccgcctccccatcaggagataattattataagagctggcgctcctggcgcaacattattatctccgtcaatgtgcacaaacagccttattatgtgtcttcggaagattattcctcgtgttgaagcaccaccaaaacacccccttcggaaggagagtatctatnaataaccccatcagaggcacaacacaatngggnggaaaaaagggaggagatttccccccctatagtgtgtataagatataaacaatcggggtagtccttggtgttgagtaacaccacctgaggaagataataggccacacatatgatcgtgtatagcgatgaagccccttgagaaacaacattgaggagatacttcacgtttccctctatacaccccttgtatatagacacacatagagttcacacatgtcccaaaagagatgggagatctataaaaagagatgtctattataaacgtgtatagagaccctcataaatcacgcacatatataaacacctctcatagagagagagagagacacgcctatagagcgacaggtagcgcacagttctacccgagacacatataggggcacataggggggcacacaggagaccttacaaatggtctcacacaaacacactcacaaaacgcacacatggcgacacacacacataagagagagaaacaattgacgacacacaatgggagtttataattataaactaaaagaagctttctgcaccacgcacaataagaaaactatccactcacgaggtgaacacacggcacaacctatccaaaatgggaggaaaaatttttgcacaacctatctcaattctgaaccaaaggggtaatatcccagaatttacaatggactccaaaccaaatttacca

SEQ ID NO: 691389 - DNA, 1038 bp, Homo sapiens
gaagaggtgcagcgtgtccgtggagaggcggctcaagcagccccaggccgacttcagcaagaatcgctcgggcttcatcctcagcgtgcccgggaactgacgccccgcggaggcctggcccggagcccggccacactccgagtcctgggtcccagtccagctgctgcctccgcaacccatgcccgctagaaacctgctgcgagggcccactcccagaggagccccgaacacacatgtaacgatcgccttacctggtctactgccttgggatatcatcttcctctgtccttactgtacacggtccctgttcaataagccaaagacctggtgccccgcccagacccctgggcatgacgtccaggaccactctcaacccagaggcaactggactggtgccttcagctcggcgccggatgcccgtgcaccaggatcaagctcagagcacatggacacggctgtccatccctgatgctgaccctgccacagggaagcgcgtgcgggatgcacagaaccacctacgccgcaagccccacagacaccacactctgcccaacgatgcaacccacccgcccgcaccccacctccaggcacgctctaggccccgcagacccgcccgaaaccctccccaaccccagctcccgcgccgccagcaccaccccagggcgacgcagagaccaccacaggacagcacctacgcacagagcacacgacaacaccgaccaagcccacacgctcaaaaacaaactccacacacaaccggcacacaaaccacccgaagcacgccgcaacagaacatcgccgcacatccccacacacacgcccacgcacaccacccaacccgacacccagcgagcggacaccgaaccaaaaacgaagagaccacgacaaaacccacccgcacacggacacccccacaacacggcaacctgaagcccctcgtcgacacgcgcggcgcccgcagcacgcactcgacgctaacgctcgacgagcaaggagtcaaacaacacgcgcaacgccagggcgcgacgcccgcgaccc

SEQ ID NO: 691390 - DNA, 103 bp, Homo sapiens
  misc_feature (7)..(7): n is a, c, g, or t
agacatnggaaagcgatggcgcgctgggtcggagaggtttggccacccagcaggaagattatcttcccgtgccatccccgcttccagctctgcatccacgccc

SEQ ID NO: 691391 - DNA, 361 bp, Homo sapiens
gacttcgggcattggtgttgcacggatctggtttagccctgcatctgttgcgttatagtgtcgcagagctgggcttgcgcatctgggcgttgttcgttgtgtttggccgctaagtcggtgcgttatctggctcctgcttgagcgcaatgctccgtactgggctatcctctagcagtactagatgtcgagggtcggaagcttgcgaatggtggggtcgatatacgatagcctgatcgatgtgttcctggatgcccaaaaccaaagttaccagtatctagagaagttgtaattacttaactcatactcccgcacctttagacccttctccaagatttcttctgccttggcccctcgaactgtg

SEQ ID NO: 691392 - DNA, 636 bp, Homo sapiens
  misc_feature (20)..(20): n is a, c, g, or t
  misc_feature (465)..(465): n is a, c, g, or t
ttaatgttttaaaacagttntcatgaaaagaaaataatataagggttcaattagatttggaatgaattcatttatttattcgacaaacatttatagagcacctacaatgttccagaaattatgcaaagtactagaaatgtagcgataaacaaaattgacaagtctctgtcttcatggagcttacagaccagtgagggaagctgacattaattaagtgatgacaaaaataaatatatgattattcattgaggtaagtactaggaaacaaacaggctggaatggttggaagagggctcactgaggtacttcctggggtcaggcagcaaagctatgagctacaattatgagtttggattttattctgcacaagatgaaaaatcactgaagagtttcaagtcagagtaagacatggtctgatttttgtttcaaaacatttactttgcctgagtagagcccaagtggganaacagtgtgagtggaaatgagaaagtcactcaggaatgcttaggtaggggaagttgggaggctgaggcaggagaatggtgtgaaccgggaggcagagcttgcagtgagccaagacagcgccactgtactccagcctgggcgaaagagcaagactccgtatcaaaaaaaaaa

SEQ ID NO: 691393 - DNA, 286 bp, Homo sapiens
gcgaattcactagtgattgtgagctgagatcgcacccggcctacagtacttctaacgtaacatcgcagaaacactgaaggagagaagagaatacacttccactcggaattcgcaccctggtcgccttcattcgctgggttcactcgctgaactgcctcgcccccgcccgggaggatgacatctcggcctgggcagagactcgaaagcctcctcctgccgctcgggatgctaacagcagggagagctgtgtctagtttttttttttttttttttttttttttttttt

SEQ ID NO: 691394 - DNA, 216 bp, Homo sapiens
  misc_feature (27)..(27): n is a, c, g, or t
  misc_feature (71)..(71): n is a, c, g, or t
  misc_feature (78)..(78): n is a, c, g, or t
  misc_feature (145)..(145): n is a, c, g, or t
  misc_feature (211)..(211): n is a, c, g, or t
ttgacctcttgccaagacaaggaaccnccttatgagatgtcatcttctgagctctctcgatggagggaatnccacggngatgattgaatatgaaaagtcttggcacagtggctcacacctgtaatcccaacactttgggtggccnaggtgggaggattgcttgaagccaggcattgagaccatccttggccaccaaacgagaccccatcanaacaa

SEQ ID NO: 691395 - DNA, 642 bp, Homo sapiens
gctgttctttcctttcgcgttgcggtgcgcctctcttccgagggggtggcatccgctgtctctgaggggtgggggttcccccctctaaattggctcccatatcatttgactttagggttctggtgtttggtttcttcattctgttactgcaactcccgatttaagccttaccaagggacaacgcctctggccgtccacacgtaggacgcctgaaggtcactcgtggtgaggctgacatgctcacaccattaccaccgtagagagggcaaatcctacagcaccgaggaactcccagagatgagtgtctggagcgcttccagttcacgctttaaaggcccggacgggccacacgtggctggcggcctcgttcccagtggcggcacgtccttgggcgtctctaatgtctgcagctcaagggctggcacttttttaaatataaaaatgggtgttaatttttatttttttttgtaaagtgatttttggtcttctgttgacacattcggggtgatcctgttctgcgctgtgtaccatgtgagatcggtgcgttctcctgatgttttgccgctggcttggggattgtacccgggacccgctcacgtaatgccttgcctgtaaccatgtaattaaaagcctctttcttta

SEQ ID NO: 691396 - DNA, 175 bp, Homo sapiens
  misc_feature (38)..(38): n is a, c, g, or t
ctagaggatcccatctcaggcaggtacgagtgggaacntagagtgggagagattagctgaaagaagatttgtggtaaggggcgatattgtggggttgttaaagggaacattggtcatatagaatgatggtgatggaaacatttattgtacagaactattggtgatggcctgagat

SEQ ID NO: 691397 - DNA, 378 bp, Homo sapiens
tcgagctcggtccaccactcctatagatcagtgctttgggaggccaaagagggaggattacttgaggccaaaatttcaagaccaacctgggtaacatagaaagacctcatttctacaaaaaataaaaatattagccggccatggtggcatgcgcctgtagtcccactacttgggaggctgaggtgggaggattgcttgagcccaggggttcaagttatagtgagctatgatcatacctctgcactccagtctgggtaacagagcatgactttgtcaaactataatatatatgtacacacacacacacacacacacacacacacacatatatgacacaggaatggagaggaagagacaaaagtgatctataagagtggt

SEQ ID NO: 691398 - DNA, 121 bp, Homo sapiens
tatcagctcggtaccctctcacatgcaagacaaattgttccctccttttatctgaacaaaatgcattttttgtcttgattgagtttcttccacagagagaatctgttccattgtcagtaaa

SEQ ID NO: 691399 - DNA, 230 bp, Homo sapiens
gagctggaactacaggcgcctgcaaccacgcccggctaattttttttttggtatttttagtagagacagggtttcaccgtgttagccaggacggtctcgatctcatgacctcgcgatccgcccgcttgggactcctgaggtgtagggattacaggcatgagccaccacgcctggcctcttatatctggattaaggtcctgtctgggcctacaaaggttcaattggcttaa

SEQ ID NO: 691400 - DNA, 235 bp, Homo sapiens
cactttgcactctcaatcccctaggctcaagcaatcctcccacctcagcctcccaagtagctgggactacaggcatgcgcctctatgcctgactaagttttaaggttttttttttttttttttttttgtaaaaacggggctttgttttgtttccccaggcgggttctcaacggaggtccccatccttataaggagaaacaaaaagtttaaatagggaagggaggttttgattcca

SEQ ID NO: 691401 - DNA, 296 bp, Homo sapiens
gaaatgggcagtggaggattcgtccacacccacagcttctcaacgggcctgaatttggccaagaaaaacctttatgagcttgtccctctctggtcaactggttttttgttcgtttgtttttttgagacaggtttgcccttgttgcccaggctggagtgcagtggcacaatctcggctcactgcaacctccacctcaggttcaagcaattgtcgtgcctcagcctccctagtagctgggattacaggcaccatgcccagctaacttttgtatttttagtagagacagggtttctcca

SEQ ID NO: 691402 - DNA, 278 bp, Homo sapiens
gcaccaagtatgggtcagatggactgctactgtgtggttcactcaacccctcccctagacggggctcagaacactgcacttcccaagatgaaatgacatctagtgggcgtgcacgtagggatcgcccatggcacacgtccacttcgtcaggcctctagctctgaccccgccttcctgaactctcacagcagttccccagtggaatccttctagaagtcgaccatgcaggacatgctatgctttggcacctggtccgctcgctttatacacacgtacgt

SEQ ID NO: 691403 - DNA, 640 bp, Homo sapiens
ggcaggccacctggctctcacctactagtgtccccatactcctatgatctgagatacagagaccatgtacttctaccctggaatgagttgaggccactgtgttccttaccgctatggagctattttaccaggctatctgctggggcctgggacaactgctcccacctcctgacacccttctcccactctacctaggcattctggacctctgggtatgggatcatggggtaggaatggaaatggatgtgagcatcaacatgcagtggtgggcttgttggggcctgggagggtgcaatcctacaaatgcggtggtgtgtggtgcagcacaggagtggctggcctccttctgagctcctgtcccctgctacacctattatacccagctagcctaagattcagtggaaagtgcggacatgcttgtagtgggaggggctacctttccataaatccttgatgattgacaacacccatatatacctattagcctgatccccaagagtttcgggcgttgtagcttcatcatcacgagaatatgtgggcttccaagtatgttcgggccaaggacctgatgacctgaagggttgactataccccatttgggtgggagtgtatgagcatctgtcccccttagatctctgaa

SEQ ID NO: 691404 - DNA, 316 bp, Homo sapiens
  misc_feature (172)..(172): n is a, c, g, or t
  misc_feature (175)..(175): n is a, c, g, or t
  misc_feature (279)..(279): n is a, c, g, or t
  misc_feature (288)..(288): n is a, c, g, or t
ccgcagccccctgtgttgggactccgttccagctgttccaggctgtctgtttcctattccttgcagacagatggggtgcttgagaggaagcccaggaagccaagccttaagaggacttggaagcaatttttggatataaatcccttgtcctaaactcagggcaacagtgtantcngcccagcagtgttgaactgcctgtgtttgtctagtatgtgtgtactggctggttggctctgggcttcattccatgtatgccactgctctattgccaagataaantgtaagacngtctgcccaagcccttctttagtactta

SEQ ID NO: 691405 - DNA, 184 bp, Homo sapiens
gtattatagtactagttctctactttctatcttctatgagttatatatatatatactctatttagcttccacatgtaagtgataccacatagcatttgtctttcacatggcttatttcatttagaaataatagccctctcaggttcatactctgtatgccacactgtgaccagcgttttccatc

SEQ ID NO: 691406 - DNA, 448 bp, Homo sapiens
acaggagataccaggatagtgaacagtcaaaacagcaggctcagatggtgagcggggggggggtaaagagacagggggatgagaaggatgaacatggccgagctttactattgaattccgagaggaggcttaccacagccgctcaaagtcttccaactgcctccttgaagaagaggcaacagatgaggaggaggatcaaaactctttgtgacccttggacacggtaataacctcggatctgcaatttcaagtgagcaaagaccgctatggagggcagccaacttttctcagagaagttccccacccttttggtctggggcaaggagtactttacgggagtgccaaatgggacacagtcttgctttgacggaaatggtaacccagaatctcccaattggaatgaaatgtcgctgctcagaggtctctcctccttcgagcttgggtaggc

SEQ ID NO: 691407 - DNA, 1038 bp, Homo sapiens
  misc_feature (412)..(412): n is a, c, g, or t
  misc_feature (699)..(699): n is a, c, g, or t
  misc_feature (1038)..(1038): n is a, c, g, or t
agcgggagtacgagtggagagagcgagctgagctggttgtgtggtccgcgtctcgcgaaaccggtacgcgctgtgccagcatggactgaccatactgaactgagagagtcagcattgcaggaacttcaatcagaacgcgtttcttgcagtactttgcacaagagagtgggtgactggtgaactataagcacacaagaggatgttggtgaacctgtaactgaggatctctgggcgcagaagtccgcgcacgaagcacgagttacaggagcagtgatctgaagtcgaacgtacgagtgctagatgcgtcacactgggcagcacattcgaacttccactggaatttgtcgtgacgaagtgataggcagagaagagacatgcaacatgaccaccagactagtgcacagtaacgtangacattagaagaacgccattgccggtgtgatcttgattaaatggcatggtcaattggtctactaattaagttcgcatggctagaatacgtatctggcgcaatggtggatgacgataaacgcttaggtagaaagaaagttaacgagaattgtaaggacagttcgatcgaatattgattctagggcatagctaggatattggcatggttggatgtgtctaaagtaagactagtgaatggagttccgtacaatattgagtggatcaggtcaatagtgatacgaccgttgntaacaggatatgctgtttagaagtatctcgtgtgtagccaataaaattgttccaattatgtcctgtgtgtcatttgggtgttgctaagctgtcattctggtaaccaatggtgttcatcaccgatacgtgtgtcaatagagccaattatggctatgctattagctacatctagaggactttcaattctcatccataggttagtctatcacctatagtcttaacgtggatcacattgtcccttaggaaccctgtagtgtgaagaaaaccattgcatcaaggtaaacgatggttggcagtggtggactgttacatcctggaataataatctaaagacccctn

SEQ ID NO: 691408 - DNA, 983 bp, Homo sapiens
gacgaggggctggattcctgaaaggctgtactgtgaggatccccaaccgcctgctgaaacccaagcctgccgcgtagagagcgtgctgtactgggccctcttctcccacctgattcgagtcccacatccccaggatgtcaacctcagtccctcaaggccatacactggacccaactgggctgaagaaagactgattgaggatggcaggacctgcatggacccagctgatcatccactgctctggcctgtgctatgaccatacacccactatctgccaggtgccaccgcagtgcactggcccaagccccaagagacctggcgacacaagccaagccacaggagcccggcgcccaaccgactatgcactgacgctgcacacgcaggcgaccgcggcacggaaggcagccggcaaacggcacgcacacgcacccaacggcacgagatgcaccagccacgctgccgaccccaccaaagaaccgaccactaacccacaggtaagaccgggacacatgccacacgaagcacgcacacccacaagacaacgaccgaacacacaccacgcgcacacgaacaagaccccctaagcaactgcgacgagcgtgagacaaccacagcccccaaaacaccagccgggaacgacaacaccgcaacaccggagacccacaggcaacgcaccaccgccagaacccacccccacgagccaaccacgaccaccccccagaacacagggacaaacatataaccagagcaagtgttcaaatcacttgacatacaaccagcggaccaatgacactgactcatcagcaaaagtttctcttccaggacgaagggatctgctgatccacagcactacgagagggaatacttaactccgctagcgtcataaaccatcacctgcatacttgtttactaacatggtatactaagtgagcacccaacacacagcccataccgaactctcactgatgtcacataagtgtgca

SEQ ID NO: 691409 - DNA, 121 bp, Homo sapiens
aaccgaagtcgcgggaacttggtcgaatcggtcacgtcttgcacgtagagcagcactgcatcggggtcattggtcaggaccacatcgccctcgatgtcgaacggggcggtgccgcggtcgt

SEQ ID NO: 691410 - DNA, 283 bp, Homo sapiens
acaggatctttccgactagcccgacagacaggagagtcattggtggctgggggtgagctgctggatagatggcagtaagaacatattgtacattattgatgaatgaggtgactgtgaagaatctccagaggaggccacgggagaacacaatgacatgagtgactgtcctgcttggttaggaaagggaaacgtaaagttgtggaattcttgttgatgcatggatgttgagcagtggtgaagcccttgtcggggctagtcgggggggggggtactgaggctccga

SEQ ID NO: 691411 - DNA, 103 bp, Homo sapiens
gaaaagccttgccttcccaaggagttggcttggctctttgaattacgttagccaaattatggggctggtgttgtttaggaaggaaaccaggctgtaagggtaa

SEQ ID NO: 691412 - DNA, 361 bp, Homo sapiens
aaaaccaggcctcagatttaagagaacgttcaaaacagtctttggttggcacggggaacactggcatgtaagctctccttaacccggagttgccacatgggtgtaaatcaagtctctgcgtatgtttaagaatttaactttatgtggccgcggttctctccttaaaaacgattacgccctttcgtgctcgcgtcaaagtttaaagagtataacgcatttttcacaatgatccacgcgttaaaatcgcggatatttcttaaccacagtattcaacagcgcacacaaagcgataaacccctttttgttgtgccacataacaatagagactgctttatacagtttttttcacacacactaaccc

SEQ ID NO: 691413 - DNA, 114 bp, Homo sapiens
cgacccaagcaatcagcaaacagcatgcaaagcaggacagcaagcaaaaccagcaggtccaacaccacttccagttttcacagcaatgctcattcccagcatccaacatgccca

SEQ ID NO: 691414 - DNA, 248 bp, Homo sapiens
aataactatttaattaacctttttatttcttcatctattaaaaaattttcagtagtgcgttctgaagcatttaagtaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaa

SEQ ID NO: 691415 - DNA, 704 bp, Homo sapiens
  misc_feature (354)..(354): n is a, c, g, or t
  misc_feature (475)..(475): n is a, c, g, or t
  misc_feature (540)..(540): n is a, c, g, or t
  misc_feature (543)..(543): n is a, c, g, or t
  misc_feature (547)..(547): n is a, c, g, or t
  misc_feature (580)..(580): n is a, c, g, or t
  misc_feature (590)..(590): n is a, c, g, or t
  misc_feature (609)..(609): n is a, c, g, or t
  misc_feature (653)..(653): n is a, c, g, or t
gcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgaatttaattctttcacaaaaatgatttcaaattatcctagagtataacatttttatcaaagatattatttccggagntcttctttctttcttttttttttttttttagtaatttagcaaaaacattactgttctaatgctgaagtgacttttgccagtgccatgtccagggggggaggtataagttacttgctcttancatttgggctggattttttggtttgggggacacctttgggagtattcccaaagcatgtctcaagnggnggcncccgagagcatggtttaaaagcttggacccctncttgggcagnaagaaaaacagggttttantaaggaataagtccaggaataggtaacccaatgctttgcttttncctacccaggctaatggttttaaacccgcctgaaattggaacctgccggga

SEQ ID NO: 691416 - DNA, 570 bp, Homo sapiens
ccgccttaggcgttttttttctaaaaccaaatctttattctctagctttgaacaaggaggggtaaatggttgtcctgttatagtcccagagaacagaacaaggcccaataggtagaaattataggaaagcagaattcattcattataaggaaggattctctaacaattagaatttctaacaattagaatcatccaggcctcaggaggtgcggaagttccgtgtcacctaagttgctcaagcagaggccaggtgtccatatgctagaaaatggacgaaaaggaaactcaccagcaagtttcccctcagtgttggccctccattcaccaatgtgcggcagctcctttgctgtgacagtgctgagctcgtggagaggagcgaaggagggcgctgcgcgtgttcagacaaagagcctggacacagtgcgtgctgacagccaggggaaggctctcagcgcctgggacggggcgacagactaaacgcgagacagaccagggagtaaatgcctggggggtctgcctcttggggaacggaacgaggatggaagtactaacagcagacgggtctctcca

SEQ ID NO: 691417 - DNA, 205 bp, Homo sapiens
  misc_feature (104)..(104): n is a, c, g, or t
  misc_feature (112)..(112): n is a, c, g, or t
ggatcctcttgccttagcctccctagtagccgccatacctggctaatttttgtattttttgtggacacatgaggtttcaccatgttgcccaggctagtcttganctcctganctcaagtaatcctcctgcctccgactcctaaagtgctgggattacaggtgtgagccactgcaccccaaggggggggggggggggggggaattc

SEQ ID NO: 691418 - DNA, 926 bp, Homo sapiens
ttgaagatggaccacgtcatggacgtggtagtgaagtccgtgaactggatatgctcccggggactgaaccacagcgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggtttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacaagttgttctcccattatgaaactgagcaaaaaaaaatattgctcccaggttaagggattccaggtggaatctggtcgtccacatcgaacgtgatggcaagaaaatcctggcagggcctatggtgggacaggtggagctcagcccaggatcggcgtgcca

SEQ ID NO: 691419 - DNA, 164 bp, Homo sapiens
ttcgactcgcacccaatgaaattctgtcaaaagttcctttctggatttcatgactgatttttgagaagagtcacacacttctcaggacacacttgtctctttctccacacacattgacctgcgtaatttctcttgggactcatttccccaaaaaggggtacttt

SEQ ID NO: 691420 - DNA, 916 bp, Homo sapiens
gagtccgagtggagagagcgagctgaggggtggtgtggtcgcgtctcggaccaccggtaccgcatgcgagcatggctgaccaattgactgaagagcacatgctgaatccaaagaagctgtatggcattattggacaaggatggtgatggaactataatgactgatggatatggggaactgtattgagatctcttgggcatgaatccctacggaagcagagttcctaggacttgatttgtgaagtagatggtgatggtaatggggcaaatggtcttcgctgaatttcgtgacaatgaatggcgagagagttgaaaggactacagaccagtgagagaagactattagagaagcatcccgtgtgttgataaggagtggcaaatggcctattattagatgcatgctgaacttcgtctatgtgatgacaatacacttggagaggagttaactagatgaagaagttgatgaactgatcatgggaagcagatatggtggtgatggtcatgtaaattatgaagagttgttcaaatgatgacagtgaagtgaagagtgtacagaagtgttaaacttctgtacaaaatgttattggcttttcttgtgtgtgcttatcggaaagggtttctccctactggcatagatatgctgtctcgtatgaggacttcatctccctgtgtctcccgtatttatgcgtgtccagagctatggttaaaatggcagcacacggtggaggggtaacggatgttctagcgtgggatatagtaaaagggtggggctgggcacatggggtactcctaggaattggaaggaagagtgagcagggggtacggggacacaccatctcacattaacggggcgcacaccttgggccaaacacgttggactcctattgtcttagaatatcattgatacttgtaggtgg

SEQ ID NO: 691421 - DNA, 471 bp, Homo sapiens
cacaccacctgagtctaaaagtttgagaccagcctcggaaacatggtgagaccctgtctctacaaaaaaaaaaacacacaaaaatggccaggtgtggtggtgtacacctgtggtcccagctatacgggaggctgaggcaggagaattgcttgaacccagaaagcaaaggttgtggtgagccgagatcatgccactacactccaccctgggtgacagagcgaggctccattttacaaacaaacaaacaaacgaccaaaacaaaacaaaaaaacaactggaatgttcagactcccatcatgaacttattgaacgggagagggagaaacatacaagcccttgtccctcagcatccagacccagattattaagctaaacacactggcgcgcatacacacacacacacacacacacacaaatacaaattcacatgtgccttggaggtttgtattttcaaaacagcttaaaaaattc

SEQ ID NO: 691422 - DNA, 477 bp, Homo sapiens
  misc_feature (35)..(35): n is a, c, g, or t
  misc_feature (141)..(141): n is a, c, g, or t
tctgtacccaggaagcttagagggtggctaccagntgagacaatgagctatcccccagggtggcagcatgtctgcacatctaaaatttgtggggtttttgtgtttttttaagacggagtcttgctgtgtcgcccaggctgnagtgcagtggcgtgatctcggctcactgctacctctgcctcctggggttcaagtgattctcctgcctcaggctcccgagtagctgggactacaggtgcgtaacaaacccagctgattttggtatattgagtagagatgaggtttcatcatgttggccagcatggtctcaatctcttgacctcgtgatctggccacctcgcgctccgaaagtgctgggattacaggcgtgagccaccacactcagcctggcctttaagactgggaaagtcatggccgtgaattctcagaagtcatgagtccttggatctcttcggtgtctctcttcacagacttttt

SEQ ID NO: 691423 - DNA, 332 bp, Homo sapiens
ttaagtgatcctcccgcctcagcctcctgattagcttggtatacaggtgcacatcatgaatacgctgggactacagacacacaccatcacacttggctacttttttttaaatttttgtaaagataaagcctggccaacatggttaaaccccatctctactaaaaatacaaaaaattagccaggtgtgatggcggttgcctataatcccagctactcgggaggctgaggaaggagaatctcttgaacccgggaggcaaaggttgggttgcagtgagccgagatcgcaccactgcactccagcctgggtgacagagcaagaccccatctcaaaa

SEQ ID NO: 691424 - DNA, 706 bp, Homo sapiens
  misc_feature (37)..(37): n is a, c, g, or t
  misc_feature (64)..(64): n is a, c, g, or t
  misc_feature (70)..(70): n is a, c, g, or t
  misc_feature (73)..(73): n is a, c, g, or t
  misc_feature (75)..(76): n is a, c, g, or t
  misc_feature (121)..(121): n is a, c, g, or t
  misc_feature (123)..(124): n is a, c, g, or t
  misc_feature (182)..(182): n is a, c, g, or t
  misc_feature (242)..(243): n is a, c, g, or t
  misc_feature (277)..(277): n is a, c, g, or t
  misc_feature (486)..(486): n is a, c, g, or t
  misc_feature (570)..(570): n is a, c, g, or t
  misc_feature (626)..(626): n is a, c, g, or t
gggtaactaacacattctctctatatcgcaggtggtnacgtctgcctgtcctccattgctggtnccacanacngnntacataaattgagtaggaaagggttatatatgtgggtggcctgtncnntacagagtacggtggcatggtctctgctgtgtccctttttcaaatattttcccaaaanggaccagtgcccctttcttctcagccctcctccacagcctgactgtactgccagccgcanncatgagaaggaggtgtgaaggaagcctgaggacntccacctcgagaaaaggaaacaggaaaactatttccttccgccttctctggaccaaattcactcccctcagctccagagagtgctgcaaaaatcttccttagggacgctgtgaagacacggggaagaggccagccctgagcgggcaagaagaaaagcttgaactttccatgcagtaccaagcaaggctattttggaaacaagcaaacanacaaaaaatggaaaccaacaccatataaccacaggttgggtagctcctaaatcctggacagcatttggattgggggtaagggcnattttactccagctccttgtttataacccgcacaagtgccagaggtttaggaccanactgactctcttcctcgtagacatacgcgggggatctctgagtcactgagctcactgatgctcacaaaggtgggggtggg

SEQ ID NO: 691425 - DNA, 342 bp, Homo sapiens
ctcaagtgatctgcccgccttggcctcccaaactgctggtattacaggcatgaggcagcatcccccagcctcagtttcttaattattcctgctacaccagccttgccattgttattccttacacctgtaacagataccaaatcttgtgatggcttattaacattgtaatctacattttttaaaaccataagtaagcaaacaggctttctgagaatattatttttcttctctgtctcctgacagatctgcctctgacttccttttctttctattaccaggtttttctgtgatatattctgtctactgtttttcctcccatttttgtctcaattaattatattt

SEQ ID NO: 691426 - DNA, 276 bp, Homo sapiens
tgatcctagagttccgattgcttgtgtataggaatcgcactgtgcgacgaatcgactaggattactgagagccgggttgactatactccaccatggtgccaggctggggggggaagtaatgaccaccgggagagagctgatgggtccagaaaaaaaagacaagaattgaggagctggggacctcaatggagtagaaaagctggtgttgagttaatggagtgagaaagcccaaaggatgaaatgttgggatcagacagcaggaatcctggaagtgaa

SEQ ID NO: 691427 - DNA, 230 bp, Homo sapiens
ggccacttatccagtgaaccactatcacgaaaaaaactctacctgtctatactaatgtccctacaaatcttccttaattataacattcacagccacaggacttatcatattttatatctgcttcggaaccacacttatctccaccttggctatcatcacccgatgaggcaaccagtcagagacgcctgagacgcaggcacatactttcctcttttacacgctagtagggt

SEQ ID NO: 691428 - DNA, 1419 bp, Homo sapiens
  misc_feature (315)..(315): n is a, c, g, or t
  misc_feature (681)..(681): n is a, c, g, or t
  misc_feature (1364)..(1364): n is a, c, g, or t
  misc_feature (1419)..(1419): n is a, c, g, or t
gcttgccatgtgttagagaaggaggaggaagcccatagacccccaaggccccactgatgggcccctaactgatggccaggtacccagatgtccaagacacccgagtgatccatggccacggatggcttgaacgacgtgcttgacaccctcagtgtagtcgatggatgggtgggcggccgacggacccgtggcatgcgatagggtcgtcgctggcaatgtccccggtccaaagaaggaacgaacgaatgttctcgtaccactcgtccttgttcttgataggaacgagcaatgacggacacgatgttgaactccctngagaggtccgctgcaagtctaagcacgtggtcgctcgtcgcggtgacgcgaacgcttggttgtctgtcaggctgtcgcgcgcaggtcgagcagttctgtggcttcctgtcctgtgttgtatactcggatagtgcaatacatataagccaagggactctaccagacgtaggagggtccctctctgggtgaaccaggtacccgatgtaagtctccctgggacgttgaaccgcagagtgtggtgcatcaagacagacccacagctcactagacctggctcgcacttgtacctactcaggaggccttcggactttcttggggcgagactatggactctctccccactacgggcggggggacgcgctgacntagagttctatgcgctccatggtcgtggccatgggtacatgcaacgggcgttccttgctgcattttggcctgcgcaggtcgacccttcccttggagcacctcaatgcattttccgtgcccgggcccctcccctgtttgctggaccatacacgcatgatttctcggttcttctgggtctgtgcgttaccctcctcctatcccttaagcggtcctccagggttgaaccggtgactccacgcactcctggggcttcgagtggttgggaagtgctccatctggacccgggtggatccttccttcaaggtcctacttgtccaaaaagtgccctggtgaacacgtggtgaaagccaccgctgggtgttgtcgccaccatgacgggggcctttgacaaagggggccggcttttgcggaccccaaccttctctggctgcctgagaataccccccccaagtgggggtcgacgattgtgccacgggtgtggtgccgtccctcccaaaggtgagtggtcttccacgtgttgtgaccacgaagatcccctactcagcagagccgagtcaaacagcgccacccaagcatatgacaactcaggtgaaccatcaagagctgcgcgaaagcgacaagatttctagagtgcgggcagacgaggacagaaacacactagtccgcaggaagaacgatgttanataccctcatgtccaagcatacaatgagtcagatcgatctttcatccacaaacgn

SEQ ID NO: 691429 - DNA, 204 bp, Homo sapiens
accgctccttaagtaaaaggtgtgacatcataacgggtgtcacattggctggatggttttacagtgcacgactatatatatatatgaagtatgtacttgacaaatctagatggctttcttatagcagaattcctattcttcatctatttcttcggctggataagctgtaccgatggtgatagtgacacggatgtccagaaatcc

SEQ ID NO: 691430 - DNA, 89 bp, Homo sapiens
agaaataaataaattgcctcccttcctcggctcccctttcccatcaccccttcccctcctctcccctccttttccttccttccttcctt

SEQ ID NO: 691431 - DNA, 424 bp, Homo sapiens
atagctgacattattaaaaacacatccgaagaagtagggggccctgtggcgtgtagaagacaaatcaggcatcctgtgaaactacagacatcaggggccagagcccgggagcacctgagtaaggcaaatgcagatgataggcggagagccgaccaggctcacaccaggaatgacgaggtctgatcgaattctccttcacttcgggcactacgctggctgtgaatcaccttcttactcgaagtccctttctttgttctgacaaagtggcctcggctataggcaagccagatgccacagaccaagattcccaggagaatcagggttacaaggacggctgccacgatgacccgcacattccgctccacagcttccatgcgcacagcatttgaagtcaatgggtgtcccatacccattccgtgcccac

SEQ ID NO: 691432 - DNA, 112 bp, Homo sapiens
cagccattgcttaggccttggctcgcctggaccacaagtatgcacctgcatgttatgcccaaacgtgcactgttgcttacacttggtcacgcttggggaaggtcaacgagga

SEQ ID NO: 691433 - DNA, 208 bp, Homo sapiens
tcttgatcatgtaagcttcatacacatccttcttgatgaggacaaatacgtactccatctctgtacgcttatatgatctcatcctcatacttgtccttgacgtcctccaccagcccctgaatgtagacaagctcaacacccactagctaaaaaatcccaaaactataactgaactactcatacccagttggaccaatctataaaccta

SEQ ID NO: 691434 - DNA, 1621 bp, Homo sapiens
tgcttcaccttttctgctgtcaccttatgcacgctccttttcgagctctgatgaaatctctcgcgtgcctgcggtgcaccatggctcatcatgacgtgtatccactgatagacacagcggcaatacgtacggtgctctctttcatggagcaatgtcctcctatggtcatttctctgacactctcctcgagtgctgcttcgacaagtgtctccctcgtgtcactatgactgcacacaggcacccctctggaccggcggggaaccatatgtgtgggtggaatgcctgaacggcaaaacgtaatactcgcgtcttctaacgatacagaagatgtcgcggtctccataatcggtgtaccaaggcgactaacgttgaatcagactactacacagagaaatttccgcagcgtgggagacgtacatgttggatacaatgtatctcgcgtctgacataatcagtcggccccactttctgttcgacgtcttgcgcgtgatcttctgcgttgttctccttggttctagttgtcttgtatgtcgtgtcttgtttgacccgtctctgttgttgtgtctccgaacggcttagactcctctgcttgccgagaacctagggctcactttctgttacgcaacgtcggttaactgaaacgtttgttctgctgctgcgtcgcatgggaacggagtcctcggaatgaactctcattgcggtggcttacgtaaatggttgcagacgggttcgtcatggcccaatttctacggattagtctttgctctgatgtatccctcatccaccaggttctccttcttcgtgtatgtatggcgctgtcatgtacgttggaacgatatctctctgtgttattgtgtgagatgccccttgttgttatagtggatgtcccctggtcattctcgcctcacctctctgcatggctcatccatgcaagaacgacgtgtccactgggtcactctcaagatgatcctatgctctctgtgattactgaatgctgagtgtcattgtggtgctgtcatgttctcatgatgccccttctctgcccctttagtattctgagatcctctgcttctcaggaatcaggagccatgtccgtttggtccactcatgttcacacttctgatgtgagtgttcatcgggtctcactaagcaaataattattcatgatcctggttgcactatcagtcatgaactgcttagcctccaagggtgtcctggcagcctgtaatcgtcttgattctatgattgatgaactagtccgatggtccacagcttggcctctataataatgctgctcctatgggacgccgctctactttttggtgagaaattagaagagtatcctaatgttgaaaaccatgacatgcgctcttgggatctgctgttctctccagggctccagaagcctgatacctgttaccaaagctaggaaagagctttatcacaagccttcactgtcctggcatgagaactggctatacagctctcagtgtaccccagtacatgagtcgtggggtgtggttgtgcgttatgtggtggtgttggttgttttgtgcttgtgtttgtttgttgtatggtggtgggatgtgttggtgtggtggtgttgtgttgtgggggagcg

SEQ ID NO: 691435 - DNA, 328 bp, Homo sapiens
  misc_feature (49)..(50): n is a, c, g, or t
  misc_feature (55)..(57): n is a, c, g, or t
  misc_feature (210)..(210): n is a, c, g, or t
gcacttctcaacagcaagcagtgatagcacagcctccgcagcaacgcannctccnnngcagccgaatgtctcctcagcataaagctttcttaagcctcattaagaaaaaaactgaaagcaatctatccttgtgtgccactggtgttctttccactttatacgaaagcaagtacccatgctttgttgtgtgttggcctttcatattagacntcattcacaagactttcctctctctgagatgtcatcacctgtatgtcatttattcatcatacacaagagataaatggttataacgacaaatctcattaccgactccctttcagatcct

SEQ ID NO: 691436 - DNA, 285 bp, Homo sapiens
  misc_feature (69)..(69): n is a, c, g, or t
ctggcatctagtcattggaagccgggaggcagaggtagagtgagctgagatcacgccactgtactccangcctggggatagagcaagacttggtctaaaaaaaaaaaaaaaaagaaaagaaaaaaagaaaaaaaaaaaagtttttggttttttatttatatttttcttctttttaaattgatccggccttgggggggaaaaaaaaccattttggaaaacctccagagaatggaggtaaaaaacaaaaacttcgccaccatccagagcgacagttaacactttctt

SEQ ID NO: 691437 - DNA, 444 bp, Homo sapiens
gacccacgcgtccgcccacggcgtccgtcagggctcttctcagggcgctctagggactgccacggctgttgtcagccaggaaggccaaaatcaagagtgagatgtacgaagagttgtaaaatagagaaaagtggagtaggctgaatcggtggttctttgcctcgacattaggatgatggtcatgaaggttctctaggcatgtgtccctccttttcttcaccctccccttgttatcttctagttgaatcaggagaaacttcaaacgttgatgggatggtcggatctcacaggcttgagaactcgttcaccgtccaagcgatttcatgaaaagagctgcgttcttgattaatcatacaaacgtctcaccatgatgtgaagagttgtcacaaagtccttcaaaatagaaaagtaatgacttagaagatgcaaacatttaaataatgg

SEQ ID NO: 691438 - DNA, 366 bp, Homo sapiens
acggagaggactcggcgagatggaagggatgcttcagcccaaaaggctgaggctgcagtgagctgtgattgtgtcactgcactccagcttaggcgacagagtaagaccttgtctcaaaaaaaacaaaacaaaacactagcatggctctgcaaacccagggcctgtgagaaggtgaactgaagcacagagaaacccaggacacaggagaaagaagctccagcccaggagaggtgctctcctgcctcctctgcgagtctgttgaccgctggagaggttgatgtgactgtgacaaagctggggaaattctaatgtgacggaaagttcagtttgactcagctaacatttgttgagtccctgtgatgtgat

SEQ ID NO: 691439 - DNA, 576 bp, Homo sapiens
gtacacattctaaagcatttctgatttgaatatttttgtacattatgatcaattattaaaccttctcttctagtgtgtaaaaaaaaaaaaaaaaaaaaaaaaaaaaaaaaaaaaaaataaaaaaaaaaaaaacaaaacaaaaaactaagctaaaaatctacttaaagacaactgaggacacatgtaatgttcatcaacttcaggatggatggtgaactgtaagaaagatccgatatataatctaattcaaatcactctataggcaatgcaaagaccatcactattggccaaccaccaatcctatatgtccttcatggagatttggaaatgttaattccacacgtttagtgagaaccattgatgacagagtgttgctgtggagtgatgtgcacactctactagccagtctcgtttagcgtctgtttgccataatgaaaaactctgcagtttatgtctccaaatataatcacatgactaaggatcaaataaattgtcagcagcaaccttaatccttgtgcaaaatccaaactatccaacattcaaaccaaaacatgcacaaccttgtggacgttgccc

SEQ ID NO: 691440 - DNA, 109 bp, Homo sapiens
gtaattagtatctgatgtcttgttaagactgctgaagaattatttttttgctgttataataaggaataaaccccacctttattccttcatttcatctaccacttttctg

SEQ ID NO: 691441 - DNA, 814 bp, Homo sapiens
  misc_feature (54)..(54): n is a, c, g, or t
  misc_feature (61)..(61): n is a, c, g, or t
  misc_feature (70)..(71): n is a, c, g, or t
  misc_feature (106)..(106): n is a, c, g, or t
  misc_feature (114)..(115): n is a, c, g, or t
  misc_feature (117)..(117): n is a, c, g, or t
  misc_feature (135)..(135): n is a, c, g, or t
  misc_feature (137)..(137): n is a, c, g, or t
  misc_feature (143)..(143): n is a, c, g, or t
  misc_feature (214)..(214): n is a, c, g, or t
  misc_feature (220)..(220): n is a, c, g, or t
  misc_feature (227)..(227): n is a, c, g, or t
  misc_feature (230)..(231): n is a, c, g, or t
  misc_feature (233)..(234): n is a, c, g, or t
  misc_feature (237)..(237): n is a, c, g, or t
  misc_feature (245)..(245): n is a, c, g, or t
  misc_feature (258)..(258): n is a, c, g, or t
  misc_feature (263)..(263): n is a, c, g, or t
  misc_feature (265)..(265): n is a, c, g, or t
  misc_feature (267)..(268): n is a, c, g, or t
  misc_feature (288)..(288): n is a, c, g, or t
  misc_feature (291)..(291): n is a, c, g, or t
  misc_feature (321)..(321): n is a, c, g, or t
  misc_feature (324)..(324): n is a, c, g, or t
  misc_feature (328)..(328): n is a, c, g, or t
  misc_feature (346)..(346): n is a, c, g, or t
  misc_feature (351)..(351): n is a, c, g, or t
  misc_feature (361)..(361): n is a, c, g, or t
  misc_feature (369)..(369): n is a, c, g, or t
  misc_feature (398)..(398): n is a, c, g, or t
  misc_feature (401)..(402): n is a, c, g, or t
  misc_feature (413)..(413): n is a, c, g, or t
  misc_feature (418)..(421): n is a, c, g, or t
  misc_feature (429)..(429): n is a, c, g, or t
  misc_feature (431)..(431): n is a, c, g, or t
  misc_feature (442)..(442): n is a, c, g, or t
  misc_feature (452)..(452): n is a, c, g, or t
  misc_feature (463)..(463): n is a, c, g, or t
  misc_feature (466)..(466): n is a, c, g, or t
  misc_feature (470)..(470): n is a, c, g, or t
  misc_feature (605)..(605): n is a, c, g, or t
  misc_feature (610)..(610): n is a, c, g, or t
  misc_feature (681)..(681): n is a, c, g, or t
  misc_feature (801)..(801): n is a, c, g, or t
attggtagatcccacttatcctcccctccctgcaaaggcatcttccccaatcangccctancccacccanngccaggagaaacaggaacacccactaggacggagnccctcctnntncacaactcctcctcactncncacctngcctcctttggtccaccctactttccaccaatcagccaaccaaccttgaccacagagaaaccctcacttcnccaacntcatttnatnncnnctntcataccncactaacacccanccacntntnnaccaacacacacccctcctnacnttcaaacactcacacaacccactcttcatncantcancacttcaatcatcacacnacaanacaacccatntcctcaanccattcctccatcttaccaatattccccnctnnccaactacgcnaccannnnaatatttncnaaccccttccnactacttccnctctcttaaanacntacntcacttccaaaagcacttatcaccacacacctgcctcacccctgccctgcagagccaatggatgagaggccaagagggaggcaggctcggggctgggccgcagcagccctggcagacaggctgagccagcctgtncccanataggtctaggggccagagaggtgttcgactacccttgtggcatttactatggtgcagacgacagggagcnacaagcagttaagctcccccaaaaagagaaacacagtataaggcagtgttagaaaactttaaatacaggattaagatcaaatcggtaaggcatcacaaatttgtaaaaaggaattttggntgcattcggcata

SEQ ID NO: 691442 - DNA, 1803 bp, Homo sapiens
  misc_feature (55)..(55): n is a, c, g, or t
aaaaaaatagaacacggattgctagtaatttttatggcgccaaaaatgaattcangtttacgttaacctatgcaaataaagtttttgatttggaaaaactaaatgcagatattaacgcttttaatgtccgtttgaagcgctgggtttctcgtgaaaatttgggtgaaattgtctatatgtttgcacgagaagcgcatgctgaccggaagttggcatattcatatgctgattcggtttaaagaccaaaaaaaggtttatattccgaatcgttttaagtaccaaaataaaaagaatcagtttacgcaaaagctacgtttgaacaaattaagcgcgataaaattgatgcccctatttttgatttatggggaaatggcgttgttagagttcaacgcatgaataatattgatagtgttgctaattatctttgcaacttatatgactaacgttcttgttgatgaacttgatgaaaaagaattggctaaagtgaaaaagcaaggtaagacgattagcccgactgtcagtgatgagagcaaatcttacatcaaagggcaacgattaaaatattttcctagcaatgcccggatattcagttggtctcaaaattatgttgagcctgaagtatttatgatgaaatacggggaagctcgtcatacatttggtttgaaagatgaaaatatgaattatcgtacagccaatgaagttgtaatagagaatgataattatgaaaagccttttattaatcgaattgttagggaaggctataccagtaaggtaatagttaagcataacgtgttcctatcacgtcaagtatgggcgaattggcaagcacaacccaaagagatgattaagaatgacattgaatggtttaaggttcatgcccccacttatttagctaatacagcaaaagcctttgttaagttttatcactacaatgttttgagtgaatttgataaagataccaaacaaggctacttagcatggcgcaaattcgtcactaaggcagaagaaaagaaatatgaagagttaaggcgattgtatcaagataccttaggtattagtatccaatcattccgagaagtaatgacactagcaaagtatcagcagtatgtcggagttaagggatagaaaagagtgatcgccagaggagtgcgtagcacatttatagcgtccgttttgtttgtacgtactagatgttaaattagccattcgctctgctcatttgagttatttcacagttagaaagctattttttgaaagaaagagagatagcttgtttcgttatgttctgaatcaataaaattgtaagaaaacggtgggatgggggacttctagtgactcgaccgaccagggagaggcagacaacccacgcccgcggaccagctctgctgggaacgcagtgggcttgggtgccgtttagcccgaagcgaccagcgtagggtaggcaccttgtccctgctagaagtgcgccagcacgccgtttagcgccgcaggcgctattaacttgacttacaatacaataaaaaacaggccaaaaggatttaatgcatcattccataaataattaatgacttaattttgccgttcaaaatttctagagaattttacactccttatattattaggaaaggagttgtaactatgaaaaaaaataacgttgttattgtggagaatgtattgtttattatcaaaataatttattggattgttaaaattattttgatggtgttttttccgtaattaacccgaacaattaaactctaaaaaacgcctaactggaaatattctggtcgggcgtgtttttaa

SEQ ID NO: 691443 - DNA, 452 bp, Homo sapiens
ggcctacaagaaggaagtatatcgttgaactcatacggttagtagccttttttgattggcttcatttcgtttagtaattatgcatttaagtttcctccttgttttttcatggctttctggctcatttcttttgagcactaaatgatattccattgtcaggatgtaccacagtttatttatccattcacctactgaaggatatcttggttccttccagctttgggcagttatgaataaaactgccataaatatttatttcctggtttttgtttggacatagttttcagttcctttgggtaagtaccaaggagcacaattgctggatcatgtggtaagagtgtgttgatttttacaagaaatcaccaaactgtcttccaaagtggctgtaccatttagcactcccaccagctatgaatgaaagttcctgttgcctcacattctccatggtgggg

SEQ ID NO: 691444 - DNA, 372 bp, Homo sapiens
ccgcgctgggcccggccccttaaacggcttcaacaggaggagcgccccggaggcttccccggggtgtgggcacccacacccagccccaggccggagcactaaacgtgagatggggctgcctcgagccccaacaaagtaatttgggagggactaggagctgagcctttttccttgacggtgccctgcaaaaagccaatcaaacgttgcaaagcccccccgcccctatgcttgggccccccccgagcaggggtggggaacttttagcaaaaggcggcaagcgggacttttggtcccagcatttcctcctttggcctgtgggttattccccccccagtgatctgtttccccccataaagtttcaaatttttggga

SEQ ID NO: 691445 - DNA, 1370 bp, Homo sapiens
  misc_feature (112)..(112): n is a, c, g, or t
  misc_feature (513)..(513): n is a, c, g, or t
ccgttgaataagttgtttttgcaccccgttggtgtttatgtttccaccacaccttgtggggggcgcacgaacagaccacgcaccaacgactgatgtgttggccgtgtggagnagaacacaactagttttgtcttgggaagtgcgccaccacacagggggtgtcgcctcgccctgtctccagcctttttggttgcttggtgggtgaagtggtcaattataaatggcgccccctctgggtgggaataagctctttgtggcctcctcatgtgagtagcccgcctattgtgtagttgtgtatcctcctcataatttcctgcctcgttgagctcccctgttatatcccgctttctggtgttctaaaccccacaccgagggtctccacaggagaagtgggacgagcggcgtttcctaaggaaaacaaaattgtcctgtggtcggcactacaagaattgggggggcctttatgggggcggacgaaaatagggagaaattgtgggggatgagcctccacanggggcagtatatagaaggtcttataaaaggggcgaccacggcgtgggatcccacgaacacaacccgcgttatacccacgcgagatatcttctcggcgagaaagggctatagagactacttctatagagatattctacacgcagacatcctcttgtgggtgtctctcacacatgttgtatatagagacatgtttgtcgagcaaatctctggggagagatacacacggagacattgtgggggaataaagaaaatgaggacacacagagagattgtgacccccacattatgagaccccccacactcttggagtaaagtatagagaggggtgtttcgctcacatatatcactcagaggacacacagatatcgagagagagagtatgcgctcttggcctctgtgttcccccccctcggcacatatattgggggggttttgaatagaactttagagacagtgtggtaagagtgtgcgcacagtgcctcttcatatatggcacagagagttcttctcctcttgcccttacccctctctttcactgacacgggcacaaatatatacacacacggctagaacccctcgttttctcctcacaccctcgttatatcctgtttttcccctataattgaacacatttctatatcacgccccacaaccctccactttctgaccgggccaccctggtgtgtggaaggtggcgcggaaggggtacacgtgaacttctgggggttctcctccacgtgagcccccaataccctcactcactgaaacccttgggtaggcttgagattttgcctaccatcccgggaaacttgttgctggaattgctgatggaacaccaattaaatatttactatata

SEQ ID NO: 691446 - DNA, 323 bp, Homo sapiens
cggtatatagcctaggctagctaggacttgagtctctggggctaacagcatatccgaacgctagttcagatcaatgtgcttgaagcagcagggagagctggactctccaccagcccttctgccatggctagcacctcagaacgatcacgaggtgagcatagcaaggctaacaagcctatctcttgcctggcctatttgagcacagcagtgggatgtctggcatcaaatgctcctagtgctgccaaactgcttgtacagttgtgtacacagaacttgatttctgctgcaacaggtgtcaatctaaccacaccacgacgacgaat

SEQ ID NO: 691447 - DNA, 187 bp, Homo sapiens
gtcctgattagaatcttggagacacaatttattaaacttcttggatttcaagaaatacaggggcaacaaggggaagttggagcaataattatgggtcagtgttctgaaagtgggagagctcaagtgagcagtaagtgaacaatgatcaggtggaggatgccgaggtggtgcatcaaaccggcgggcc

SEQ ID NO: 691448 - DNA, 225 bp, Homo sapiens
  misc_feature (150)..(150): n is a, c, g, or t
  misc_feature (215)..(215): n is a, c, g, or t
gcggggtaaccctttcatttcttcaattttgtaaaagggccaggtgtggtggctcacgcctgtaatcccagcactttaagaggccaaagcggcctaacgctgacacagaatcacttgaactagaaaggcggaggttgcagtgagccaggntcggaccactgcaacctccgcctttctagttcaagtgattctgtgtcagctaactggggaggctnaggcaggaag

SEQ ID NO: 691449 - DNA, 120 bp, Homo sapiens
  misc_feature (90)..(90): n is a, c, g, or t
ggccggtctttgggggtaggcggctgtggcggccgaggttcggcggctgctggcgtttcaggatcggaagccagagaaattcctaaactnggtgtgtgagccttttcactggatttacaa

SEQ ID NO: 691450 - DNA, 745 bp, Homo sapiens
  misc_feature (123)..(123): n is a, c, g, or t
  misc_feature (129)..(129): n is a, c, g, or t
  misc_feature (683)..(683): n is a, c, g, or t
  misc_feature (690)..(690): n is a, c, g, or t
  misc_feature (695)..(696): n is a, c, g, or t
  misc_feature (703)..(703): n is a, c, g, or t
  misc_feature (710)..(710): n is a, c, g, or t
  misc_feature (716)..(716): n is a, c, g, or t
  misc_feature (721)..(721): n is a, c, g, or t
  misc_feature (724)..(725): n is a, c, g, or t
  misc_feature (731)..(731): n is a, c, g, or t
  misc_feature (736)..(736): n is a, c, g, or t
  misc_feature (740)..(740): n is a, c, g, or t
gagagcagcaggaggaggcagagcacagcatcgtcgggaccagactcgtctcaggccagttgcagccttctcagccaaacgccgaccaaggaaaactcactaccatgagaattgcagtgattngctttngcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgaatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggttaatggactgaggtcaaaatctaagaagttcgcaagacctgaatcaggtaccctgatgctacagacgaggacatcactcacaatggaaagcgaggagttgacatggtgcatacaagggccatcccggtngccaggnactgnnagcggcntctgatnggacangccgnggnnaggacngtatnaaanagtca

SEQ ID NO: 691451 - DNA, 498 bp, Homo sapiens
  misc_feature (50)..(51): n is a, c, g, or t
  misc_feature (192)..(192): n is a, c, g, or t
  misc_feature (302)..(302): n is a, c, g, or t
  misc_feature (316)..(316): n is a, c, g, or t
tgatctagaggtcctagacggactgactgtgtgacgaatcttattgtggnngagtactgctccttattcacttcatgcacagtgcagcgtgacagggctttattgatggggcttggagctgtaataaagtcagcatgcagattgtgaaggttcgtatagccaccaggagacaagggtcaaaggaacgagccnctgtgggctctgctgcttagagtactttgtcctttctcagttcttaagggcaactgggaaggaagagggatcagcacttcacaaactggtgggtgacctcatagattccnacagactcctgggncttttcatcatagtcagtccagtccttctcctgcagattaatgtcactgaaggctgtcccggactccacaccttcagcagcaaacccagcctgcggctggaaatcaactggttcaaggccccggcactcaaactccactattgtcttgaagttctcattgtcttcagcattgtaaggcttga

SEQ ID NO: 691452 - DNA, 764 bp, Homo sapiens
  misc_feature (354)..(354): n is a, c, g, or t
  misc_feature (377)..(377): n is a, c, g, or t
  misc_feature (389)..(389): n is a, c, g, or t
  misc_feature (421)..(421): n is a, c, g, or t
  misc_feature (446)..(446): n is a, c, g, or t
  misc_feature (454)..(454): n is a, c, g, or t
  misc_feature (466)..(466): n is a, c, g, or t
  misc_feature (503)..(503): n is a, c, g, or t
  misc_feature (523)..(523): n is a, c, g, or t
  misc_feature (565)..(565): n is a, c, g, or t
  misc_feature (590)..(590): n is a, c, g, or t
  misc_feature (607)..(607): n is a, c, g, or t
  misc_feature (618)..(618): n is a, c, g, or t
  misc_feature (621)..(621): n is a, c, g, or t
  misc_feature (623)..(623): n is a, c, g, or t
  misc_feature (629)..(629): n is a, c, g, or t
  misc_feature (632)..(634): n is a, c, g, or t
  misc_feature (636)..(639): n is a, c, g, or t
  misc_feature (641)..(643): n is a, c, g, or t
  misc_feature (645)..(649): n is a, c, g, or t
  misc_feature (651)..(654): n is a, c, g, or t
  misc_feature (658)..(660): n is a, c, g, or t
  misc_feature (663)..(663): n is a, c, g, or t
  misc_feature (666)..(666): n is a, c, g, or t
  misc_feature (668)..(668): n is a, c, g, or t
gagttgttttttcctttggccagatgctttttggtcccgtctgtccttgcgccctcaggatttcgggttctcaatttgtgttcaatttttgtgcaagccttgtctagcagctgcttttgtgaaccagaaaaggccattaacatggtcccggatcatcaagtcttctgactctagatgggacactgacagggacttgaaacccttgcatattcaggaatgcatgagatttccagagagcctaccagtatgaaatcattgttcgaccaacaataagccagcttgcttctgaaatagctgtctttccccagtagctactcacctgcctctggtggctgggattccagatagcccacnaaactgtcagtatctatagaccnggtctgtgccanctcctctctcctctgtgctcagtgaggaggcngtaaatgaagttacaggctagcacnatacctantcatgtttcccngtacacctgtagatattactgtacttttatgttctcnagaaataagttgttgcctantcagtgttacagatttctttgtttctttttaattaaaatacnagaagcagctgaggaaagggagacnaggtattttatttctgnctgattttagnaanancttgtntcnnntnnnngnnncnnnnnannnncccnnnttnctntntaagtgtttttgtaattaactttcagattttctttgttttttaagaagttgatgtgcttgtttgacatttgtctcattaaaacttttctacgttga

SEQ ID NO: 691453 - DNA, 791 bp, Homo sapiens
  misc_feature (123)..(123): n is a, c, g, or t
  misc_feature (129)..(129): n is a, c, g, or t
  misc_feature (729)..(729): n is a, c, g, or t
  misc_feature (736)..(736): n is a, c, g, or t
  misc_feature (741)..(742): n is a, c, g, or t
  misc_feature (749)..(749): n is a, c, g, or t
  misc_feature (756)..(756): n is a, c, g, or t
  misc_feature (762)..(762): n is a, c, g, or t
  misc_feature (767)..(767): n is a, c, g, or t
  misc_feature (770)..(771): n is a, c, g, or t
  misc_feature (777)..(777): n is a, c, g, or t
  misc_feature (782)..(782): n is a, c, g, or t
  misc_feature (786)..(786): n is a, c, g, or t
gagagcagcaggaggaggcagagcacagcatcgtcgggaccagactcgtctcaggccagttgcagccttctcagccaaacgccgaccaaggaaaactcactaccatgagaattgcagtgattngctttngcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaagtgctgtggtccatctgaagaaaccatatgactttaaacaagagacccttccaagtaagtccaacgaaagccatgaccacatggatgatatggatgatgaagatgatgatgaccatgtggacagccaggactccattgactcgaacgactctgaatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggttaatggactgaggtcaaaatctaagaagttcgcaagacctgaatcaggtaccctgatgctacagacgaggacatcactcacaatggaaagcgaggagttgacatggtgcatacaagggccatcccggtngccaggnactgnnagcggcntctgatnggacangccgnggnnaggacngtatnaaanagtca

SEQ ID NO: 691454 - DNA, 762 bp, Homo sapiens
ccaagcgtcgcgacgagtgccctggcggatgcccccgctgccttcccatggtccagttgagctgccaggcatcacacttgactctcagctgtgctcttgtcgcttctgtgttgtggtgacgccagtgctgctccccagtgggccaagacctgcactgctggaggtctgtgcccgagtcacccacggtgccatactttgtagtttcagcctttcgagccacttggcagcctgtcagttgcttgtgctcctaatgccagtgggaccctgatgttgactgcccccctgtggcgcctgcccatgtgccgtgaggcccttttcatgaaccgggcgaaagctcagtgccttgatctctgctgggcccgtgtgggccgtgttcccatgtggacagtgtggtgatgcctgtggccggactgtgctcgcacgtgctgatgcgggacgcccccctcttggcttgtggttgtctacccttgtgctggctggcatggggccagggtatattgcccgaattatccctccctacaacgatcaccgtcacacaccctcggtcaatactcacttggagatcaccggtaccacagccaaaatcttggaaagacaatgccactatttgattacatctccaataagatgatgcaaagtacctagcaatctaggaagtttagcgctatataagacattgcggactctcagacccaggccaacgtgtgtcatccaatggctctgccaactctatgctgcttctccgaaagaaacgagtgggcc

SEQ ID NO: 691455 - DNA, 87 bp, Homo sapiens
cttctcttctcccctccgcatcggtagcagcaagcactctgcgtctctccctttatccccgcccgcatggctgctctcctccgcacg

SEQ ID NO: 691456 - DNA, 285 bp, Homo sapiens
gaatagaaaaagaagttatactctcacaattataatttaacattgactgagaacttattatgtgccccaagcgtggtttaataacggaagtctttttgtaaagtttaaagaaagtttttattaactagtttaatttttggtgagatgcgcacttttactaccctcattttatggaaggaaagggacaaaacctaagagggggccagggaaatttaaaggggaaaagggccgttaaaagccttttttaaaaacccccgttttttaggcctgtggctggaataagga

SEQ ID NO: 691457 - DNA, 165 bp, Homo sapiens
ctgcttatagaggatcccggtagcgcggtcgttattactctccgcggaaagcaagctcagccccaatgcgtgttgctcaggaaagcagcgcgtcgtggtttctcccctaggtctgtgcttgccaataggaacaatggatggtcgtgggatgcctccgtgctcccg

SEQ ID NO: 691458 - DNA, 509 bp, Homo sapiens
tgcactcaaagccggggcctttccccacaaccaggcaggccacactctccatctacaggctgtgggctggaggacaatggacggacctgcctcggtggctccagaccccacctaacaaacctgaaaagcaaaatccaacatgatctgactgctttcaagtgactgagttccagaacaaagttcaagaacattcacacgaagaagagtccttagcaccatacaagttttgcaaaacccacccacatcctggcatcagctacaggttaccagatgtgcaaaggaacaggaaacatgacccacaatggggagaaaaacccagtcaatcaaaaagcccggctttgacacagatgctggattagcaaacaaggtcattaaagccattggtgggctgggtgaggtggctcacacttgtaatcccagcactttgggagaccttggcgggggaatcacttgaggtcaggagttcgagaccagcctggccgacatggtgaaaccctgtctttactaaa

SEQ ID NO: 691459 - DNA, 157 bp, Homo sapiens
  misc_feature (32)..(32): n is a, c, g, or t
  misc_feature (38)..(38): n is a, c, g, or t
  misc_feature (107)..(107): n is a, c, g, or t
  misc_feature (120)..(120): n is a, c, g, or t
actgtttcattgacttggaaatgctgggccgngcgcanaggctcatgcctgtaatcctagcacttagggaggctgaggcgggtggatcacctgaggtcaggaattcnagaccaccctggncaactaatacattccgggtgtgctggtgcatgcctat

SEQ ID NO: 691460 - DNA, 232 bp, Homo sapiens
  misc_feature (33)..(33): n is a, c, g, or t
  misc_feature (47)..(47): n is a, c, g, or t
  misc_feature (111)..(111): n is a, c, g, or t
  misc_feature (121)..(121): n is a, c, g, or t
  misc_feature (210)..(210): n is a, c, g, or t
ggagtacagtggtgcaatcatagctcactgcancctcaaactcctgngctcaagtgattcttccattcttccacctcagccaccatgcccagttaatttttaaattttttngtagagacgnggggtggggctcctgctgttgctgaggctggtcttgaactcctaggctcaggtgatccttccgcctctgtctcccaaatttgctggganttacaaggcatgaagtcaccca

SEQ ID NO: 691461 - DNA, 118 bp, Homo sapiens
aaagggctgggtcaaagtctccaagagatgagacttcggagagggtagaaatgctgtacccaccatcttgaaattcacactccaaggagtctttcaattgggtgttcggggataaata

SEQ ID NO: 691462 - DNA, 913 bp, Homo sapiens
gttttttcactgacccggtgaggcgggggggcaaaaaaaaaaaaaaaaaaaaaaaaaaatttttgggccgcttgctaaaaagttttaaccccttcgtttgggcccgggccccatgttacttgcagtgtcccaaggagaaacccgggggcagtgctatcgtcgctgggggtttcctacacaataaaaaaacgccgcggggggaaacccgaggcggtgtcttagaccaactccagagtgggaggtccagagggcagatacggggatccatactcaacaggggggcccacaggaagagagcgatttattaaatttatacgccccggcgctgggtcaaaaacagcagaaacagacaaccaaaataacgctacgcagtcacgagtatgaatccaatatacacttcaccaatatatattaaactattaccaaataataatcttacatacaaataaaaaaacacaaaataaatataaataaaattatcttaataatatatgtacaaaaattatagactaaaaatgactcactaaaccaaataaactataataataaagattacatactaaaaaaaacataaaataaaaaattaaacatagctaaatactacacactctaacacaaccaacataaccaacacaaccaaaagaggtcgagagcagaagacaaacgcaagagcagtaggacacagacacagacagacggcgtcaggagaacacggacaacggtgagacctatcagacccacgcggtacacgacgatcgaataaacgagagcagatacgataacaaaggcaccaagcgaacgacggatacgcgtaacagacaacaaacgagagaaagaagaagcagcacagtcagagaaggaaacgaaagacagaacagccgagtcacatacagagcgcgtgcatcagtcggtt

SEQ ID NO: 691463 - DNA, 81 bp, Homo sapiens
  misc_feature (80)..(80): n is a, c, g, or t
gatctcattccatgggaaaaaaaaaaaccctgtctggtcaaaaaattgcaattgcaattaattggaaaaagggtacactnt

SEQ ID NO: 691464 - DNA, 947 bp, Homo sapiens
  misc_feature (1)..(1): n is a, c, g, or t
  misc_feature (92)..(92): n is a, c, g, or t
  misc_feature (94)..(94): n is a, c, g, or t
  misc_feature (96)..(96): n is a, c, g, or t
  misc_feature (103)..(103): n is a, c, g, or t
  misc_feature (105)..(105): n is a, c, g, or t
  misc_feature (127)..(127): n is a, c, g, or t
  misc_feature (156)..(156): n is a, c, g, or t
  misc_feature (193)..(193): n is a, c, g, or t
  misc_feature (195)..(195): n is a, c, g, or t
  misc_feature (216)..(216): n is a, c, g, or t
  misc_feature (219)..(219): n is a, c, g, or t
  misc_feature (223)..(223): n is a, c, g, or t
  misc_feature (228)..(228): n is a, c, g, or t
  misc_feature (255)..(255): n is a, c, g, or t
  misc_feature (296)..(296): n is a, c, g, or t
  misc_feature (487)..(487): n is a, c, g, or t
  misc_feature (494)..(494): n is a, c, g, or t
  misc_feature (506)..(506): n is a, c, g, or t
  misc_feature (548)..(548): n is a, c, g, or t
  misc_feature (585)..(585): n is a, c, g, or t
  misc_feature (707)..(707): n is a, c, g, or t
  misc_feature (711)..(711): n is a, c, g, or t
  misc_feature (718)..(720): n is a, c, g, or t
  misc_feature (723)..(723): n is a, c, g, or t
  misc_feature (752)..(752): n is a, c, g, or t
  misc_feature (755)..(755): n is a, c, g, or t
  misc_feature (770)..(770): n is a, c, g, or t
  misc_feature (773)..(773): n is a, c, g, or t
  misc_feature (779)..(779): n is a, c, g, or t
  misc_feature (781)..(781): n is a, c, g, or t
nggcagggggacccacggcaaagcaggcggcagttaccccaccagtcaacccccgcgggagtcataattccctccatagccaacactgtggngngngcctccngngccgcgctccacgcaaagtccncgtggcggcggaccggggcgcacctccgncactgcggctggggcggtgcggggcggggggggaggngnggacggctggcaccgctactntgncggnagtcnctggcgaccaaaccctccactaaatcngctcttagagacgtccacgactgcgacccttgtagtggtgntcataagccatgttttctaaccaagacggcacttcttgtttagcttcaacaagaagatccaacaaatccttagtaatatttatgttcctctcgttaaagaatgaggtggccaggccaaggtttcctacacgtcccgtacgaccaatacgatgtacatattcttcaatatcacttggcaagtcaaaattganaacatgnttcacatttganatgtccagtcctcttgctgctactgctgtagccactaaaatngggctttttcctgagcggaacgggtgaagggcctctnctctatccctctgagaacgggctccatggatgcgggtacatgcgtatccttcatggtataagaaatcctccagagaatctgcaccctttttggtctccacaaacactaaggtcagtgaattnttgnctgttgnnnttnggaggtcaagcagaaatgaccgtttgtcngantcttccacccaaacnacnttccgngngatgttttcagaggtagagccaactcttcctacagccaagaagatatattcatctaagaaatcacgagccagcatctgtatttccttaggaaaagtagcactaaacatcatagtgtggcggacaccctttggaggcatagtatcttgttcgactattctacgaatc

SEQ ID NO: 691465 - DNA, 303 bp, Homo sapiens
tcccaggatgagaaagttgggaatgggaaggatcatattttacattaaaaaattatggaataagcacatgaaaagatgctcaacatcactagtcattagagaagtgcaaatcaaaacaacagtgagatgccaaatcacaccagctaggatggctgtaataaaaagacagtgacgagtgctggcaaggatgtggagaaactgggaccctcacaggttactggtgggaatgtaaaatggcacaggtaattaaaacaacctggcagttcctcaaaaagttagagttaccatatcacccagcaattc

SEQ ID NO: 691466 - DNA, 1035 bp, Homo sapiens
aaggctggggagtctactaagaaattccttccctataaaactgacagtccaatctagccatgcctgatacgagtatagacgcgaacgatgatattaactagcctctgagtactgactcttggcccacaggtagggctgtctaaggaaacagttgccttgggagcctactatacatagagaaagaagaattctggtcctgccgaggcttgagataagtagtataacagacgggccctagccatcgttggtgtggaataggacagccctgataattgaaccactaagagagcatgaggctccacgactacagactgcacgcccaaggctcgattatctcgtcaaaaggaggatctagacgaaatggccttcacgagtgaatgaaaaatggtcaacctccattgcgaaacaacaacgacgtttcagattacagggccccgcagtgtaacaaggtgcccaaactgtacttattcggcaatataagctggcgcttctccgcggcataggattcacctgccacaggtgaacactgacaggagccaccgaatgcaataccccgggtgaattttcctatacacaactccacaaaccacacgggagagccaagccccgccttctgacacacgcatcggcgtgcacctggcgacaaaaatcgcccagccacggaacattctgctgcacaacgtgggagaccatcatctacctgtgaaccccccgctacccgggtacagacaactcgcctcaaccatcatacccactctttgcgaaacatcgggacccctaggcacaatcaaagcctgcttcacacgctgggacacaaagggcagagccaaccgagataagaacgggacaacacgcggggaagggattcgaaataaccaagagagaaaagagcgatcacacagtaaagaacgagaacaaaaccagaacaggaccaacacagcgacggcaacagtaagagccagaacccacaaacatggacccccagagccgaaggagaaagccgccacacgacaccaagaaagaagaaaacaaaca

SEQ ID NO: 691467 - DNA, 324 bp, Homo sapiens
tcgagatggaatttctcactgtcacctaggctggagtgcaatggcgcactctcagctcactgcaacctccccctcccaggttcaagcgattctcctgtctcagcccccaaagtgagtagctgggattacaggcatgcaccatcacacctggctaatttttgtatttttataagaggtggggtttgaccatgttggccaggctgatctggaactcctgacctcaggtgatccacccaccttggcttccgaaagtgctgagattacatgtgtgagctactgcgttccggccaacactcttcttaagcaagcttaagcagccttgtc

SEQ ID NO: 691468 - DNA, 345 bp, Homo sapiens
  misc_feature (251)..(252): n is a, c, g, or t
  misc_feature (256)..(256): n is a, c, g, or t
  misc_feature (270)..(271): n is a, c, g, or t
  misc_feature (276)..(276): n is a, c, g, or t
  misc_feature (307)..(307): n is a, c, g, or t
agataggagggtgttaatctttatgtgaaaaatcttgatgatggtattgatgatgaacgtttccggaaagagttttctcaatctggtacaatcattagtgcaaagggttatgatggagggtggtcagcagcaaagggtttggttttgtatgtttctcctccgcagaagaagacagtaaagcagtgacagaaatgaacggtaaattgtggccacaaagccattgtatgtagctttagctcagcgcaaagaanngcgncaggctcacctcanntaacncagtatatgcagagaatggcaagtacgagcngttcccaatccacgtaatcaacacctccttcgagcggg

SEQ ID NO: 691469 - DNA, 1013 bp, Homo sapiens
  misc_feature (721)..(721): n is a, c, g, or t
atgaatgagattgttacacaaattgatgcacaaaataatgctggaaaaatctgaggctggcttagtcaggagctccagtccgtgctgtatcacgcgtgtacaagaactatgaaatcttcctgagatcccaagaaatacttaacattggtgacatcagtataaaagtgccaaactctgccctctttgaaataaaaatgttaataaggccactcccaggtgaaaatccagggtgcgaacgagtcatctaagtttgaccatgcagttgtttaccaaaaattagaggcacggagagtcttacctttggctcttggatttaagtcgaggtactgtatagaaggtagtgtagaatcatgtatgaaagttcaatgtttgctggttcttgactgagtgataatcaagagataggttgagtatgttcgctatgtgatttgaggaaggcatttttgtgaagcctggattctttggtgccctagctgtacggcattgacctgtcactgttcctagcgcgattcaataccgtgagcttttgacaaagtcgttggcgagtatcattactcctatactgtctgtacaacccttacaccatgtaggcgggtaccggagatggtatcacgaagtgtcaggcattccttatgtcgccatgttctggctaaatattgatcaccaacagattcggtgcaatcttagggacaaatgcgcaaagcttcgtggatcctacgcnttttccacaacgcacctttttgcatgggacatattgttaaataccttcgttcacagagttttcaaccaatccacactgctacccccagggaggtaaaaagctgagggactggttggctaacgtaaattcccatttggccaaaaaaaacgcaaaacacacgcgatttatttacaccaaacggcgcattttgaatgtcggccccccattttctgggctccgctccataagaaaatcgcggattcattcaacctcgcgaatggggtcccggggcacgagaacgagcgtcccacag

SEQ ID NO: 691470 - DNA, 183 bp, Homo sapiens
ggctgggtgcaggagcacgtgggtgctccacccctcagaatctccggctgacgctgggggacagggggctctggggatggggttctcaaggatgggaggacggtgaagagatgacatactcgataaaaaaccgcctgggttttccgtcctgacaagatcatccaggatagttggagctagagc

SEQ ID NO: 691471 - DNA, 448 bp, Homo sapiens
tagaggatccccgctacccaggcgcacttctcactgttctccatgttctcactttaggatagttctcttgacaaaacctattaggcaaaagtcttattctctccatttgacagggtcacaagactaaggctcaaagaggtttgaaacttgcttacagtcagcaagtagccagtataaagccaagttaggacccacaccttagtccaggatccaaactcttaccagccttccataccacagaagcagcgttgtttctggtgtatgattaccctctgtagactctgtttcaggtcccatgtgattaccatcagaagtgcgcctgggtgccacccaggcgcacttctgtgccctggcgcacttctgcgccccggcgcacttctgcacccatgcgcacttctgcaccctggcgcacttctgctcaataaggcggtcactctcacagccactc

SEQ ID NO: 691472 - DNA, 149 bp, Homo sapiens
  misc_feature (9)..(9): n is a, c, g, or t
ccgtacagnttcgatcaggaccgatctcccgcgcggagttatcccgacggacccatctatccaaagccagcatcaccagcctggccgccgagctggcggcgagggggctcgtgcgcgagggaagcccggaccgcaactggtacggcggg

SEQ ID NO: 691473 - DNA, 459 bp, Homo sapiens
ctttcaccagacgatatggcaatatacaatatattgcttgagctgtttgagaaggctgtgatgtatttttgtattgacatagaaaattataaattacattgaattagtatccataatcactatatatatacacaaaccagttctaaaaaaatacactggtttaaatttatgagtgaaaacctcacaaggtacagtaaacaattagcatgcttcggtgccagattttgatttcaaaataaaaaattctagcctgtccaatgaacgcaccccaattccattagcagcacgagcattttcaactgacttgcctaataggatttattttaggtctgttaaatatgcagattgcaatttatttattaattgtttctccttgttaacaaggtcaatattggtgactcagttaaaagaaaaatgacccaccaaatgaaacaaaaaaacgaacaaataaaaaagcca

SEQ ID NO: 691474 - DNA, 375 bp, Homo sapiens
aagacaagaaaagcccaacaaaggtcggctctccctagtcaaaggactaagaaaagagcaacttggtaagtaagacaatattcagacaataactgtattactctacacacacaggcaggaaagccacagaccacatttccgccacatttccgccgcatgaagtgaaaggttggaggggtgagcctgtaccttcctggccttggtcaggctataatgaggcaaccccaaacccaatggggtggtttccttgggcattccttttgccttattatcccagattagtagctggagaagaagcgacccaaaaatgccagtgggcaaagacaagaaaagctccaacaaaggtcgggctctcccctttttcaaaagaaaacc

SEQ ID NO: 691475 - DNA, 1357 bp, Homo sapiens
  misc_feature (67)..(67): n is a, c, g, or t
  misc_feature (217)..(217): n is a, c, g, or t
  misc_feature (220)..(220): n is a, c, g, or t
  misc_feature (277)..(277): n is a, c, g, or t
  misc_feature (371)..(371): n is a, c, g, or t
  misc_feature (407)..(407): n is a, c, g, or t
  misc_feature (445)..(445): n is a, c, g, or t
  misc_feature (486)..(486): n is a, c, g, or t
  misc_feature (513)..(513): n is a, c, g, or t
  misc_feature (539)..(539): n is a, c, g, or t
  misc_feature (590)..(590): n is a, c, g, or t
  misc_feature (595)..(596): n is a, c, g, or t
  misc_feature (605)..(605): n is a, c, g, or t
  misc_feature (658)..(658): n is a, c, g, or t
  misc_feature (688)..(688): n is a, c, g, or t
  misc_feature (728)..(728): n is a, c, g, or t
  misc_feature (746)..(746): n is a, c, g, or t
  misc_feature (755)..(755): n is a, c, g, or t
  misc_feature (925)..(925): n is a, c, g, or t
  misc_feature (936)..(936): n is a, c, g, or t
  misc_feature (1073)..(1073): n is a, c, g, or t
ggctgaattatcccgccccgggcccgcggttccctccccttgtgctccggagagaattcttcccggncgtgggctaaaacacaagagacacgaggggacccacattagccgcagagaggaaaatgtctatcctgagaacaaagagggccggacgaacgcgcgcgccaacgtgaaagtgtctccccatagggagctagtaacaaagccgcggaggggnaanaaatgccgcgcgcccccgcgaaaaaactgtagtgtggtgtgtctcttctctcctggngaaaaccgcgcgcgccctccgttgcggcacatgcgttgtaaacaccaatgaagaagcccctcggggccgagataaactcatcctgtagacaatnacgagacagatacacaggatggttcgtaacccaccnaaagagaggtaatccgaaatgtcgcggtcgcccttggnggataagagaagatgatcctcctcaaccgagatcagtcccnctctccgcggatagcctacacaaactngagtgtgatcctatctcatcaaaaanaaaaaggagggccggtgaccgaaaattgtgccttcctcaccccaggggtanagacnncaccggganagccatgggaggtccaactaggccctctatgaatccccccacgtctctgtctngaataccggtgagggtgggtacagaagaanacgaaacgtacctcggtcccgaccgcctcttcgccaccanaaatatttcggagttgtnttctaaacnacgaaaggatgaaaacggatcccggcgagcagccccgaattgtgaataataccctccggttgtcaacccaccgacagtagggatagtgatgacatattactatcggggaaaagaccacaatagcttggggctcgtgcctcgcaggcctaatactctatagtgtatgaganaatcccagcanagacaacaggtttcacaggaagataatcgagtgttctgtcagtaacaccgggcgtatatgtaaatcaaaagtaacacgacaacaatacctgtatgcgggggcagcctttgtataggtgcaatatcccccttgggttnacaacaggactcgttgtctgttgttcggatgtgttaacacacacgtcactaccacgcacccatggctcacaaaacattatgctttgtcaccacgtgcgcttgtgcttcacacccacacccccgcgcacatgtcaaagattgtctagccggaacgatccccacccaaaaggagcgaataagagctgtgataggcacaaattggaagtcttgcagaatcttattacagacattagttttctccaaagcaacacaacaaacggggaacgcggtcccccaacatacac

SEQ ID NO: 691476 - DNA, 1582 bp, Homo sapiens
gcttcgtacgagagtgatagccatcataatcggaggcttggggaacccttctagggtaaggaccaggatgtaggaggattcactcgttcacagacgcaagctattggtgaatgaatgtacgtacgatagtcaagtagcccatccataagtcggcaggcctctagggcaacatgagcgtagattccccgtagtaatcggctgccccgcgcagtatggccgtctgtcgccgacatataacgaacgataagctttggtgacctgcttacctcccatcgtctccgtactgcctgccgcgcgagtcgtgtctctagctgggaggcccggagcccaggcacacgagggtcggaaccacctcctgacccctcacgctgtagccagcgggaaacctgacaagagaagagacacaccccacaacaaacagaaacacaagaagccaatacaaacaaacagcgaacccacaacagacacccacaacacaaaaaagaagagccaaggcagaacccgacgggaacccgggcggcgcgagcggggaatgaagacacagacgcggaacccgacagcacgtacgagcacataaacgtcacaaaagccgaaggcggaacctacagggcaacacgctacggcgcccctcccggaccaaccacaagctcgtcagaaaaacagaacgcacgccaataagccaaacctacatggcctgtggacgaccacggcgacagacaaccgacccatacaactacacccgaggcgcgggcaaccaacatcccaccccacaacattaaagacccctccagccaccaaccccgggaccaccgccggcctggcacattaccccaccgcctatagacacacccaggcccccgcggcgcactcccctacagtccgaacgcgccgcgccgacacacggcaccgcaaaatcgtcacacatacccacagccccaccggacccaccgaccacaccacacgtaccgcacacgagaacacccagcacccacacacaccacagccctaacagggaaccggaaaggacacatcaacagcgaatcacccaaccggaggcgactgagcacaccacccaaaggacaaacgaacaacaagcaagatacgacagacacccaacgcgaagtgaaaacactacaaagaggctacagacacacgataacgagacgaaaaaacacagcagcgaagctaagaaggcaacacaaaagaaccccggcaaacacacactaccaccagggagagcaaaaagacatacaaagacaagggcagagacgaggacaacgcaacacagaaaccaaacagaagaccagaccaccacgcacccgggccctcgcgagcatcgcgcacacacgaccacacgcgcgacacaaaaacagcacaataaaagcaccaccaagaccagacacaccagggagcgcacagcacgaccacgaacgagcagagcgacgccacccccgcagcaaacaacacgaccgcccaagcaccgcccacacactcgcccagacccacgcagacaaacaagagaccgacaacaaaaccccaacccgtagaacaggacccccgacggagagtaggacgacgagac

SEQ ID NO: 691477 - DNA, 96 bp, Homo sapiens
ttcccccagaagatcaatggaaggtggattccaaagagtgggcaagtgaggaccccttctctgttaccaaggtgaccccaaggaacacagtaaatg

SEQ ID NO: 691478 - DNA, 725 bp, Homo sapiens
ggcctgctggagctcagtgcggcgtggcgcggctgggatgtgcgaagatgcaacggagagaatggtgcctgtgctgctgccctgcggcctggggaaatgcctgtcgggaacccgggatgagcctggcccagtggcccccgactgcctgtcaaccgacctggactgaacctcatgcgtctcgtcgtgtgtcgttgacctctgtgagtgcctaactgtgctttcggcctgatgcggcctgctatctgacaacgttcgtgcttccatcgttggtgctcgcaagtggcggccgatgggcgcgctggagtgaatgtaccctctgtgatgggtgcttgatgtgccagagtggagtccaacgtgtgctggacattgctcaacaactgggacaaatggactggccaagaagcacaaaaagattcgtctgcggtgccaaaatgggcatccctgcttctctgcgtgggcctgtgcttggcagtacctgtcaggaggcaaggtgaagttacatgcagaaccctggaaagtttgacgagcttggacatgtcccctggggaccccaagtggctggacgtgcattgagcgtgacctgcaccgtgcatgtcccattccatgagatgtttgtgtcccgggggggccacggtcagcagtgacttatttcctgtgtgctgacaggcctacacgctggtacctgtgcctgacgaggtgctacttggctaggcccagtgcgccca

SEQ ID NO: 691479 - DNA, 453 bp, Homo sapiens
  misc_feature (27)..(27): n is a, c, g, or t
  misc_feature (44)..(44): n is a, c, g, or t
  misc_feature (453)..(453): n is a, c, g, or t
gccccttaaaaaagttgtgacctagangccaattaaaaaataanggggaaatgtggtaggtttttaaatttgtacatccctcttatttaagtgttacccacataaatgatgaagtttgtgtggttcctgttttcccatttttgttcctaactgaaaactttttggctgggcacggtgccctcatgccctgtaatccccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaggan

SEQ ID NO: 691480 - DNA, 225 bp, Homo sapiens
  misc_feature (19)..(19): n is a, c, g, or t
  misc_feature (88)..(88): n is a, c, g, or t
  misc_feature (108)..(108): n is a, c, g, or t
  misc_feature (139)..(139): n is a, c, g, or t
  misc_feature (165)..(165): n is a, c, g, or t
  misc_feature (219)..(219): n is a, c, g, or t
ttttttttgaaggtcgganagcatctttattgtggggagggagaacatcaggaaaaatagctaatgcatgccgggcttaatacctaantgatgggttgataggtgcancaaaccaccatggtacacgtttacctatgtnacaaacctgcacatcctgcacatgtnctctggaacttaaataaatttttttttaaaaaaagaaatgcagatggatagganaatgat

SEQ ID NO: 691481 - DNA, 442 bp, Homo sapiens
ctgcaggtcgtgtggagtttgctggatggtccactccagaccctgtttgtctgggtatcaccagcggaggctgcagaacagcacatattgcacaacagcaaatattgctgcctgatccttcctctggaagcttcgtcccaaaaggggacccgcctatatgaggtgtctgctggcccctactgtgaggtgtctcccagttaggctacatgggggtcagggcacccacttgagggggcaatctgtccgttttcagagctcaaacaccatgctgggagaaccactgctctcttcagagctgtcagacagggatgtttaagtctgccgaagttgtctgctgccttttgtgcagctaagtcctgcccacggagatggagtgtagaggcagtagggcttgcttgagctgcggtgggctctgccaggtcgcacttccaggccactttgt

SEQ ID NO: 691482 - DNA, 573 bp, Homo sapiens
ggccctccgccgagcgatcctggcaccgtggccttggggtccaccagatgtatggcttttcctgttgagtactcgttttcggtgccccagcgcgtttcgcgcgccctggcaccttgccccttgtgggcatcagacactaggtgttccctgttgagctcgcgtcgcggcccagtggcctgctgcgctgcacctgacctctcagggcatcagagttgatttcctgtgagcttggtcggggcccatccgcctgccgccatgcacctgcctccgtgggcaccagagtaaggtttcctgtgagctggtcggggccatggacttgccaacctgggacacctggacccaataggggacaacagatgtaggtttcctgtagagttaggctccgggccacacggctgccgcctgcactgccctggggcacagactaggtttcatgtgagctggtcggggccatggctgctgccaggcacctgcctggggcacagagtaggtttcgtgttgccttggaacattaaggcgtaattttgattcagtttttcctaaagaagcattttgcatttttatggcttttgc

SEQ ID NO: 691483 - DNA, 270 bp, Homo sapiens
acaaaggtaattacttttctttttacacttatccacatgtgaacttactggaaagagacaaaacaagtctaaagaagaaattttcataggcttcttgttcagtagcacaggccaaagccttagtcgtcgtcttgcagggtccttataaatgtgtaagaccagacagcatatactattgagtcctacagagaaacacacagcaagcaatacattgctcgggagtgacactatcacctactcttacgactactggtactccaagtcccctaa

SEQ ID NO: 691484 - DNA, 358 bp, Homo sapiens
  misc_feature (131)..(131): n is a, c, g, or t
  misc_feature (209)..(209): n is a, c, g, or t
  misc_feature (272)..(272): n is a, c, g, or t
  misc_feature (325)..(325): n is a, c, g, or t
ggttatccaattgttggaatataatttttcatagcattgtcttatgatcctttgtatttctgtggcattagttgtaatgccttctttttaatttgtaattttattttagagacagagtcttgctccatcanccaggctggagtgcagtggtgtgatctcagctcactgcatcctctgcctcccaagttcaagtgtttcttctgcctcancctcccaagtagctgggattacaggtgcacaccatcacacctggctgatttttttgtattttnagcagcctgaccaacatggaggaaaccctgtctctactaagaatacaaaattngccgggcgtggtggtgcatgcctgtaatcccag

SEQ ID NO: 691485 - DNA, 377 bp, Homo sapiens
tcgacgtcgcagtggacagttcatgcgcaagtgtgtcttacgagatcgctacttcccctatcatagaagagcttatcacactttcatgatcacactctctcatcatcattttccttatctgcttcctaatcctggatgcctcatgaccttgcagtcagtagcataactagctaatactacctttttatcacgcaccggaaatataaaccgactgaactatcctagcccgccgatctatcctagatctctcatcgtccctcccattctctactcgtcctttacataacatacgaagtctacgatccctcccttaccatcagatcaattggccaccaatggtactgaacctacgagtacaccgactacggcggattcgg

SEQ ID NO: 691486 - DNA, 176 bp, Homo sapiens
ccgggcttatactgaggtcgggtgggttcgaatcagtatggggacatttacaaacagggtctcagctgacacttccatcagcagtcccactcgctgcaggttcagcaggcctggcggctgggccagaccatcctccttgtggcgtggggcatgccaagctcgcttggctctcatcc

SEQ ID NO: 691487 - DNA, 119 bp, Homo sapiens
taattccaagtgaagcagcacagtgctgagaaacagttcatccatggttgcatgttaaagaagttggaaatatatcttgaaaattctatcttccttttaggcttgaatatgatgctgaa

SEQ ID NO: 691488 - DNA, 94 bp, Homo sapiens
agtaatctccataaagaactaccatccgaagataagaatcatcactcaaatgctgcagtatcacaacaaggcccatctgctaaacatcccgagc

SEQ ID NO: 691489 - DNA, 333 bp, Homo sapiens
cttaaaagctcaacctgggcttggtgcggtggttcatacgtgtaatcccaggcctttgggaggccaaggtgggaggatcacttgagctcaggagttccagcccattccaaagcaaaaacaaaaggattttgagatcagtgtgggcaacttagcaaaacaccatctcttaaaaaaaaaaagaattagccaggctttggtggtgtaagcctgtagtcccagctacttgaaaggctgaggtgggaggattgtttgaacccaggaggttgaggctccagtgagctgtgattgtgcccctgcactccaggttgggtaatgcagcgagactgtgtctca

SEQ ID NO: 691490 - DNA, 756 bp, Homo sapiens
  misc_feature (309)..(309): n is a, c, g, or t
acgcctggcactcgtgggctgtgggtgtgtactgtgatgtttgtcgttgagggtcacgctgctgttactccgaatgtgtgtcgatggatgtgtgggctatcggctcccgatccctgggccggagcatgtcagtcctgtggggggagggcgtgctgacctagtgggaggacgccccagtgtgcatccgtgatgctgcctgccacgcgtccctctcccattgtatgcgatccaccctcttggaggtggtttggtgcagctctgaggttgtgtatcgtggcggtgttgctcttcctcgtatctccgatcgtncctgcttacttcacaaccagttcgttgggtcaggcgtgcggagaggtgttggaggtatgtgttcggcgttgggtagagggtcatcttgttccatcgtcgtcgtaagcgaatggtctgattagtcttgaacatggctctcccgatcccctttaccttgggcactatatacatccttacagctcttgtcactaaatatatagtaacaggtagcaagaggccagagtaataggaactatccatctaattgttcaaaaatagaagatatataagatatatatagagctttctagagtggcggcacctctataaatgcatcgggggagttatgggagcgacaaaaaaaggagtatgtgtaaaatcagaaagagtttggggcacgcgaatagggggttgcgattagacaccgtgatatctcccgttggaacaccaacaagggataattaaaag

SEQ ID NO: 691491 - DNA, 442 bp, Homo sapiens
tctgagcaagcgggaaatttaggtagagacaaccacgggggatgactattggagggcagggggggcgggggggagggagttctgtgcaaaccaaggggtatggctctcgcagggccaggccgggatcaacggcacatgaatggcagccgctacgccaggagccgactcagcatttcgcttcctctctggctcagtccaggatatgaggatatggcaaaatcaccctcggtctcacttttttttggggtcagttattactatttagtccggtagctatcggtttctctggcatgaatttttttctagatagcattcttccccaaaaaacttttttaaaaggtagtacccaaagatgaatccaataaggtaccatggactttatcggcaaattccaccacctcttaggagaatcccgggatgctcatctttcttcccagcggct

SEQ ID NO: 691492 - DNA, 325 bp, Homo sapiens
gctgtcagagttcacatgcccacttagaaaaatctaatatgggcagggcgtggtgtctcaagcctgtaatcccagcactttggaaagccaagatgggcagatcactttgaggcaggtgttcaagaccagcctggctaacatggcgaaaccccgtctctactaaaaaaataccaaaattagcgggtgtggtggtgcatgcctataatcccagctacttgggaggctgaggcatgagcattgcttgaacccaggaggtggagattgtagtgagccaagatcatgccaccgcactccagtctgagtgaccgagcaagactctgtctca

SEQ ID NO: 691493 - DNA, 847 bp, Homo sapiens
  misc_feature (9)..(9): n is a, c, g, or t
acccctccntatgatataataatattaacatataaaaaataaaaaaaaaaaatataataattgttctcattactcgtgtatttatagattgataaatttttgatattccaccttccctctttagggaccctcaactggggttacccaaaaggtttcctgtatataatgtgaatgataaagctttgtctttaagccacgtttccttctacaaaccgcttattcttttggtaagaaatacttgggcttcctttatcgcccaaaacattttcaatcataaaatccccttttttcgtaaagacaagacccatattttggtataaaacacattcgggcccctacacacattcacaccttctttagcaaaatcaaagtggtttaaaacacacgtgtaattacatttggccccctttaacaatatgtttccccgtggttccctgcgataattcaaacaggagggtgttctccccccgaaatttggctcataatctttctcctagttgacaatagcttttacaaaagtaccctttattccaggagaacacaacacggagccctccctgatatgtcaccaccccaacacttgtactcttctcgttatgttccattaaaccaaatccatctaattgtgatattctcccgatacttagaaaatttgagtttacacaatctttcccataagagcacaagcttatcaacacacgtgggccctccaccataactagtcgcacaattctgtgtctcacacacactcacaccaacttgcataaaataaatacttcttctccaaaagcagtgggttcttttttccccctaaaaaaaaataaacccttccctcccccaaataaca

SEQ ID NO: 691494 - DNA, 125 bp, Homo sapiens
  misc_feature (22)..(22): n is a, c, g, or t
gtgtagatgcactatattattngccttcttctccccctctccttgcctctgcattagacaggccaatatttgtcctacaaaatttcctctggtctctttaaaaatcagttatgtcgagcatgtag

SEQ ID NO: 691495 - DNA, 387 bp, Homo sapiens
aggtgggtggatggcttgagcccaggagttcgggaccagcttgggccagatggtgaaaccacatctctgtttatttttttaattttctgtttattaaatttttaaaattaaaaaaagaaagaaactggctcaaatataataggggaaaaagttaagagagagcagtcacagctttgcaggagcatgtagtgcatgttatttatatgttaggatgctgttaagaaacagcttttcatttgaagatcatatgtttgattcttttctgtaagttcaaatgagggaacccttatttcttcccattttgttcatcacactcctgaagtcagtgtctagacctgagattagaacaaagaggccttttcactcctgtgcactactcactactca

SEQ ID NO: 691496 - DNA, 166 bp, Homo sapiens
ggggaagatcacgaggtcaggagttcgagaccagcctgaccaacatggtgaaatcccgtctctactaaaaatacaaaaattagctgggcccccagggaatctgaacggaagagaccagaagtctatggcaattgctcatgaagagatgagggtctggccaaggggc

SEQ ID NO: 691497 - DNA, 290 bp, Homo sapiens
gaattcttggatgagaaacctgatatcttccatgagagataactaaacagccataggacagtacagaacaaatgtgggcaaaagtcaaatctacaaatgatgaactcttccctttatatccaacccaatagtcatcataaagaagtctgaatatcttggttgagagctagactttggaaacagagagaccctgtataataacagactaaggaagtaaggaagacaagcccagccagtcccacaactatttcattaataccagggtaaagcaacagacctgccagtgaagg

SEQ ID NO: 691498 - DNA, 208 bp, Homo sapiens
tgaggatccctaaagccaaggagattcaggaagaggacaaattgacaagaagtataaagcgtgaggaagtataaagcgttgaggaagtataaagcgtgagaagtataaagcgttgaggaagtatagggcgttagggcgtatagggcgtatagggcgtcgagagggttgaggcggtgaggagggttgaggcggtgtaaagcgtagagcg

SEQ ID NO: 691499 - DNA, 125 bp, Homo sapiens
ctcatgagggcgtacagcatctataagaataggtcagctatctctagcagttataactctttccatagaataactttttctaagcaccttaaatcacatgaatatatctgccttacataaatttg

SEQ ID NO: 691500 - DNA, 438 bp, Homo sapiens
taatacatgacagtgtgatgagtcatgactcccgtcctagacagattcccagagcacctgcagatcattcagatcgcacgtatctctagtgaggggattggtgattatccaggaacaacctacaggactgcatctgagttcgtatgggccggaaaacatctgcgtgacagagaggcaacgtagtcgcaaaggaaggggcaaggaagactggcaaaacagatggcaagggatgcccctctttttcataaaactctccaaggttcaactcaatgcaatgtatagtgacacttcaactcgatctttcatttagacaactattaaacaatccagagaagtaaacactgttacattgactgtatatatttgcttcttaaaactacctgtatcactgtttgctcacctaatttatatcccggtagttccattatctcccagttc

SEQ ID NO: 691501 - DNA, 166 bp, Homo sapiens
  misc_feature (150)..(151): n is a, c, g, or t
taggtgctcgtgatgtcggtcggagcttcagactaggcgaggcagggtgaggcctcgggcacacagccggctgccagtcacccggcccagatggagggcggccgggcctgcgcaggcacttgccaaggtggctacacacgtcaacgcacnnactcgcaccgaggac

SEQ ID NO: 691502 - DNA, 1471 bp, Homo sapiens
  misc_feature (2)..(2): n is a, c, g, or t
gntggttgaccgtttgttgcgcctgcgtgtgggcgcgcccctgcgtttgtgtgttgcgtctttagattgtgtcgtgcggggtgctgcgctgtgccccttgtcgttgtgtcgttgtgcggcgcgggcgggtgtgttgtctgtttctctgtcgtcgcgcgggggtgttctgctttgtgcgtcggttcgttggttgtgtgggggtgcggccagttgtggtctggacgtcgttctgtgtgttggtgcatgcaggcgtcggggtgttgttgttgtttcgttgtcgtcgtgtgttccgcgcggtgggtgtggttgtggtgcctgccgcgccgccggtcgcgctgtgtggtgtgttgtttcttgccgcgcgtgcgtggcttggggatcgacccgcagctcgggtttggttgcttgctccggcggtgagttgtgtgtgtttgtgtatctgtcgtgcgccttcgtgggttgagttgttgttttctgtggggctgggtggttgtggtgtgtgtgtgttcgtgggcctgcgccgcgctggtcggcgttgtggttgtgttcgtaggtgtgttgtgtgttggcgtgcggtgccgtgctcgcgtctttgtattgtgttctgtggctgggcgtgtctcgtctctctctggcgcgtgggcttggttgttttggtgtgtggctgctcgccgtcgcgtgagaggtgtggtgtgttggtgtcgggggttcccgcgactccgcggtctcgttgtgtggcggtgggtggttgtggggggcgcgtcatctctcttctcgtttctcgtggcgtggttagcggttactgcgtcctctttctgttttttgtcgggttgctgttgactctttctctcttggtggtgtgtgtgggctggtgtgtgttgctggctggcgcggcccgcgctcccccccgtctctcgtgtttgtttccctcgccgcgtgcgcgctgtgccgctgcgcgcgcctcgcggcggcgttcgtgtgttgttgtctttctttttttttctgtatgggagcgggcgcgcgtcacgcacacctctctcgctctcggtgcttcgtctgtccgtctgtgtgtggcttttcttcgcgcgtcgtggttgtgtcgcccccccgcccgccgcgccgccgccgcgcgcttcctttcctattattcttctttattgatttttctctctcctcccgccgcccgcgcgcgcgcgcgctcgttgctcgcgctttctgttttcttctcctccttgtgttagcacacaccacccgcccacaaatcttctttcctctctctctatgaatataatattatatttgtttttttctttctctccttcttctcttcttttttatatataaagaaaacacacccaccctcttttttttttttttttctttgttgttgagacccatcccgcccccccccccttctctctttttgtgtaggaaaaaaaaaaaagaagtctctccttctcccccatccata

SEQ ID NO: 691503 - DNA, 1565 bp, Homo sapiens
cgccctcttcttgtctccgtgtcgctgctctagcttgtcgtcgtgtctctttgtcgcgtgcgtgtgcgtgtttgttctcgtgctgtttctcttgcttcttctcgtggcgcttggttggggcggttgtcttgttcggtggccctagtgtctggtcggcctggtgtggtgtgtcgtggtggtggtgggtgttcgcggggctgcgcggtcggggtggggtcggggcgctggggccgtcatgcagccgtggtgggagagcagcggggtggaatccaaggctcgtggggcgcagggtcagcgcgtggcggggtcatgtgtctgtctggccgtgagttgttagcggtctgtgagtgtgcgtgtgcttggcggtccgacgtcgggccggggggtgactcttgccatcagtggcttttggtgcacaggggtggcgggtccgggtgttgcatggatgtctggcggcgtcgtgccgggccatcgtggctcattggtgtgcttgtgagtaggtcgtggctgccggccgttagggtggcatgcgttggcggtggtggggggccgcgtggcggtcttgtcagcggtgcgcgttctgtgttggtggtcggggtggtggcgggtggggtggcagcgggagtcccgttgtgcacctgcgcgcgcgctatgggctgggtatgctgtgggcgtctgcgatcgctcgggactgggaagtgtcagttgggtgggcggggggttgagtggggctacggggtgggtgtgtctgtggctgtagtggatgtccgcgggttgtatggtgtcggcgtggggtatgttgtggttggctctgggtcccgcgcgtagcgcatgggttgttgccatgagggactggtgttggacgcgttcgccatcgttgtgtcggccgtcggaggggggcttgtgcagggcggatcagcttggcggcctgcggtgtcatgtggtgtaggttgcgtagcatcgcgatggtgtgtgtggtatttgtggctgtgtcgttttgctgctcgtacggaggtcgcagggtggcgtgcggtggccgtccgcagtggatgttacttgtattgtgtcgttgtggctgtgtggaggcctcatcgcgcagtggaccgtgcgttgttgatgtgatctgggccagatggcatcagatggagttgtcatgtcctcgcgtccggggacagccgggtccgagcgagaggtcgtcgttggattgtccgagtaaccacgctggagtgacagtgtcggatatgatcgtggatcaaacccatgagatcgaataagagcggtgcgctacactgtgtgtctgaggctatggcactcgctggggacggtggctccggtgccttttccactgacggtgtgatagtaagtatataacctgattttgtaatatggtgataatgataaatatgctgggtagcctgtgtggaaagtctgaccgttttaagaagtggcatgtgccttgaaagggggcagtaatgttcagtcgttcgtgtttttaacatcagagtctctagaagaggtgcatgacatcccgtctgactgtccctgtgactcgctcagttgtatgt

SEQ ID NO: 691504 - DNA, 117 bp, Homo sapiens
gactagttctagatcgcgagcggccgcccttttttttttttcccagaagaacggggtctcgcaacattgcccagactttcctttgggtgttagttaataaagctttctcaacgtgcc

SEQ ID NO: 691505 - DNA, 283 bp, Homo sapiens
caggaattgagcataaaattataattttatctagtctaaattactatttcatgaagcaggtattattattaatcccattttatagattaacttgctcaaagtcacattgctgataagtggtagaggtagaattcagactcaagtagtttaactttagagcctgtcctcttaacaactatcctggttgaaaagcaaatacagcctcttcagacttctcagtgccttgatggccatttattctgtcaaatcatgagctaccctaaaagtaaaccagctagctctt

SEQ ID NO: 691506 - DNA, 365 bp, Homo sapiens
  misc_feature (30)..(30): n is a, c, g, or t
gacgaaggaaggaaggaaggaaggaagganggaaggaaattgattctcttccagttgaggggttcagaagtctgaaatcaaggtgtgggtggggctgccttccttctggaagccctggggaaaaaccattcttcatctcctccagctctgggtggtgatgggcagtcttggtgctccttggcttgtggcagcatcacaccaatctctggacccccaccccagctcaacccctgtggtcacattaccttctcttctgcgtcaaatcaccctcttagaaggacacttgggatacatttagggcccacctggatgatccaggatagtctctgcatctgaagatcgttaacttcatgacatctatgaag

SEQ ID NO: 691507 - DNA, 135 bp, Homo sapiens
tgtgcccaggtagtcgggttacagttttatacatttgagtggagacagaaggtccaggcgagagccataaatcaatacatgttatgtatacactgtgtttggcctggaaagggccggagatcttgaagaacacgt

SEQ ID NO: 691508 - DNA, 151 bp, Homo sapiens
tctctatctccatacccacctctgcttcaataagctatttgttgaagatctattatctcgattagattaagagaagaggcatagctgtctggaagcaatgagcaattaaaactagatggggaagtacaggtagatggggttgacctcagga

SEQ ID NO: 691509 - DNA, 327 bp, Homo sapiens
cggaccactcaggtcaagcattcttctgcctcagcctcccgagtagctgggattgtgggcatgcaccatcacacccggctaattttatgtatttttagtagagacagggtttcaccatgttggccaggctagtctcaaactcctgacctcagttgattcatctgcctcggcctcccaaaatgctgggattacaggcatgagccactgtgctccagctaagggcaaataattcatccagtgcaaacaatgcaagcaaaaatttccagaaactgcaaggcacatctcgtttctcacaattgcaacagtgctccagccacctattcaatg

SEQ ID NO: 691510 - DNA, 164 bp, Homo sapiens
agatggcacaggaggcaaagagcgtctacggtgagcgcttccccgatgagaacttcaaactgaagtcactacggtgtcctggctgttgtgagcatggccacacgcaggcgaccgacaccagacgtgctcccagattctttcatctatcgacagatcaacgacag

SEQ ID NO: 691511 - DNA, 1101 bp, Homo sapiens
gggaaagatggcgtccgcaaggaaggtaccggctctactgccacctcttccagctccaccgccggcgcagtgaggtaaaggcaaaggcaaaggcggctcgggagattcagccgtgaacgcaagtgcacgagtacgatggcctatgtggtacttcaccacgatacagtcaagacacttatcaacgaacgaacggaccacacggaacctgaacgttgttcacatggtacgtgcttcagggtctggcttgtacgaaccactcggcttcgaaatttaccagagcgtgctcttccgttgtccctccagtccgacacgagcagggatgcatgcttgcactcttgcagtgcacatggtccaatcatccagatggcaacgtcgcatgcggcagccttgtcgctcatgctaacccttgtgtatctatcgttcacgctgggcgtggtacttctaggtgcctatcatagcgtactgggcatcatttcggttgaacccaccgggagcagttccgtgtgcactcgtacaggtgttatgttacctcatgcatttggcccattgtcgacaacgaaattctcgtcagttgctccaatatgtagtaggatgcccagtagacaccaactgtcctcaaagggcatcatcttctcttaacctacatagtgcactaacgaagcaactggagcctccttaatcagcctgactgggcaagtccacgctcaagcaggaactaaggcactatgttacccaccttgacagacaaatgcgcaaacgaacaacgcacgaactcaatgtcagcacctttcttggactggtcaacaagtcgttcactggcctctgcgaaagggttggctccggccatctttaggttaatgtttcaaacacactctgtatctaagtcatattccttggaacttcctagcctggattcgccttcccagtaggtctcgctgcggaaatgcttacggacaaagcacgaagaacggttcgcatggcgcctcggttcatcgccacctcaaagtatatacccccatgttgggcaacacttcggtccatatccgcagccttctacgacaccaggaccacgactagaggtcaacataatccaggtgctga

SEQ ID NO: 691512 - DNA, 101 bp, Homo sapiens
  misc_feature (84)..(84): n is a, c, g, or t
gcccactccaccttaccaccagaacaaccttaggcaaaccatttacccaaataaaggtataggcgcatagaaagttggaacctnggcggcaatagatatag

SEQ ID NO: 691513 - DNA, 990 bp, Homo sapiens
  misc_feature (990)..(990): n is a, c, g, or t
gttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatagaaatgatagtggcagaggcacgccagaccgacgaccactgcacgtcacgaatcttcaaacctgcaagcacgtcggacaggtgtcctccatcccaagaagagaactcagtccatcacaaggcacacgcccccccggacgatcgggtccgccgtggcttacccctgtttaccccaggcgtgggcccgattggggggtgtcatggtcaacgcaactccaggcctgacacccaggttgggcctcagggtctcaagaccctggcctggtactcaggcagcaggagagcggattacagcatctcagggaatggcagcctctgctgcagcaagagctcttcttcctgtgccatggccggcgagaacctccggtattggccagattgaaggcagttgccctgtccaggctggacactcgaggcacggtgccttgggttggccatggaccatgcgtggttgggctggcgaatccccgttgggtcgcacgctctgggcaggccgttgcgccctggggcctgcttctccttccctgcgctgn

SEQ ID NO: 691514 - DNA, 141 bp, Homo sapiens
agactgcccccttgggagaaacacatgcacaggtaggagtaagatggactcaggacaccgaaagcagtaagcagtagaaacatcagatgacgatgcctggaagtaggcatataaatgctcacagtgtaaatctggacccag

SEQ ID NO: 691515 - DNA, 125 bp, Homo sapiens
tgactctagaggttactatttatcgcccaacaccacgccgttataatttttgtattttaggtagagacggggtttcaccatgttagccaggatggtctccatctcctgacctcgtgatccgcccg

SEQ ID NO: 691516 - DNA, 112 bp, Homo sapiens
ccttgatcattacgcaccaaaagcagccaggacgtacatactgaggagggtctgacttttctagacctgaccctagacctcttaagacgtgttttggcttcttatttcttac

SEQ ID NO: 691517 - DNA, 184 bp, Homo sapiens
tggggaaacaggattaaaaagaaatttttaattccttgccttttttttgagggctgaacagaactgcggggccaaatggaaagcttttttttaaaattcccttgcagaccttgatctttcgcagaaatgcaaagccccctgagttatacaacttgcattttttatttaatagacagaagtgcca

SEQ ID NO: 691518 - DNA, 275 bp, Homo sapiens
  misc_feature (24)..(24): n is a, c, g, or t
  misc_feature (34)..(34): n is a, c, g, or t
  misc_feature (131)..(131): n is a, c, g, or t
  misc_feature (178)..(178): n is a, c, g, or t
  misc_feature (238)..(238): n is a, c, g, or t
  misc_feature (241)..(241): n is a, c, g, or t
gggactttcccatgcagcctcatnaccataaatngttgcttcaactctagacagaatatggaatgaacctgtccatcaacacatgaatggataaagacagtgtagtatatacacacaatggaatactattnagccataaaacaggaggaaattatgtcattccaacaacatggatgancccagatggcattatgttaagtgaaataagcccggcacagaaaaacaaatactgcatganctnactcacatgtgatattttaaaaactcttaggaat

SEQ ID NO: 691519 - DNA, 100 bp, Homo sapiens
gtcagctgttacagatgaccccaagtgcgcaaaattaacccccgtaataaaattaattaaccacatcattcatcgacgctccccagtccaacatctccgc

SEQ ID NO: 691520 - DNA, 118 bp, Homo sapiens
gcatcacagttgccgcagcccgtgccgataatgccgttgtagcaggtcagggtctggttgcggatcaagtccagctggcggactatcaccaccagctggacttgatccgcaaccagac

SEQ ID NO: 691521 - DNA, 907 bp, Homo sapiens
  misc_feature (1)..(1): n is a, c, g, or t
ngcccggcggatgtggcgccgcggtgtcgcgctcggtcgggcgtgtggcgcgctgtgtgtttgtgtcaggccggctgtcgttcgtggtgcgggccggtgctgcttcgagcgcgggtggtggtgcggctgcgtgggttggcccgagcgtcgggcggcctgtgcttgggggttcgttcttgcgtgcgggtcctgtgcgtggaccttggcccactggggcctagttggaggtgggccgcccacgcggtgtagtcggggcccgacgtggggtcgatagaggcagtgggtcggagcgtgtgcgttgccgcccgacggctgttgggggcctttgtgagccgcttggcgacgcgctcccctccccgacgtggtggctgtgacatagttctgaggagtcgaccagcgcctgtgtgggttagtacacacagggggggtggggtgcccgcagccaggcacgggtaggcgaggggagtgacaagggagcggaatgagatatgtgttgttgtgggcggcgtccacgccacgtgccgtgtgtttgtccgaagcaccagagtgagaggcgcccccgccaccggctggtgggggccctcgccgcccgcgggcggtgcgtttttccgttgtcccacgcaggggtgggtcttcgtgcagtttcttgtcgccaccaactatcctgtgtccttacctacctaagtcgtccccaacacgttgatcttcttgtcacacaattctcacaccacccttgttatactcacactataaatttattagcagtccccgacaggagaagtctaaacaccccgtctcgggtctataacctctgtcgtcagcattaaaactacgcggaatgcccactatgtcgcacctctgaacactccacacgtttccaaaacggtttaaaacgcaaacatgaaca

SEQ ID NO: 691522 - DNA, 642 bp, Homo sapiens
  misc_feature (3)..(3): n is a, c, g, or t
  misc_feature (347)..(347): n is a, c, g, or t
gtnggatgttctttatttggagcaaacaggtgttcctgggaggaactgtcctcagatggctggagggggtgccattctttcacacacataaaaagttcctcttccctctgcccgcaggaaaattagaattaactacagctttttctttttgaatggaaaaagagaaataaaaatatggcaccaggttttggctctggctggatttccacagagcatgcaatctatgataagtgatgagaattcttgaagcaaagcatgcttgtagtttcaacattggagatgctataaaaagtagatgaacgcaaagaatctttttaccaaaagatgtacctataaaatcaaaaagnccttccctctgttattcatttgttcattcaccaaatatttctggagcagctgcgattccccaaacactgtgcttaggactagggatgagagtgaacatataacaagctctcgccttatagtagcttgcctgaggtagaaattgtaggaacatggaagtgaacctcggttggcttttgtagaacataagcagaaaggtgttgcttgacccacaaaggatggttttttcgcatattacccctatcacggaattgctcacttggtttatttgggaaaaatcttttaaaattttccttc

SEQ ID NO: 691523 - DNA, 285 bp, Homo sapiens
ttgatttgtcagcatctccctcaggactctgctggtctcttgcagagtgaatgagtggctcctgcctctcccatgggtcctttgggatctgagccctaggccaccgtctggctgcagtcctgaagctcctgggccctctactctcagctccttgggacagttctctgcctggcacacaaaagaccctcctgacaccagccgacctagacacaccccctccaaagatcccatcggagcccaacatcctgggagcatcacctaaaacccttccggtctcacgaattc

SEQ ID NO: 691524 - DNA, 174 bp, Homo sapiens
ctcgtaccgagacaggcgactctcgactcttcttggcttacttagctggggctgagcagcagcagacagtgtggtggagcagcacagggcagcagcacaaaggcgatggatcagcaagaaggcttgaccttttcagcaagtgggaaggtgtaatccgtctccacagacaaggcc

SEQ ID NO: 691525 - DNA, 111 bp, Homo sapiens
tagtcttagaggatccgatcacgtgcattgtgaggaaggttcagctgcacccacatgaaggctgcatgctgtgggctcatcgcctactcttcttcaccaacctggacgagg

SEQ ID NO: 691526 - DNA, 251 bp, Homo sapiens
ggacacgaggctggtcacgctgagccgccgctgcatcgccgatgcgtatgctggcggcctgtgcgcttcgatcaggtaccgcatgcgcctgcgcctctgctccagccttgtcttgaccgcactgcttgccgcctgcagcagtgcgccgccggccgtggacgtggcggcgcagaccggcactgcggccagccccgaagccgccgaggcctaccaggaggcacgcgaacgtcgactgccaggcggctcggtgg

SEQ ID NO: 691527 - DNA, 447 bp, Homo sapiens
cctggctagagggcagaggatcaggatgctctgattgaggaacgatttcagctctactgcaggatgtcgaaacagtggatgtctacccacatttgcccgtgttcctagaaagacaaatggagaaacagagcacttcacataaactgcctcatgtcctagcttttttctgtgttcaacacacattttgtcacctctgcacaatttgccccaacaatctagtgagggtacccctgcttaaacttgggtatctgggttttctgtcctaatataccactttgaatcaattctctgatgaacagtttcaagattatcttccatatgcagtacataataatgttccctaataatacctctcaagtaaaagaaacaagaaatacaaacagatttcattatgtttgaacaagtccactctgaagacttatgtaatttgggtatttttattattta

SEQ ID NO: 691528 - DNA, 777 bp, Homo sapiens
tggatcgagatctagagcctcagagatcccacgtggcgtgcgctgaaccccgtggcgtggatgtgacacagcagtaacgcccacttgcagactaccacctctacacagtgacatgcaacagcaagttaatcatggacctgctgggctggagacctagactggcgtgtgggcagttgagcgccattgtcggtgctgttgtggagtagttccgcctggcagggtccacgcgtacgtctgtgtgttccgctgctccgattctcatgggtctgcctgcctgtggctcctacgtgtccttcaagtgcttctggattgcctgggtagccatgtttgggtggagttggtcttgcaaggggcatgcaagagctcccaactggtgtgtcacgtgcgagtccattagccacgctcctgtatcgtgacctgacagggtgacacagcccctttcacactctgtgcctcctatcttcctgggtagatgccctggtgtagggctgagtactgaatggtcttccatccccagccacggggtgtgcagacccaggatcaggcccttcagaagccacggcagagggacgcacggtggctagagaccgctgcactatccttttcagagcacttcatccacttgctcctccctctaccctcggacaccctggagtgggacaggggttgatgcttatcatttattgacagggacagcactcactaacggagtccagacctacacagggggtgggggacattccctcccccacccacgaacgacgtccgcacttggct

SEQ ID NO: 691529 - DNA, 221 bp, Homo sapiens
  misc_feature (98)..(98): n is a, c, g, or t
  misc_feature (100)..(100): n is a, c, g, or t
ctctaccttgaggacgaatgtgttatccttctctggcatttccaggggcatggtggtgcggacctcaatgatggctgacagtgggatgctgaccttgngnctggaggctttgggcggcacgaagaactccaggcggaagcgttcctacggccacagccctagcgcaggagcaggcggcacttctgccactgagccgaccccctggagccgcgcggccgcgc

SEQ ID NO: 691530 - DNA, 320 bp, Homo sapiens
gatcccgggccgtacgtatgtgtgtcagatcacgcgtccagcgctaccccgggcgcgtgtgtgagccacaagtgcgagcacacgctgggctcctacctctgcagctgtaccgtggggtaccggactctctgtggatggcaggtcatgtgacgacatcaatgagtgcagcagcagtccctgtagccaggagtgtgccaatgtctacggctcctaccagatgttactgccggcgaggctcacagctcagtgatgtggatggagtcacctgtgcagacctctgacgagtgcgccctgcccaccggggtccacatctgctccta

SEQ ID NO: 691531 - DNA, 322 bp, Homo sapiens
tagaggatccgtgtcatccccttcgtgcagaatagaggtgagtgctgctagggctgcataatgaagggcaagatgaagtgaaaggtaagaatcgtgtgagggtgggactgtctactgagtagtctcctccagattcattgaactaagtctggtccaatgtatgggattggcggataataagtttgtaataactgtgggcccttcaaatgatatttgggctcacgggaggacatagtctatgaaggctgttgatatagttgccagcaggagggataatgccgatgtttcaggtatctgagtagaagacaatgatccgtaatat

SEQ ID NO: 691532 - DNA, 1152 bp, Homo sapiens
taacatacggctaggtacgatgcccggtggttagtaggacgagggggacatgtctgtctcactcgtggctgatgagaaccccttcagcccagtgtggacctgacagtccgaggactgcttcatcctggaccacggcaaagatgggaaaatcttatgtctaggaaaggcaagcatggcaaacacgtgaggagaggaatggctgccttcaaaacagcctctgacttcatcaccaagatggactaccccaatgcagactcaggtctcggtccttcctgagtgtgctggtgagaccccacatgtatcaagcagttcttcaagaactgtgctgtgtgacccagaccagacagatggcctgggcttgtacctacctttccagccatatcgccaacgtggagcgggtgcccttcgacgccgccaccctgcacacctccacatgccatggccgcccagcacggcatggatgacgatggcacaggccagaaacagatactggagaatcgaaggtaccaacaaggtgcccgtggaccctgccacatatggcacagtactatggaggcgacagctacatcatactgtaacaactaaccgccatggtggacgccaggtgcagataatctataactggcagggtgcccaagtctacccaggcatgaggtcgctgcatctgacaatcctgactgcatcagctggatgaggagcttgttgaggttccccctgtaccaagagaccagagtgaggccaaggcaagggagcccagaacaaactacatgaagcctgacagggtgggacagcacatgaatcattctaccaaggacggaacacacccgacgagggcagggacaagaaagacgcagagcacgcaccacggcctcaataccaaagacaagcgaccaacaagagccgagaccaaccccgggaatagacacggacatggcctaaaaggtaggtacactggactcacaaacggacatcccgtggggccgtaaaaagccccgtaaaacagcacaaccgctgcgaggggcaccagacacacacgaagagcacaaaacacgggggcacaggagaagacacaggatgcaatgcggcacacccgttgtgcgtgagagaaagcagaacacacaaatcaatgggagcaccgcaagaagaacgcaa

SEQ ID NO: 691533 - DNA, 123 bp, Homo sapiens
  misc_feature (47)..(47): n is a, c, g, or t
  misc_feature (74)..(74): n is a, c, g, or t
  misc_feature (95)..(95): n is a, c, g, or t
gaatggcaaaactgggaaggctctaaatggcctcactatagaacaantctttatactaagcagtctttgattancttggaattattcttaaaaangacatctaatggaaattgttgttgttag

SEQ ID NO: 691534 - DNA, 310 bp, Homo sapiens
agttccacggagactctcagaaaactcaaccccccgtccgggaaggatcaccattttatcttattttattttatttatttttgagatggagtctgctccatagcacaggctagagtgtggtggcgcaatcttggctcactgcaacctctgcctcctgggttcaagcaattctcctgcttcagcctcccaagtagctgggattacaagcagcaccaccacacctagctaatttttgtatttttagtagagatgggtttttgccatgttggccaggctggtttcaaactcctcacctcacgtagtccacctg

SEQ ID NO: 691535 - DNA, 216 bp, Homo sapiens
  misc_feature (42)..(42): n is a, c, g, or t
  misc_feature (204)..(204): n is a, c, g, or t
  misc_feature (209)..(209): n is a, c, g, or t
cggacccgggcagttacccaggtcctagtacccgggctgccngcaggtgggagcgcaagtttcctttcaaccagtggggcctgcagctcgaagtctcctcctccaggccgcgcgcgattatgtcgtccggaaaccagcccagtctaggctggatgatgacccacctccttctacgctgctcaaagactaccagaatgtcccccnggaanttgagaa

SEQ ID NO: 691536 - DNA, 186 bp, Homo sapiens
cttgatatggaagtgctataaaacatggtacactgtttatcagtctgtggtatcgtacactgtgaaagtggcaggactgagaaacccacttcaaagagttcaaatatccggaatcgtacacaaggaaatcactggaggcaatcgaattcagttgcagaataacatgtccatctttgatttggtaat

SEQ ID NO: 691537 - DNA, 124 bp, Homo sapiens
tccttgactacggagctgtcatatgtgtacagctaagttgtcgagcttagtcgtgcaagacgagctgacgcactgtggtctgaagtctgatctactggtgtgagatccatcaattttgggtatc

SEQ ID NO: 691538 - DNA, 785 bp, Homo sapiens
  misc_feature (4)..(4): n is a, c, g, or t
  misc_feature (84)..(85): n is a, c, g, or t
  misc_feature (134)..(134): n is a, c, g, or t
  misc_feature (173)..(173): n is a, c, g, or t
  misc_feature (201)..(201): n is a, c, g, or t
  misc_feature (203)..(203): n is a, c, g, or t
  misc_feature (228)..(228): n is a, c, g, or t
  misc_feature (235)..(235): n is a, c, g, or t
  misc_feature (245)..(245): n is a, c, g, or t
  misc_feature (271)..(271): n is a, c, g, or t
  misc_feature (287)..(287): n is a, c, g, or t
  misc_feature (290)..(290): n is a, c, g, or t
  misc_feature (328)..(328): n is a, c, g, or t
  misc_feature (336)..(336): n is a, c, g, or t
  misc_feature (344)..(344): n is a, c, g, or t
  misc_feature (365)..(366): n is a, c, g, or t
  misc_feature (368)..(368): n is a, c, g, or t
  misc_feature (400)..(400): n is a, c, g, or t
  misc_feature (409)..(409): n is a, c, g, or t
  misc_feature (500)..(500): n is a, c, g, or t
  misc_feature (595)..(595): n is a, c, g, or t
  misc_feature (651)..(651): n is a, c, g, or t
  misc_feature (660)..(660): n is a, c, g, or t
  misc_feature (685)..(685): n is a, c, g, or t
  misc_feature (687)..(687): n is a, c, g, or t
  misc_feature (720)..(720): n is a, c, g, or t
  misc_feature (779)..(779): n is a, c, g, or t
aaanggggtactcacattcatttgtcacacatttcaggccctcatacaccccttttaaattgtctaactcctatcccagtctcnntttatagtctaaaaacaaggcatcacccaagtcagacactccttcagancactgctgaaaacggatcaaacgtggagatcccccaganccctgtcctcaagtctcaaaaatatttnancttagcacatagaatacccttaganatattcngtcatgtccnaaagactttgtctctccccctttttnatgatgtcttcaattnccnctgacacctttcctgtatagtcatttggctctattgcntttaactnctcttganactccagcggcaaaccatttnngnttgcacccatgcaaataatctttttatactgnggggatgtngggagcactttcgtaatttgtcatcagataacttcgacaggttatttcttttccttcttgagttgcaactttaacttctattacaacatanattccacttttaaccccttcttgctcattcagagaatttaaattgcttttgttcattttccatactactccccacacttcatcgccaggtctctnaaaaatggtggctatccctccatgctaagtttgatttgttttgccttgtggagatngccaaagtnaagcttaaaatcctgcaggcgggcnanatagaagaacgccgccgaggggtttcggaggtngattctctttgttagctggttgctgccgtcgaaaaatacagaaactctcctcatctggnccgtga

SEQ ID NO: 691539 - DNA, 889 bp, Homo sapiens
  misc_feature (794)..(794): n is a, c, g, or t
tgtttgggctgcgatgacgccaaccgtgttgtggcttggggtcccaatgtgcctcggcacgtggtctgttggccggtccttggtgggttctttttactgggccttctgtccattgtagtagtatagtgcggctgacctttagctctggtttgtgtcgctgcggacgagcgtttgtggtctgtctagcccgaggggcggctgcctgtttgagcgtccccggccgtttgcgtcttaatggtaagttgcggggggtcgtgttaagcccgccgcgggcggccggtcagttgtagtgcgggcccccactttgcgtctccccttgttgtggtgtattgtataacgtcggccgttctcgctggtcccaccgtatccctgaggagtctgtttctcactcgcgcgccgtggggttgctgctgcccccgcgagtagaccgtcctcgtctttttttgtgacgtctcctctccgtggagtcctctccctctccctccaatgtgtggtgtgcctttctatgccgcttcctcacagacagagaatggggtgtgcgcctcctcgcgcggccaacgcctcgccgaccatcgcgtgggtgtgggctctccgctgaggagacgtgtcgcttcgtgcgcgtgcgtatttcttttgagaaggcagtcgtctcttcgcagcacggatgattgaagcgccgcttggggtgcgctcctcgggatggtttttcatatgggcgcacgacgcttctattcgggtaatatggcgcggttagtatgggcatgagagacgatcgaacctcccccgggacctcnaaatagcgcggtcgcgttactatcatggttgctcgcaacaggagccccctgtggcgcccagataacgagaaaaaaaagttttgaaaaaaaagaag

SEQ ID NO: 691540 - DNA, 948 bp, Homo sapiens
ggacgcgtgggtcgacccacgcgtccgcagtgaacagttgttatcccattgtaaagatgaggcaactgaggcgcatcgacagtaacatcttacgtcaaggacacagtttaagtccagtgcctggcatctgtagttatttgtctcagaccctgccctgactcggttccctcacagcaggatggaaccaggtgaggagctggaacacggagggctctccagtgtggcctgtgacggatggcattcaacctgtctgagcaacctgtgctagcagagtgccatggacagctgacatggacccctgagactagatgtatgatgcaccgcaacaactgcctgccacatgagctggatgcctgtgctggacaaagtaccacaacatacccaagttaccctgactatgagggaccccaggtatcaaccaaactcagagcctgtgggcatgagacttgcagtagtatgtgtgcagggacataccagaccccaaactccagagggacgtgcatggagactgcaggcagacatgaggacagacatctgcagaacccagaggagcgggcccaaatcaaccacaccgggataaccacatggagagaccacgaataacgacagagacaacacccaaaccaacagatgacaacacggaaaaacaaagatggacataaatgccaatcctgagacacccgagggacaacaaagaatggagaacagaaagacaaatgaagacaatgcagaaatatggccccagagaacacccgaagagataggaaaaggagacaagagacatcaacagacgaagaaccacaaaaaagcatacgaaaacaccaaaacggatgaccaaaacggaaacgaaagaacgacacaagccaacggaacaaaacaagatgatcacaaaacacacggacagacaactacacacgcaaaaccaaacatagcaaatagaaaccaagg

SEQ ID NO: 691541 - DNA, 1158 bp, Homo sapiens
ggctggcgggtgctggctcgtgtttgcgggcctcggcccggtgcgagcggctccgtgatgtggctgagcccggagtgagtgtgctggtggccaatgcgctgtgggtgacggagctgggccaaccccgttctatctgtgcttgcatgctgactgcctggtggccactggtcagggagctggctgtgccttactgggtcttctcgtgggcaccctgtgacgtgtgtgctggactccagtgcccgctgtgggcccttacctgcatcctgcaccagacccaggactcccagtgtctactggacagtggcgtgtggttcttccctgcaaagagatcacaaaacactgggaatggctggaaaataacttgctccagacactgtccatcttcgacatgtgacggacgatatcaccaccttcgtcaagggcaacgatacactggaatcatctgcacgaagagaacaagaacctgcagccccagtggagacgaggaccccgggaagttcaaggaggctgagctgaacgatgcggaacgcagaagggatgcctgagggcgagaagctggtgaattactactcctgcagaggtggacatctttgagctcctgaaagtgttcctatgagaaattcagcagcctgagggccgaagacattgagcagatgcggttaaacagaggctgaaagtgatccagtaccttggacggaccacgggcaagaggagtgtggtccgagctataactggtgaccataggttcataccacttgatcagcatggaagacctttacatggtgtacaaagcaaggaacgtgaaagcagacactggggataacaagcacgacaatggcagtaagcggaccacaaccatcacaaataggaaactaccgaattgaaccgcaagtcacggaacactatgcaacccatggtgcacagagacacatcacaacatcaccaaacatcaactcagaacacatctaaaaaacagcaccactaagcaacaaactaaaacctcacttctaactcacccactaactaattaaacaaacactacaagacacaaaacaaaaacaattaaactataaaaaaaaaaacaaacaaacactcaacacacactcaaacgaacacattactactacttacctataaatcataccaccactatacaaa

SEQ ID NO: 691542 - DNA, 202 bp, Homo sapiens
  misc_feature (15)..(15): n is a, c, g, or t
ggtggagctgagggnggaaggggagttaggggactctcggaagctcccttgagactatcatccgctgagggtggaaggggatggagcagacactcgggacgtgtcttgagattatcatccgctgagggtggagctgaggaaagagctgaggctggtaggtattctgagcatgacactcgggaggttgcttgagattatcatc

SEQ ID NO: 691543 - DNA, 511 bp, Homo sapiens
tgtgacagtttctcagactttccttgttttcagtgaccttgacacttttgagagagattttcctcaactgggatttgtcagttgtctttctcatgattagactgaggttatgagtttttgaaagtaggaccacggagaagaagtgccattttcatcacatcatacaggcatactttggagccaatgcagatttggttccagatcactgcaatgaagcaaatattacaataaagcaagtcacacaaattttttggtttcccagtgcatataaaattttatgtttaccctatcctgtagtctggtaaatgtgcaatagcattatgtttaaaaaccaatgtacatcccttattttaaaatactttattgctaacatgtttttggcccaaacaagaagtgagcacatgctgttggaaaaatggtgccaatagacttgttggtcacagggttgccccaaacttttaatttgtaaaaaatgcaatatcagcaaagtgcaataaagtgcagcccaata

SEQ ID NO: 691544 - DNA, 120 bp, Homo sapiens
gtggtaccctccactaggctggtggagcggcaggcaggcgggatgtgaccccagacgggctggatgtggaggggctcaggctccagtgtccgaggagccccagcctgggctggactcagg

SEQ ID NO: 691545 - DNA, 1142 bp, Homo sapiens
aaacatacgaaaaacacacccattatttaaaattattaaccactcattcattgacctacctgccccatccaacatttcatcatgatgaaactttgggtcccttctaggagtctgcctaatagtccaaatcattacaggtcttttcttagccatacactacacatcagatacaataacagccttttcatcagtaacacacatttgtcgagacgtaaattacgggtgactaatccgatatatacacgcaaacggagcctcaatattttttatttgcttattccttcatgtcggacgaggcttatattatggatcatatacatttatagaaacctgaaacattggagtacttctactgttcgcagtcatagccacagcatttataggctacgtccttccatgaggacaaatatcattctgaggtgccacagttattacaaacctcctatcagccatcccatatattggaacaaccctagtcgaatgaatttgagggggcttctcagtagacaaagccaccttgacccgattcttcgctttccacttcatcttaccatttattatcgcggccctagcaatcgttcacctcctcttcctccacgaaacaggatcaaacaacccaacaggattaaactcagatgcagataaaattccatttcacccctactatacaatcaaagatatcctaggtatcctaatcatattcttaattctcataaccctagtattatttttcccagacatactaggagacccagacaactacataccagctaatccactaaacaccccaccccatattaaacccgaatgatatttcctatttgcatacgccattctacgctcaatccccaataaactaggaggtgtcctagccttaatcttatctatcctaattttagccctaatacctttccttcatacctcaaagcaacgaagcctaatattccgcccaatcacacaaattttgtactgaatcctagtagccaacctacttatcttaacctgaattgggggccaaccagtagaacacccatttattatcattggccaactagcctccatctcatacttctcaatcatcttaattcttataccaatctcaggaattatcgaagacaaaatactaaaattatatccataaa

SEQ ID NO: 691546 - DNA, 936 bp, Homo sapiens
aaacatacgaaaaacacacccattatttaaaattattaaccactcattcattgacctacctgccccatccaacatttcatcatgatgaaactttgggtcccttctaggagtctgcctaatagtccaaatcattacaggtcttttcttagccatacactacacatcagatacaataacagccttttcatcagtaacacacatttgtcgagacgtaaattacgggtgactaatccgatatatacacgcaaacggagcctcaatattttttatttgcttattccttcatgtcggacgaggcttatattatggatcatatacatttatagaaacctgaaacattggagtacttctactgttcgcagtcatagccacagcatttataggctacgtccttccatgaggacaaatatcattctgaggtgccacagttattacaaacctcctatcagccatcccatatattggaacaaccctagtcgaatgaatttgagggggcttctcagtagacaaagccaccttgacccgattcttcgctttccacttcatcttaccatttattatcgcggccctagcaatcgttcacctcctcttcctccacgaaacaggatcaaacaacccaacaggattaaactgcatgtgtcggatgtcctgggaatttgctggaacagactacaaagttctgctcagccggcagatgggaatggtttttgccttggattatgaccctgtggaaagcaagatatattttgcacagacagccctgaagtggatagagagggctaatatggatgggtcccagcgagaaagactgatcacagaaggagtagatacgcttgaaggtcttgccctggactggattggccggagaatctactggacagacagtgggaagtctgttgttggagggagcgatctgagcgggaagcatcatcgaat

SEQ ID NO: 691547 - DNA, 175 bp, Homo sapiens
agtcagcttctccagtgtcagcacgcagggcgtggaattccactcaggagggtgacgtacgcgatggccatgccagacaggcccaccttgccgttccgccagatgcacacggttgtagtgcaccctggactcctgctcctccaccaccttgggcgcctccctcctgcggaggttc

SEQ ID NO: 691548 - DNA, 435 bp, Homo sapiens
caataaattggctgggcgtagtggcacacacctgtaatctcagctactcagggggctgaggagggaggattccttgagcctgggaggttgaggttcaaggaggttgaagcagtgagccgtgattgtgccactgcactccagcctgggtgacagagtgagaccctgtctcaaaaaaaatttttttttttccatggctgggcacggtggttaatgcctgtaatcctagcactttgggaggccaaggtggccagatcacatgaggtcaggagttcaagaccagccttgccaacatggtgatcctgtctctcccaaatcaaaaattagcagggtggtaggggccgtatcagtcagaggtcgcatagaacctaagttgggagttgcagtgacgagattgcttctgcactccagctgggtgcagagtgagattgtctcaca

SEQ ID NO: 691549 - DNA, 221 bp, Homo sapiens
gccaaaaccactccaccttaccaccagacaagctgagcaaacattaccaataaagtataggcgatagaaattgaaaccttgcgccaatagatatagtaacccgaagggaaagagtgagaaaattatagacccagcctatatatatgcgcaggggctcaacccctatatacctctgcataaatggagttaactagagataaactcttgtcacaggagagacc

SEQ ID NO: 691550 - DNA, 284 bp, Homo sapiens
ggcgctctgcagtaactcacgccatgtaatcccagcacttgtggaaggccaaaagcaggataatctcgcgttcaagaccagcttgggcaacagagcaggacccccatcgtcgtacaaaaaatatattcagtgtgtcgagcaagaagtgattcaaattgctgctcagattttaaaacttattgtaactatcagtgtaaagtacccatgcctggatccgtgtacattgttgagtatcaacttggtggacctgctgttcttgaaaccctgtcctcgctatacgtaaa

SEQ ID NO: 691551 - DNA, 233 bp, Homo sapiens
  misc_feature (51)..(52): n is a, c, g, or t
  misc_feature (80)..(80): n is a, c, g, or t
ctaattggttcttcgatgacgagtcttttctgtcccttatgcagctcctcnnccttcaggtctcagatgaaacatctccnctgagaaacctcccagggcccccggcaggggcggggggtgaggcacctctgctctgggcccccaccacaccctggcctcctttcactatcgaaactatcaggcactctgatgacatagtcctgcctctggagcgtcatcgaagaaccaattag

SEQ ID NO: 691552 - DNA, 105 bp, Homo sapiens
ttcgtcatctgagcagaaccaacctccgagcagtacatgctaagacttcagccagtcaaagcgaactactatacgtcgattgatccaataacttgaccaacggga

SEQ ID NO: 691553 - DNA, 236 bp, Homo sapiens
ctgaatgttgccaaatgcaaggagagatggaggacattctccaggaagcccggcaatgcagaagaaaaggccaagaaggccatcactgatgccgcctagtgactggctgaggagctgaagaaggagcaggacaccagcgcccactggagcggatgaagaagaacatggagcagaccgtgaaggattctggcagctccgtctggatgaggctgagcagctggccctgaagggtgtga

SEQ ID NO: 691554 - DNA, 198 bp, Homo sapiens
gctgatgactccagaagtcgactcatctcaaaacacacaactgtagaaatggccatggaacaaatggttcacaccttgtcatacccagaccctcaggactgccaaggacaagaggatcacttgagcccaggcgtaagagaccaccctgggaacgatggtgagaatctgtctctacaaaatgtatataaaaaattggct

SEQ ID NO: 691555 - DNA, 472 bp, Homo sapiens
  misc_feature (148)..(148): n is a, c, g, or t
  misc_feature (151)..(151): n is a, c, g, or t
  misc_feature (394)..(394): n is a, c, g, or t
  misc_feature (434)..(434): n is a, c, g, or t
  misc_feature (455)..(455): n is a, c, g, or t
agtccaagagttcaaaagctaaggaacctgaagtcggatgtttgagggcagaaagtatccagcatgggagaaagatgaaggctgaaagactcagcaagtctgccctttccatcttcttctgcctgctttattctagctgcactggcantgnactagatggtgcccacccagattgagggtgggtctgcctctcccagtccactgactcaaatgttaatctcctttggcaacaccctcacagacacacccaggaactatactttgcatccttcaatccaatcaagttgacactcaatattaaccatcacatttcctaaaccaatataccaattattgattatgattatggacaatcatttcacattgtatacatacatgtattcatcacactgtnacatcttcaaatattatggcaagttttatttgttcaatcntacttcagtataggtgaggancaagttaaatggggaca

SEQ ID NO: 691556 - DNA, 114 bp, Homo sapiens
tagttgttgctgtaggtgaattagaggatcccccagcccattgagattggtagcccagggggggggggggggggtcgcaccagtcgtggtgggagaaggaggggtaccggagct

SEQ ID NO: 691557 - DNA, 200 bp, Homo sapiens
  misc_feature (48)..(48): n is a, c, g, or t
  misc_feature (88)..(88): n is a, c, g, or t
ttggttcattctctggtttgataggatttaaactcataacattgaaangtcaatataacattcattcttaggacatttgaaatataanattgttgaagacctttaaagtgagataaaatgggcccatgacttgcttgattgcattgtgctgagtcattctttgtgccttaatgagtaagcagttaaggccaaagtaaatg

SEQ ID NO: 691558 - DNA, 1190 bp, Homo sapiens
ggcctggcagtcggctgcaccgaacgcgagggtatatgcatgtatagactgcctttgatcctggattacagtggcgacctggaaacctcgtacctcctcgtgtggctgaaggaaccgaggcttatgacgatgtatgactatctaggccgtagtatagcgcgctatcatacgagagagtctccgagtgatagcacgagcgaagtagaggtcagtggcacatgcttgggcgcccattaagaggggctcatgggaggcttgtacaggcaacgggcattggtgtgtgaggggacgttccactctggagccaggccgactcccacgtccgacgtctgcgagctgtcatagaaggcatacagtcgtaacactgtcgtgagggcaccgtcggacgtgtgcgcacgagtgccctgggacttcggcccgcaatgacaagtgtgagcagagtcagcaacatggctggagacctggagagcgcagaggtagtgttttccccgagcgaaggagactcaccgaggcgacagaggcgcgagatcggactccacgggttccagggttatgaaacactcatcttttgtagtaacgtgcaagcgtgcttcccacacacgcgaagaatgaatagggttcgaatgtggctcaaccttgtggaagcggaatggcccttgtaaatctgcttagatattgcggggacccgaaggggagaccaggggaccctgaagacattgaatttggcacgggaaccaacgacaaaggtccacgggaccggagggaatagtccgccagtacactccgggggtcatctgcacggataattaaaccccgatagttcaagctagtcgcgcaagtggacagaaacacatcgagtgtacagagttcgagtgccaacggtaacgcgacttcgcgagaaattccatgggaagcgcaaacccggcaggattggagaaagcggatgagaagaccaatcggcaaggcggccctccataagggacaggagaattaaatccctaacgggtacccgcgaaggagcagaagatatgggaccacgagcgagaggacatccccgcgatatgaccacaattcctgcgggaagcaaatgcagaaagagtagcacaggacacaaaaggggggagtccccggggggtggaagaggggtggaaccacacacggacaagaggggacttgacaccaccaaggcc

SEQ ID NO: 691559 - DNA, 389 bp, Homo sapiens
ggcatcctccagacccccccacaggggttcccttgtagccccttccagggggggtgccccgttggtccacccacaattcaaggtaacttaattctcccttcagggtggggaagccccccccaggagaaagctggttccagccccctttttgataaggccccgtcggtgtagggtgccccttcccaaagtaatttgcccgcgtcccacgctgcttttgagtgcgtcgcggccgccaggcatgcgcgtgaggccttggatgatctccacctcgtcactgtagtgcagcgcgcctgcgttccacaccaggtttcggtcacagcggtagtacctgtccctcaggttgtcgatgaagcgcttggtgaaggacttgacgtcgacgcggccgcgaa

SEQ ID NO: 691560 - DNA, 174 bp, Homo sapiens
tgtgatcctcgcattggaggggcagttgtgccatcagtggcggatatggaagcagagccggaggcagctatggctttgggaggtggtgccggtagtggatttggttacggcggtgtgagctggtgtgtggctttgggctcggtgggggatctggctttggaggtggcttcggtg

SEQ ID NO: 691561 - DNA, 138 bp, Homo sapiens
cgctcggtaccgtcccccatcacccaacctacagggaaaatcgagatcaaaatggtccgcccatgggctgaagggactgaagagggtgcacgtggctgactgatgaggacacgagaaacctcaacgctatctcttccc

SEQ ID NO: 691562 - DNA, 949 bp, Homo sapiens
gtgggaatggggctgcccgaggccggcctgggtgctgcagcgcaggaggcggtccggtggctgcggtctggcagactgtgagcgcgaggaggcggagtgctgctgggcgggggcgggacggtctgtgcggtggcaaggcacagtgtgtaatggataggtaacagagaagacctcgtcccttcctatgtcgatgggggatcatgtaatgactatgatgtgcttcacattgcccccgccaccatgcaagccccatggtgaacacctgcatgggttgtgctgcaattgtgcaagctgtggctttaccgcgggacccccgagctctgaatgacgatcaggtcgctagcctaatgtttcccttgggtttgtaccgtgcatttggatgatggccctcaccttcccccgattgacagtcctccattgaggcctccttgattgtaggtggtctggattgactggaggaacatgattcagttggtgagatggagagagaaaatgtgggaaaagttttaaaggagttaacattgggaaagatgcattgtgaccttggaagggctaattggcattggcttttgcatgtgaaaaggatttaaggtttcttggggacgcattgagggcgagaataacactgtcccgtttctagtatagttggacggaggtgtcccaaagggggtacatactcaggttgtttccagatgaagaggcaccagcgttgttttggaaggacgggggcgaggtcgacaacgggcgaatttgcaagaaagtcactaacgacgaagggcccaagccaggagcgaacgtaggccatcagacgggattgaaccggccacgaggctgaaggaagaacattcacatgaaggaaacacgttcaagaacgaggtttgaaagagcatggcttgattgtttgtcaaaaccagtggggagagcgaaaacttcctaggggaatgatttg

SEQ ID NO: 691563 - DNA, 800 bp, Homo sapiens
aatagggggggataacaattttgtagttattgatagttgtctaaagaagtgaggggcatagagcattttttaaagagatatttttgcccgcaaacaaaagggggatttagtggaatatataagtgagttgaacaacatagttgggaatgatttattttatatataaaacggcggagtgcaagcgagtgagagggcgaggagtttataatcgagagagatagatattgcgcgtccaatatatggtgacactcctcgttgggggggtcccaccccccctcctccttgttgttagaaaggtttttccccgtccctcgtggggaccaactgcacgcgagctgttttgttttgttgattttttttgttgttccctccttggggtcacgatcgcccccgtttcttgaggttcttcttttctgttaactcccactgggttctcacaagttaatttgggggggaactacccctgagccacgagataccactggggaaagagtctctaccccctttctgttcgagagttcatttttatccccctcctcgtctgaaccacaaactgtatgggatcaaccacccacccgagctctgtggggacaaaagaaaaacctgctcccttcgtctctgctggaaactggaagggtggctaaggcccccgggtagtagtgcataagaaattttagacttttttccccctttttttgtataattggggtcagagaggaggacactgggtttttatgtgaatatggcacccattagccctttacccacaagtatcttgtttaccattttttttggtttta

SEQ ID NO: 691564 - DNA, 667 bp, Homo sapiens
  misc_feature (583)..(583): n is a, c, g, or t
actgccatctcagacacaacaatcaaataagatgaagaaataataagcatgaataaccatcttttcatatgttactggccgcctgtgaataactatatttatatcctttgtcattattctgttgtacatgtcttgatttgtaggcgtactttaaatattctggatactacagtctttttggtcgtgcgcatcataaataattggtgccacactttgggtttttggtctcgaactcctgacctcaagtgatctgcccgcttcagcctcccaaagtgctagaattacagatgtgagccaccacacccagccatttttttttttttttttttggaaacagagtcctcactcttgtcgcccaggcgtggattccaggtggccccatctcggttcaccggaacctccacctcccgggttcaagctgtttcctccgtgcctaagcctctcaagtagctgggattacgggcccccgcccccattgccgggctaatttgtggtattcttcaagtggagacgaggttccccccatttttgccccaggctggtctggacacttcttgacctcaggtgacccgcctgcctcggnctcccaaagtgctgggatacacggcttgagcattgcccagtcctcatttagatgtctcaaccttccaatggtccgagcttccat

SEQ ID NO: 691565 - DNA, 137 bp, Homo sapiens
tgtcataacagtacatgctcagagcaagtttgctcagtcaaaggcaggaaacactgatgtccagctcatgagtcaggcagagaagctcctctgctcagtctgtgtctagccggtctccaactgattggctgaggctc

SEQ ID NO: 691566 - DNA, 488 bp, Homo sapiens
tttttatattaaaagacttcaaacaccaaagagaggtcatacacgtcttattttttaaaaacatgcgtcaaactatagctacccaggacgctggggaaccatctctggaggagaatatggcagagagggtttatgtataaatacacaacaatatttgtacacaactggtaagctgctctgactagccctatagacaatgtcctagagttcgtgagggctgccatacaaacttacttacctggttttaaccgcgcgttgggtgtgcaggcccattccacttccacagctgccagggctatttgaacgggtcatctaaaagcccgtgaatgcggccacatattttgctgttcacctgtggtggaagggctcaaatacactaggactgccgatgtacctagcccccaggttgtaggctcttttggcgtacatcagtacatccaatatggtggcaactgtggacaccagtccaaatgggagtcttgggagaa

SEQ ID NO: 691567 - DNA, 656 bp, Homo sapiens
tataccatccgtttggcgcgcggatccgatacttaatttagtatgctttataggtgttccctttgatatcctggtcttgagtagctgcttggaattctcaccaagtaggaatggctcggcggctgagcagtatggtactgatataaacttctttatgagcgttgcgtgagggctctacttacatgtgcctcttactctatgcagtgagctgctagagtcagcagtgtacgaataagtcatgagttgatggcctcactagcccagccaaaaatctattagtggtgcagccaaagggccatagaaaactagaagaaactctttctgactgcactgctcccaggacaggacgagccaacgtgcgacgagctatgcgctggcgtgggggatggcgctgtggagtctccacttcgcttgggattctagcgctcccgtctcatatcagtgcacacgacttattcaacatcgtacaggcatgtgcgacatctgagccttcatgtaacgcaaaatgttaaggtactggcaaaactgggcttctctttcgtgagaattacagctcttatggtgtcttgtaatcgtccgtgggtggggacaggaacatggtgtcattatctccatcccattgacagaaaccaataaaacctcaggtgtacaggcac

SEQ ID NO: 691568 - DNA, 1054 bp, Homo sapiens
cattactttggaaagttacactttatttttcctttcatcaccgtcttagaaacaaattattttccaattcataagaacttggtaaataaaaaaaaataaaaggaaattatatgttttgtcttgggacattcatgggaaggcttgtggaatgacatgatcccccagaaagccttagttgagccagatctcaaccagagactcaagatagcctcaatgtacagtgacaagattatgtatccaagaaaaataaaaaaaaaatcatacaataaaaagggaggagggaagggcaggtcttgctttgttaaacgcccaaatgggtgtggtaaactttacacaagggtggtttttcgatttttttttccctaggggcatattacccaagaaagttgtgtaaagtgggggaaaaatactgttgtaataagcgattttaagtgttcgcaacgaggggttgactgtgtgggccctctaatagcgttcattacaacgattttactccccttataaatgttttcagacacaggggaaaatcaatcttctgggcaatacatccttttaaatgaaactgagcaggggacgatgatatacaaagtattcatcactatataattctacctaaaataactaattcttcggtgacagagcacaagcgcacatctttctaccgccattatgtttcacaacagcattggcacgaacactgcttgttgcggcgaaacaattaatctcacatacgtagacacttagcctggtgggcgaacactctaacgcccagctatagtaaaaaggtcacatcgattaacaaatccatgcgtggtcggaccatttttgcgccccggaccactcgccgtccgttgtatcacatcacaccaccgtacggtctccaccataagatattcccacactaacagtcgtcgtacagcagattactcacacatatacaaggctctcctctaaatcaaacatctgagtgcagccatactcctcctactgttacaccacattagttggttattcggacgcactgacgcggtcagacatacactctatctcagca

SEQ ID NO: 691569 - DNA, 120 bp, Homo sapiens
gtaataatgcctcactttgctgaaccttggctatcctgccatgctccagacactccttgcagcttccagcttatcattcacagtggatgccaacggcctgttccataccggggaaggtta

SEQ ID NO: 691570 - DNA, 124 bp, Homo sapiens
ctcacccccaccgcctgacgctgtgccccggacccagcagagctgggagggacagcccccaaagaaaggggtcatgctggcctgccccctgcccacccccactttcaggcaaaaagggccaggg

SEQ ID NO: 691571 - DNA, 220 bp, Homo sapiens
tcctgcgttagtggatgtagtttcaagaataactggatggttgttctgactcatcttcttatgagcccatactctattagtacaaactgagggttcacggtgatctcctggtccatggcttatcagccgctcatccagctcacatgcacttcagcatctcctcgatcaatgttatgaagcatggctggagttattatatttttcagaggttatcatagga

SEQ ID NO: 691572 - DNA, 464 bp, Homo sapiens
  misc_feature (98)..(98): n is a, c, g, or t
gggcataaaaacctgggcctctgggttaagcgtgtttttgttctccttatccactcaccatccattttcattattatcatccaggtaaagcgccttcnctggtcccttttcaccaatttggtaagaaccctcaaatgggtcgatccaaaccctaagatcctgtggcagattgccacgaacatcatcaatgtccaaacccctttctttggatgcttgttcaatcactggggcccctttttcccctatgggtatacatttaaaccccgatcctttgtatggcttttcaggaaaccagggcccttcatattttttcttaagaagtctttcaagtttttccccaaaaatgttgacccgtttcctgggaagcttattggccaaatacgaaataataaaatttagtgctacttggatttcaagctgcatagctggtacgccccaaaattaggtttcaactccccccccca

SEQ ID NO: 691573 - DNA, 549 bp, Homo sapiens
cccttcacggtgtctgggacagcaggtactgccatgtgcactaccatggcccccgaggcaggcatgcaatggtgacgggactggaagccctttgcagatgccgttggaggagctggtccgtccacaatccaatgtagtgccactctgcacttagcaggggatggataagcagggaaacattgtgcattcctcacagccaacagtgtaggtctcggtgaagccccggtcgctgagctaggctcaggctgttccagggagccacaaaactgcgggtagtgatgttgcaagagtccatcctgcagttttccagcactgagaaactcctcgttgcggttgtgggacctgtggaagtatgcgcagacactctccatggatgatgggtgtcgacgaaccggatgttagcgggatcccctaaggcttgtgaacccttattctctctaggtcatcttgatctcttaacgctggtataagggcggtctggttgacttctggtgtccgccagactttggggcgtgatgacgaggtcggaattgcagaacaccgtcgaag

SEQ ID NO: 691574 - DNA, 148 bp, Homo sapiens
  misc_feature (77)..(77): n is a, c, g, or t
  misc_feature (112)..(112): n is a, c, g, or t
aatcgacgacaatttaaagaaactgtacagcaaagcgacgattgagaaaaacgatgcaattagaactgaaaagaatnaaaatagcaagcgaattgatgcgccagcaagaatnagcgggtaacgcctctgcaggtacgagctcgaatcg

SEQ ID NO: 691575 - DNA, 349 bp, Homo sapiens
  misc_feature (38)..(38): n is a, c, g, or t
  misc_feature (46)..(46): n is a, c, g, or t
  misc_feature (109)..(109): n is a, c, g, or t
gtttatgggggggccttggaaggggaaacccccattcnccccggcnccccagggggtttttgggtggggcggggggaattttcccccccccgtttttcccccccccaanaaaaggttttttggggggtttagggcccccaccccggggcctgtttgggtttcaaaagggccccggggttctttcccggccgtgggaaaaaaccccccggggggccccaagttttggaaatttttttttgggtttcccttccccctgggggcccccccccccccagggggggcccggggccccttttaaagcccccctcccccggaaaacccggtgtttggaaaggggttttttttttta

SEQ ID NO: 691576 - DNA, 813 bp, Homo sapiens
agatggcggcagctgtggcttcgcttcgcaggggtagtgttgggcccgctgtggcgcggggctcccgggctgcgcgtgcccggggtctgctgtgcagtgcgcggcccgggcagctcccgctactgacacctcaggcagtggccttttctgtcgaagtctggttgccttttcccgtaggccggacaggtgatgcttgtctagctgctggtgcatgtcttggtcggcagggggttgcggggctggactgtggcgtctgcatattcggcgtgttgaggtgccacgtgaggctggagcatgcaaccccacccatgactatctcgtggtctcaccgtggcctccttctcgttcctttgtgatcgcacacgcagcatcctggaggggttccccacggtatataagcaaggcttgtgccgcctcctgccacagtcattgtgacttcgattgggcctaccagcacagcatggtgggctgtgtgctacactggatggatgataggcgtagaggatgctggctgccggcagtgtggactggttcaagaaccgggccctaagtgatagcataggggagattgttcatagtggctcaggtgaaggctgtatcgacttattttcccgaaaagcatatcgcccaagagttgacggctgtgtcgaggctgccgatcacactgagcgttggccgctgagctagctacatcgtgcgagtagcattgtggtgggccacgtgtctcctgccagggctatgcgatccaccacgggtgtctggggggttcactcaccctatttggcggctgcaggcctccataagagttaatgc

SEQ ID NO: 691577 - DNA, 139 bp, Homo sapiens
tcggaaaggtgaagtaacttgtccaagatcacaaagctggtgaacatcaagttggtgctatggcaaggctgggaaactgcagcctgtacttggcgctgcccttgatcatccgtgcgtgctccccgagaagtctaggagg

SEQ ID NO: 691578 - DNA, 130 bp, Homo sapiens
gacggcgctaaggggcgcgggagtgtacggtcagctgggcgtaacaacataccgcgggctaatggccgtaaggggcgtcagtggatttcgggaatggtgggaactattgtttttctttttttttcctttg

SEQ ID NO: 691579 - DNA, 179 bp, Homo sapiens
gagtaataatggtttcaagagtatttttaaggaacaaaacgagcatgaattaactcttcaatataggctatgaagtaatagttggttgtgaattaaagtggcaccagctagcacctctgtgttttaaggggtcttccaatgtttctggaataagccctatttcagggttcataacagtc

SEQ ID NO: 691580 - DNA, 750 bp, Homo sapiens
  misc_feature (298)..(299): n is a, c, g, or t
  misc_feature (314)..(314): n is a, c, g, or t
  misc_feature (326)..(326): n is a, c, g, or t
  misc_feature (335)..(336): n is a, c, g, or t
  misc_feature (403)..(404): n is a, c, g, or t
  misc_feature (411)..(412): n is a, c, g, or t
  misc_feature (453)..(454): n is a, c, g, or t
  misc_feature (469)..(470): n is a, c, g, or t
  misc_feature (480)..(481): n is a, c, g, or t
  misc_feature (492)..(492): n is a, c, g, or t
  misc_feature (514)..(514): n is a, c, g, or t
tataacgattaatataactttgatatctccttgtactgcattttgatcacttggagcattatgtcatgaatacttaattgatatcacagagtacgataggatcatatgttctgaagcgattatcacaatcataaattttatgcccggatcgtaacctcggtggacagataccataacatacctgctagcaatagttgttagcatatagattgcctgtcatatgatgtctgatactggcacccatttccgctctgactcgattatattagatttctgagcatgctatactaagtatgcnnttcagtagaagccanccacatatgtcnatctttgcnntgtaaagctgcaacggacaactttttacaacttctgtggacactttgagttacgactggtaacatannctgactnntacgaaacgttgaacttgggttgaaggcgggcccaaatcanncctgacggtcagcanngtttgagacnntagcctggcanacacattgactgaaacccctgnttcttcttacttaaaaaaataaccaaaaaaaaacaaaacacacaaagcaacaaacaaacacaacttgttgtgcgcgcgcggccttctgggtgccctctcgcgaagaaacgctcttctcctcgagacaccctctctcctcttgtgcggcgcgcgcgcggtgcccccacttatggtgttcaacttgtcgaacctcttggctctcactaaacttgtgtttctccccctggggaactctg

SEQ ID NO: 691581 - DNA, 458 bp, Homo sapiens
cgactctatgagtgatccgtactttcatcattgtggggtggctgcgcttcccacagatgaaggaatgtatttgtaacacatcgtcccccatctggctccaccgctccaccaacaaatgattaaagggacccacttcaagaggggcaaacgaaagacactacgacatctgattccctgcacactgggtagtggtgactgtgctactcacaggtcgggtaacttctgttttcaccactgaagatactgtgcctggacttatttatgcaagagaacacggtcagtgcggattcacaaccctctctacacacttcagaagcctgggtggtgaaagccagttcttcccctttgcagaatcttaaacaaaaccgaggtttaccctgagtccttttctttccttctcattctcagttactgaatatctgctttatgtcaggcacagtggtaggtttgaaggtgag

SEQ ID NO: 691582 - DNA, 353 bp, Homo sapiens
gctacagatgtctctatagaaaaggggaaaatcaaattattgggtaaaagtgcctgccagtaacacggcagtggtctcagaagtctctgaacacctcctaccctactcactagtgatttttaaagaaagcggtaggggtggtggtggagtggggggaggccagtaatgaccagttcagtgagttttgtaccttgtgattcctctaacctgaccaaaggtgatgagaccagctgtcactgccttgtccttgaagccctttggactttgaggtggtctccagtgggaattccactcaggagggccactgggttagaatgaggtcattggccccttttggagtaggagtggggagc

SEQ ID NO: 691583 - DNA, 273 bp, Homo sapiens
cgacgatcccgacgcctctctatggggtcactgcacgtcaggtccatgtacatgtcatgttgacatccatgttcatgtatggtgtgctggccccatgggtgggtccactccctcagcccagactgccccatgggagggctcagtgcaggcccggcctccaccaaactccatgcacatgggagtgcctgcaggccctcacccacagccatctgcccgggcaacatggtgggatccctcttgttggtgctgcctgcatcatcctgctccatctcc

SEQ ID NO: 691584 - DNA, 383 bp, Homo sapiens
  misc_feature (197)..(197): n is a, c, g, or t
  misc_feature (298)..(298): n is a, c, g, or t
  misc_feature (310)..(310): n is a, c, g, or t
tgaacgcaaggaaaggggccaacaaagggaagaggttattttccggcatgaaataagatttgttccttttccttggtgggattttccagggtccagcacttggagagtttgggggttggtttttttactgccaggattcctttaggaaaaccctccccaagccctggcagggggtgtttggcccttacctgaagggnccccattcactcccaagctagtggccttggtggatttggggtttgctgaattcaaaggttgaacaaagcaaacaggtttcccaaaaaagggccctcaaagngggcaaaacggntttttgcaaacaggtttgaaaaaagccttttccctgttcctttttccattaaaaaaaaaaaaaaacgcctgga

SEQ ID NO: 691585 - DNA, 119 bp, Homo sapiens
atcagctcggtcctgtgtagtgttgagactatgaaagactcattgtcttgtattcagctcttaaatagtgtaactatattcccccccccctgttggaaaagtaccctgttggaaaagta

SEQ ID NO: 691586 - DNA, 280 bp, Homo sapiens
gaaattttaaataaatgggatcaggatcttgaagcctttcattgaaaaattgtaacaggagatgaaacatggctttaccagcgcaatcctgaagacaaaacaaagcagtggttaccaagataagtagttcagttaaagcacaagaggacttgttgagagcaaaggtcatggcaacagcttttgaatgctcaaggcattttgcttgttgacttctgtagggccaaagaatggtaacgtgcttatcatgggagtcctttcagaacttagcaagcttcacaga

SEQ ID NO: 691587 - DNA, 130 bp, Homo sapiens
ccctctataatgtgtgccatcataaactgtgttactgatgggcaaatggcaggtaaaaaaaaaattgtataggggccgggcatggtggctcacgcctgtaatccctgcactttgggagaacaaggtacct

SEQ ID NO: 691588 - DNA, 197 bp, Homo sapiens
ttgtgaaacgagtggacaggacaaaccagattatatatatacctgcaccctatgtcctaagagatgacaatggaaaaatcacatgtgtgctgcattacagacatgtttatcgagaactgtctcacttattaagaactacagggctacagagaaactgacatatcttgctagactgaggtgagatgagactttcagca

SEQ ID NO: 691589 - DNA, 601 bp, Homo sapiens
agcgggagggctgcagtctggagttggagccctggtcccaaccagggctggataaaaggtgtgggtggtgctctcggtgtgcgaaggctgtaagttatatgatgaggttccatggatctcaatagtgccagcactgtgtcttcaggtgtacacaggccacagtcaggatactgtggtacaacagctgaggagcagttgaagccgtgggagacacagccaggtttctattcaggtgctgaatattttcaccaaccacacttggatataaatgtaaggtggcttgctgtactgtattttaaacatggaattgatcgctactggagacgtgtagcacctcatgctctctcagaggaggagaaaactactctggcgtgccgggctcatcaccaacttcaaatgaaccaataaaccagattgcaactcagattgcagtggtcattgcaaaaagttgctagatgggatgtcccagacagtggtctgaacctaatttccccactctaatagagtttgttaaagtccaggatgatcttcgaaagcacagagcataacttacctttctatcatgttacaagacaatggattaaacgattgctgtgataga

SEQ ID NO: 691590 - DNA, 306 bp, Homo sapiens
gggggagacttgatgttccacatccaaaagtccagacgtttcgatgaagcccgagctcgtttctacgctgcagagatcatttctgcactcatgttcctccacgaaaaaggcatcatctacagagacttgaaactggacaacgtactactggaccacgaaggccactgtaaactggccgacttcggaatgtgcaaggagggcatttgtaacggggtcaccacagccaccttctgcggcacgcctgactacattgccccagagatccttcaggagatgttgtatggacctgcagtcgactggtgggca

SEQ ID NO: 691591 - DNA, 381 bp, Homo sapiens
aaaaaaattttttttttcccagggggggggggatttttaaaaggaggaggggcggggaaaaaaaccccccccgttaaattggggggccaaaggaaaaaaaaatttttttttttctaaagttttaaagggggatttgttcccaacaagttttgttgaaattccccccgggggtcgggaaaaagggttttccgggaacgggtttcttttttaattttctaaaaaaaaaaaaagggccccccggggttttaaagggggggggggatggttttcccgggtttaaaaaggcccaagggggaggttttaaaaagggggccccctttatgggggggggagggggtcacccccttttttttaaaaaaaaaaaaaaaaaagggcccggta

SEQ ID NO: 691592 - DNA, 1073 bp, Homo sapiens
tggggctccatttagtggttttaaaatctctttgaagttaattaggggaagaaaaagccactcctctcatacgtgactctttggggggtaaccattattgtttatactttagaaatttacgctagtatattaagattaagtgaattctctttttatatctaagattgtgaacccattttacattattattcttgcgatatctcaattattccaaaaggcctatattgactgtgtgttttcaactggactctaacttttacacaaatttttcataattttcggggtcacactccatctaggggggctacccaggtttgggcgcgccattatagaattagaagtatgttttggcttgtggcaaaaaaaaacttttactctttcataggaagagaaactcataatgtaccactctcctggggggtatccgctctaaaatctaaaatttctgtgctcgtgttaaacacaggcggtgaccagagtttttcttcttgcaaaattaactgtgaaacctctttttacaaacaccttacaacctgtgggtcctttgggataggctcaacacacggggggcgtattcaaaacgcgccaaaaacaacctgtttgcatttattttgaggagatgtcgccctctgtgtaataaacgggagactccggggttcgagcatgtggattccacgggggcgaccaccggtgtaaacacgcgtgggacccttcatttaataacgccaacacagtatctcgctttaaatagacatattccccttatatgtgtgggcctaactgggggttatacccctaattttgcgccacttgtgtatcaccaaatctttcacccccaaaacacctttatgttgcgcgcgattaatataacccccgaaaacaccctttggctattttgggtccataaaggtcccttgcgcaacttgaacaggaacacatcttcgcacaagtgtgggccaaactctaggggataagatccatacaaacacaaggactcctcaacaaacgaggattatgaccacaagtaacactcgacggggattaacatctaaatataacagggggccaatatg

SEQ ID NO: 691593 - DNA, 258 bp, Homo sapiens
cgggtgatctaaggatcccgatatgcgtctcaggataaaaaataatgggtccggtatggtggtcatgctgtaatccagtgttttgggatacgaggcaggaaaattgcttgaggtcaggagttcaagaacagcctggcaatatggtgaaaccccatctctacaaaaaatacaaaaattagccgggcttggttgattgcgcctgtggtcccagctactcaagaggctgaggtgggaggttggggcttgagccctggaggt

SEQ ID NO: 691594 - DNA, 119 bp, Homo sapiens
  misc_feature (29)..(29): n is a, c, g, or t
  misc_feature (54)..(54): n is a, c, g, or t
  misc_feature (84)..(84): n is a, c, g, or t
tttccatagattatttaccccaaggttgnaaaaagtgaatctaattggtgactncttaatatctcttaggttcttttagctgtnggttgcattactgtgtctctgaggtgcggtcgacg

SEQ ID NO: 691595 - DNA, 920 bp, Homo sapiens
atgatcatcggcagcatcaaggatgagatggagcccagcttccaggaggtctccttctactacagcgaggagaacaagcctcccgagccagaggagctggagatggagctggagatggagcctgagaacatggagagcgtcccactggacccttcggcctcctcagcctccctgcctctgcctgaaagacactcaggacacaaggctgagaatggcccgggccctggcgtgctcgttctccgcgccagttttgatgagagacagccttacgctcacatgaacgggggacgcgccaacgagagggccttgcctctgccccagtcctcgacctgctgatcctcggacacaccgaagcacgcgccaacagtaacgtgtgtgcgcccactcggtgggcgggggggcggggaggggagagcaggttgtaacaatctattcacaagccctccctgtacctcagtggatcttcagacctgccattgctggccaacgggagacggctttctctggcagtaaaacaccaccctggggaacctcccctttctcacaaatgtgacacacgcgcttacttatctcctttacccacgaaccattaagctgacgatgggcctctggacaaccttgaatgacaaccacttaatagccagcaggacactcgagaaagtgagtctcttccgctgctctggccttattcttctgcccttgcctttccgtctcttgccctcttcccttccccgccccggcttcctctttctctgttttccgctggcccgactgcaagtggcggcacctggcaagccggctgcttcctataccacagcgacgcgcggcgctcctggtggctccgcgtccgtccccgttctggatgtggccctgggccctttcgcacagcccttccgctactgccggcggctcgcgcctcg

SEQ ID NO: 691596 - DNA, 784 bp, Homo sapiens
cacagcatggcatatcatgcccacggtgctatcactcagatcatggacacagacaccgtgggcatggatatgccatgctgcactgctgcctggtgattgcagctagaggtgggagtggagaatggttcccaggaagacaggttccacctctaaggtccgaaaatgttcccgtattaccctggagtgggagtgaggggtcatacaccaaaggtattttctcctcaccatgtctaggcgtgactaggcattcatgaagaaattcgccacgcaacacctcctcgaacctcattgtcgagcagagagggccctatctgtagtcgttgaaagcatgcctttcgacatgtccacaccttcttgccatgttccagctgctctcccaagctggaaggccgtctcccctatagccaagtcctcctcaggcttggatgaacttcctcagcgtcacctccttcattgagccttctctgatcactccatccctctcctacgcctccctcccccatgcgctcaatgtataaagttgctgcttgatgcgttagcattcagaattatgattgatcgtatcagtgtgtgtgtgtccgatctcacacagtatatgtaaagcccttcggtggcgagggggacatatccgtagaagctctctgtattacctcgagattatctgtaatggtgtcagggcacacagctagggtgatcaatgacacacttgttgattgagcagaagggaagaacgaagaagaagaaacttaggggctcacaagtaggggggcgcggaaaagaggaa

SEQ ID NO: 691597 - DNA, 590 bp, Homo sapiens
atcagcctctcagtctgtcctgcctgtattttgtcctccctcccagcaaggtaacctggatttaggttgtgttttgctctatcttagagcactgcaggcagttgctctgcttcagtccttgagacctaagcctttaggtaatgaagataatactgataatgatggtaatacaattggttcatttattcagcaagtatttattgagtgcctaatatgaaccagcatattctggtcactggtgactccaataatgaacaaaaccaggttcttacctgattgtgagagatggacactagacaaataggcaataaatatatatgtcctacggtaataacaaaaataaagcaaggtcaagaagatacaggaggatgtgggattataggccaaggtgctattttatatggagaaggtcaggaaagtatcacaaattgggtgatttttgaacagagacctggagtgatgtagtaagcacttagcaacccctcttgaaagtagaacatttagggaaaggaggcagagagcacaaaggccacagagcctgcaatgtttggggcatatttgaggaatagctggaatgaattgggtaccga

SEQ ID NO: 691598 - DNA, 89 bp, Homo sapiens
cgcggagagtgagggccaagtctgccctgctccgccacttagtgccgccccagacgcttccctcggggctgccaccgtggtcgggcgcg

SEQ ID NO: 691599 - DNA, 95 bp, Homo sapiens
aaagttttaagtggaaaactggaagccccaagtccgggaaggcgaaaaaaaaaataaagaagataggggaatttgaagataaaaacctcctttta

SEQ ID NO: 691600 - DNA, 815 bp, Homo sapiens
gctccacgagggtcatgctgtctcttactttcacccagtgaaattgagctgcccgtgaagaggcgggcatgacacaggcaagacgagaataccctatggaggctttaagtttattaatgcaatacagctacctaacaaagccaacaggtctcctgaaccttaccgaaacacttgcatgtatgaaattgtcggctaggttgcgacctcgagagtcagaagcccaagctaccgagcgagtgtacatgctaagacgttcaccgaggtccatgagcgacactacgtatactcaacttgatccgagatgaacttgaccaatcggagagcacgttaccctagaggataagcagaggcaatgcctattctagagttccatatcgacaatagggttaacgacctcgatgttggatcaggacatcccgaatggtgcatgccgctattaaaggtgcgtttgtctcaacgactgtaacgatccttacgtgactctgagattcagaccagagacgtaatccaggatacggtttcctactctcacttcaaaattccctccccttgttaccggaacaggggacccacgcaggacacattcaatggggaccctaaccgtttcgaaccacagaaagcctgcccctttgcccccccccggtaccacgttgcaagtaattccgagacactagacacactaatcacaccgacccagagaacaacaacaagcgaaatacaacgacgagagaagaatcagcacaagggaaatgaatgcgaccacaatgtgtaggaacgagagacgaacaaaggagagaaggaggaaaagcagaaaa

SEQ ID NO: 691601 - DNA, 289 bp, Homo sapiens
  misc_feature (73)..(73): n is a, c, g, or t
  misc_feature (82)..(82): n is a, c, g, or t
  misc_feature (221)..(221): n is a, c, g, or t
  misc_feature (253)..(253): n is a, c, g, or t
taagattagccattctctgctgctatttccctacataatgtcaattttaaaccataattttaacatgattganatgtacttnaggcttttaagttttaattgagaaaagactttgcaattttatttaaggatgagcctctcctagacttgacctagaatataacatatccctccagtaatactgaagagcaaaagagaggcaggtttggggtcacagccgnttcttcagcatggcccaagtgggccttggggnttgcagcgttctcgaagtggctgtaggcctcgaatt

SEQ ID NO: 691602 - DNA, 126 bp, Homo sapiens
ccaaatgtgccaacgcatgatttctttgagtaaatttctaaacgtcacagaagtttatgaaacaactttgtacactcaaagaaatacatttggaaataaactctgtcgatagtttatgcccattta

SEQ ID NO: 691603 - DNA, 412 bp, Homo sapiens
aaattttggacttttttattattcttactagctgctattcaatatatagtcgaccatttttaatttcctggtatcaactgctttgtgagactgaattcttgcaattgcattagatattcaagcaaatatgactcactcatttcttgtgggtcgctcttcctcattctctggaagaggatcattactgaaacaacatgagactatattatcatgtgcttttaacatctgtgaggatgacaaggactagcaaataatatctcactttcgcatttaatggttggattatattttaggcccttcatgactatgtcgcagattatcaacactttataattatttctcccattttattgtgtttgattgcagtacaatggatgtactgggtgatttctttaaaagatcttaactctct

SEQ ID NO: 691604 - DNA, 340 bp, Homo sapiens
  misc_feature (160)..(160): n is a, c, g, or t
  misc_feature (244)..(244): n is a, c, g, or t
  misc_feature (264)..(264): n is a, c, g, or t
  misc_feature (296)..(296): n is a, c, g, or t
ctttttgagacgaagttttgcttttgtcacccaggcttgagtgcaatggcacgatctcggctcactgcaacctctgcctcccaggttcaagcgattctcctgcctcagcctctggagtagctgggattgcaggcatctgccactatgcccggctaatttncggtatttttagtagagatggggttttaccatgttggccaggctggtctcaaactcctgacctcaactggtccacctgcctctnctttttttgttttatttttnatttttttgttttgaaatattaatagcttttnatgttgtatttttaattttttgaaaacttccatactgttttcca

SEQ ID NO: 691605 - DNA, 342 bp, Homo sapiens
tactgacaacatgatcttatatatagaaaaccctacagactccaccaaagaactgttcaaactattaaatgaatacagtgtatgtgtatgtgtgaatatatatgtgtatatatgtgtgtgtatatgtataagtatatatgtgtatgtgtgtgtgtgtatatatatatgtgtgtgtgtatatatatatatatatatatatatatatatatatatatataaaatcctacagactccaccaaaaaactattaaatgaatacagtatagttgtaggatacaaaatcaacacacagaaattagtagtatttctatgcactgttaacaatgaactatgcaaaaaaaaa

SEQ ID NO: 691606 - DNA, 417 bp, Homo sapiens
  misc_feature (279)..(279): n is a, c, g, or t
gcgttacagtgtctccttcgcgttctccaggtatctgcgaagccactccacgcacgtgccctccaggtaggctctcagtgtgctcggcctcacggcccgcttcccacttgcgctgggtgatctaacccgcggtgtccgcggcggtccagaagcacaggtcctcgtccaggccaatgtaaccctcgccgtcgtagcctaccgggtcatgcccgcgaagaaggcgcccgtcgggccccagttcacagccatacatcctgtgaataatgtgagacccgggcncggcccccgtggccagccccgtccccagagccgcgccacagccgcgcacaacccgcgggaattgtgcgcctaactctgaatatgaacccgggtaaaggtgtctggcgctctccgcggtagagtgtctgcgcgcgtgcc

SEQ ID NO: 691607 - DNA, 323 bp, Homo sapiens
tggcgcttagccagcatgcccggcctagattctacattcttgaatcttcccttctattcgtccctatctcccattctttttttatattttgagatagagtcttgctctatcacacaggctggagtgcagtggcgcgatctcagctcactgtaacctccgcctcccaggttcaagtgattctcatgcctcagcctcccaggtagataggactacaggagcacgccactgtgcccggctaatttttgtatttattggtagagacagggttttgcctcgttggccaggctggtcttgaactcctgacctcaggtgatccgcccacc

SEQ ID NO: 691608 - DNA, 167 bp, Homo sapiens
tgagttgaatgtgcatcccagaccctgaattcccagtaacctttgaccgcttttgtggcctcatggttcaacttttacgcaagctcagtgttcgagctgctgatgagcccccagaatcgggtcgaactcggacgtggttcctctatagtcggggctgcggcctcaat

SEQ ID NO: 691609 - DNA, 1081 bp, Homo sapiens
ggcgcccagcgtccagggctgcgcctgtcccgtccaggcctgtggacactggttgcaaacacctgtgacttgcatgtgtgccgcgcggggcacagctttgcagtcgacaccatgtaggcccccatcatgccgaagattatccatacctgaggcagcggtcgggtgagctagaagcctctcagtcaacacacctgtggacatctgtgacacctggccagcacgacctgtggtcgcggactgtgcgtctgcttgcgatcaggagctcgcattaccttcacgcctggtcatagacagccatgaatccggacgaccataacatgccccttgctggacaggagcagatggctcttaggctccatgagaggcgcaagtcccacgcggtgcgtgatatcgagagagtgtgcatcccttggagtagatcaaggcgagcgagcatgctagtagacgcggggcttgcaatgggggcaatggagagcaagaggtcctcagtcatcctgatttgccgtcgctggcactctgggaaaggcatctttgcgacgtctgcgaacggaacacatgatgcgagggtccagaacggacagcgtcagaatcttcaagggtgcctggagagtctcgtgagacccggacgagtcatgagtagtgactcagtcactactgcagcaagggggaaggtgggccctgccccccgagggctgaagactggcgggagcgcgccggctgggaaaaaccaaattttccgcttgcgcactggcgcaagccagcgcgtcgcttctcgtggatgctgcggagaataaactcgggggggaaccccgggccgaaccccgcacaagggtggtaccgcgcctccaggccgggaagctggttgctgggcgaagaagggcccagggccacctggtgagcccaagaactggaagggcaaaaaggggccccctgccaagttgttcccaacccaaccaaaagggtgtggtggcccccagaggggactattccttgggcacacaagcacaattgctgggactctcaaaggccccagggcccccctctcctggcccaagcttggtgacgcaggggggaactcctg

SEQ ID NO: 691610 - DNA, 172 bp, Homo sapiens
ggatttgctggtgcagtacaactaggcttaatagggaaactaaataaggcacagaacagagatacgtgcacttccagacagagaattcaaaatagctgtgttgaggaagctcagtggaattaaaagataacacagaaaaggaattcagaattctattgaataaaaaaaaaaa

SEQ ID NO: 691611 - DNA, 272 bp, Homo sapiens
ctttgttttttttttttgggacccctgtggaccccccggggccggggttttcccccccccctttttcatttggggggactgaattcccaaatttttttttattggaaacggctttttttggcccccaaaccccttgctaggggtttatttttaaaaaaaaaagcccgggggggggggggaaaattttaaaaatgtttttctttccaagcttgcttttttttttcctttggtttttaaggcccctaaaaaaaggaaggcccttggaaacccca

SEQ ID NO: 691612 - DNA, 317 bp, Homo sapiens
agcttattctaatgcagactgactcaggaggtctggggtggggactgggattctgcatttctttcttttctatttatttatttttttgagacagggtcttgctctgtcatccaggctggagggcagtggcacagtcttggctcactgcagcctccatctcttgggctcgagcaatcctcccacctcagcctcctaagtagctgggactgcaggtatgacgaccacgcccagctaattttcttttattgtttttatagacagtgtcttactatgttgcctggctggtctcaatctcctgggctcaagtgatcttccca

SEQ ID NO: 691613 - DNA, 355 bp, Homo sapiens
  misc_feature (13)..(13): n is a, c, g, or t
  misc_feature (149)..(149): n is a, c, g, or t
  misc_feature (300)..(300): n is a, c, g, or t
  misc_feature (323)..(323): n is a, c, g, or t
  misc_feature (352)..(352): n is a, c, g, or t
atgttattgaagntgtttatagtagacttaatccacacaaagacaatgatgggggcgctggcgatctagaagactcattggtagccttataaccttctaaaatgcttttgattctgaaaattgggggaaacttttaatcacattttctncaatacaaggggaaatattcttgtgaattcacactgttttgtgatatgagcagaaaccaattagcatttcccaaccattgcctcccatttgtgttccccgtacttaccactcttaagcattgcctgggactctacagtattttttgccaanctcaggcatctgggttacaactngtattgaatttttggcccctagaaaaacnaga

SEQ ID NO: 691614 - DNA, 382 bp, Homo sapiens
  misc_feature (99)..(99): n is a, c, g, or t
  misc_feature (327)..(327): n is a, c, g, or t
actgagagagaagaaggatacagatccatagtgacctctctggcacatgaggcagttctcagtctgtggtcagatgctgaagaatctgaggcatcttgngacatacaattagagtgtgggatgttgggtttgggaggctaaagtcactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctanccatgaacagcagctgatttcaggatctttagataacattgttaagctgtgggat

SEQ ID NO: 691615 - DNA, 106 bp, Homo sapiens
aggatattgcgaaactacataccggtcgactgctcgaagatgccgccgatcaccatcgtacgccgtggtcgaccagtacctgggtcttcacgtgctatagtgttga

SEQ ID NO: 691616 - DNA, 310 bp, Homo sapiens
  misc_feature (59)..(59): n is a, c, g, or t
  misc_feature (112)..(113): n is a, c, g, or t
  misc_feature (162)..(162): n is a, c, g, or t
  misc_feature (243)..(243): n is a, c, g, or t
  misc_feature (300)..(300): n is a, c, g, or t
  misc_feature (302)..(302): n is a, c, g, or t
  misc_feature (310)..(310): n is a, c, g, or t
aaaggcgcgcctccatttctgccagtgatgtcttccaaggcagctttcatgctcagctngtgactgcagctcaatctcatagaccctgattggtgcgccgcaggtcagtggnnctcggactcctcatctggatgctgcaaaagtgtgggccagcgatcctcnccggttcaattcttcaagtccggctggtgataccaggcttcagcatccttccggttcctgctcgggccatgacctcatatntggcttcgcatgtcaactcaggatcttggccgagatcggtgcccggagcggaatccnancttccacn

SEQ ID NO: 691617 - DNA, 712 bp, Homo sapiens
gccgcgcggggggcgagtaagccagcggcaggaccagcgggcgggggcccacgaactgaaagctggcgaggcgtgacagaggcggcgctcagggacggacctgtctggctaggtgaccgattgtgcgtgtggttttcccggactgtggtgtaggtgtgagatcaaccgatggagttccgttgcacgtttagaccccagagaggagtttgtgctgaatcagtcgcgagagatgggcctgggttccgtcatacatagagtcaaacgttgcgcgaactgctaagatgtgcagaaagaggaagagcgatcgcctccaagcgctagcaagggatgccgttgccctcgcaggttccgtgcagaaagctgacttggcctggaagagtgcccagggaacccgtctgggagcctggggggaacaagatccgagccatcgaagggcttctgtcatcactcaggtgtgccatgtaccccgtggaggagagaagagtacgaggatatgaagcagtgtggagaaggtgaggagatgtaaaaggtctggcttgagtatcatgcagacgaacgggtgatcacttggagttgtgtatggcgcaaagaccaaggcctctccgatcatggatgtcaggaaaagctggatgcgtgtcattgaaagcgacggaaaggacatgttggataggactggaagtgctcaccgcctcaaccagtggttgggcactcc

SEQ ID NO: 691618 - DNA, 462 bp, Homo sapiens
  misc_feature (100)..(100): n is a, c, g, or t
  misc_feature (102)..(102): n is a, c, g, or t
  misc_feature (104)..(104): n is a, c, g, or t
  misc_feature (161)..(161): n is a, c, g, or t
  misc_feature (165)..(165): n is a, c, g, or t
  misc_feature (360)..(360): n is a, c, g, or t
  misc_feature (364)..(364): n is a, c, g, or t
  misc_feature (371)..(371): n is a, c, g, or t
  misc_feature (377)..(377): n is a, c, g, or t
  misc_feature (429)..(429): n is a, c, g, or t
gaatcagactccagtgaggaggcggcggcggcccaggaacctttgcagttaaagaacgggacagttggagggcccaggccagcccccattaatggccctngnanccgggtggccgggggtttgaccaacaggcacacaacagccacatagccgggcggggntggntgtaaggggttgcccccccgccagtgccttggatatttttggggtgattggactggcgcccctgggccccctttttggaaacaaggaagggccccacccggggtgggtgggaaggtttatgatttgtttccagccccttctttttgcccacccgccctttttccctttgggcaattggacaaatttgggagccancagntggatgntgtggntggccaaaaacccctccaggctgtagcctgggggttggggggagccccaggntgaaaagggtccaattaaaacaaatggagccca

SEQ ID NO: 691619 - DNA, 305 bp, Homo sapiens
cgaataatttccaaagtaccaaatgatactggtaaatcattctcggcaggcgcggtggctcatgcgtgtaatcccagcactttgggagactgaggcgggcggatcacaaggtcaggagattgagaccatcctggccaacatggtgaaactccgtctctaccaaaactacaaaaattagctgggcatataagcgggcgcctgtagtcccagcacttgagaggctgaggcacgacaatcgcttgaacccatgaggcagaggttgcagtgagccgagattgctctactgcgctccaaagcctgttagg

SEQ ID NO: 691620 - DNA, 365 bp, Homo sapiens
atcgtctcggcacatgctgaagcacagggcaagcatatcgtgcgaaacagagtctccaggacggcagcgtaagaggtagtccagcagggctgtggtcagggtagcactcggcccagaataaaagggaaaaagcaaggtgtcagtctgggacggcaaggcagcagaggactcagctgagtcacctagtccggcattccttaaaaactcccaagaagaagaggagcagcaatgagaataaatcacgagtttcatgctgtcccacgtatgaggaaacaggcatgtgtgctttcctgttggcagtgtgaaaggcaaaactttttctaaagggagaacactttaaaatacacccgcataagctcgtcata

SEQ ID NO: 691621 - DNA, 515 bp, Homo sapiens
  misc_feature (17)..(17): n is a, c, g, or t
  misc_feature (259)..(259): n is a, c, g, or t
  misc_feature (354)..(354): n is a, c, g, or t
  misc_feature (476)..(476): n is a, c, g, or t
taagcggtttaagaggnccgcgtccagcccaagaatgtggatattctctccctattgaccaaagtgggtgggtttcttcagaaaagccccaaaggcagggaccagtaagccccaaggttagaagtggaactggaaggcttaagtaaaatgcggcttccacgcttccaggctgggcagcaaggaggagaggcccataaggtgccaggcctccccatctgaaaccagtaaagtttggaaggacagccgcggcacgcctgcntttcccagggggccaataatggaagggagctttccagggtcagagggctgagtccggaataggagcgggggcagggccctgcggagaggcacttntggcctgaagaaagccccattgagcccctccagtccaggtgtggtccctaggaccaagcccacagcctggaaaggggcgcctgcaagggccacggccaggaggaattccccgaagccttgcncccctggggcagcagggctgtgggagggggtgacattaa

SEQ ID NO: 691622 - DNA, 228 bp, Homo sapiens
cgctttttacagcgcaggatgctgtggaggcgttcctgctgactaaacaagtggctagcagtagccagagcacttgtcacatacatgccacttaaagaaatcatgcaagtatcaacaaactgttggaccctaaatagtgttaccgttctcaaaagttggttattagcactttaacaaatagctctcataacatgctggcccatgacttcaactgaataaggacacacc

SEQ ID NO: 691623 - DNA, 189 bp, Homo sapiens
atgacacctgcggacggatagagtgcccagctcgcgatgccccaggcgcacctcaatatctcattccctgaatcccgactattggtctggccctgacgtaacccaacaaaacccaaatttacttgctcgcatgaaggagtctgattcccacattgtggaaccctaacttaaccaaaatgacccattaga

SEQ ID NO: 691624 - DNA, 167 bp, Homo sapiens
gcagaaacacaataaacatacaggaaaatagtatacaaagcatccacaagatgtacaccatgtacaaataggatacatacataaaactctactacctaaacccagaaaactatctattcagataaaatactttactctatcatagttacagcatataattcgaatta

SEQ ID NO: 691625 - DNA, 140 bp, Homo sapiens
tgacgtatatacaaagtgaaataatatagagctccattgccaacataaggagctacataatttctattacgcttgcctaggcatgagaaacgcaaaagcaactcaagaggagcaagtccaggaaaagaaaagctatgaag

SEQ ID NO: 691626 - DNA, 564 bp, Homo sapiens
aatgatagaatcgagctgtgtaccgacagcatcctaaccagaacagagtgccgtgcaggcatgctgtgggtgatcaggccacgtttccactcagatggagtggggcaagttccaaagactagtcttaccaagtcaagccaagtcaaaaccagaacaaaagtgccaatacaggcacaccgtgggtgatcaggccacgcttccactcacgtggagtggggcaagttccaaagactagtcttaccaagtcaagccaagtcaaaaccagaacaaagatgtcaatacaggcacaccgtgggtgatcaggccatgcttccactcacatggagtggggcaagttccaaagactagtcttgacaagcttcagatgtctggacttccaagtgccatttccttcccgggtgtacagccagtgttaatccttctcgggagcctgctatgcgctgctctggcaaggcgttcaactgggggccattttcctacccgggagcgcctctttggatttgcgtcactcaggctggccggagtcctctgcagggacgctccaacgggggcccacagggcttg

SEQ ID NO: 691627 - DNA, 626 bp, Homo sapiens
  misc_feature (299)..(299): n is a, c, g, or t
tctctctctctctttctgctgtctacttactacagacaacttagcaaacattacccagataagatatggaagaaattgaaactggtgcataatatatactgattggactgatggaattataacaagcatatatagaatgactaacctatacttctgataatgaattaatagaaataactttgaatgagagccaaagctaagaccccgaaaccagacgagctactaagaacatgctaaaagatgcacacccgtctatgtagcaaaatagtgggaagatttatagtgtagaggcgcacaanctaactgagcctggtgatagctggttgtgcaagatagaatcttagttgaagtttaaatttgccgagagaaccgtcataaatcgcgttgtaaatttaagtgtttagtccaaagaggaacaggtctttggacagtatgaaaaaaacttgtagagagagtcattttaacaccgatagtagtgctatatgcagcgacgaattaagaaagtgttgaagctcaacagccagtaacttatagaattccaagatattaatttaattcgttacaccaatttgacaatctatcacgctattgagaagtaatgtaagttaagtatggatctcgtcgct

SEQ ID NO: 691628 - DNA, 388 bp, Homo sapiens
  misc_feature (151)..(151): n is a, c, g, or t
  misc_feature (193)..(193): n is a, c, g, or t
  misc_feature (265)..(265): n is a, c, g, or t
aaggaaaatccatatatggagacatctgcacctgccatgctcgttccagcactattcacagtacccaagattggaatcaacctgtgtctatcagcaaatgaacagataaaatgtggtatatataccccgtggaatactatttggccattanaaaaacagaattctgttattctcagcaacatgtatgatcttngaagacattatgttaagtaagccaggcacagaaagataaatactccatgtactgtacttatgtggaaggtanaaaagatctcatagaagtagagagtggctcatgcctctaatctcggtgctttgggagtctgaggtgggaggatcacttgaggcctggagtttgagaccagcctgagcaacatctctcaaaatt

SEQ ID NO: 691629 - DNA, 473 bp, Homo sapiens
  misc_feature (5)..(5): n is a, c, g, or t
  misc_feature (27)..(27): n is a, c, g, or t
  misc_feature (64)..(64): n is a, c, g, or t
  misc_feature (111)..(111): n is a, c, g, or t
  misc_feature (126)..(126): n is a, c, g, or t
  misc_feature (151)..(151): n is a, c, g, or t
  misc_feature (473)..(473): n is a, c, g, or t
acccncaaaaccctacctccccgaagnagtttggggccctaccgtttttaaggggttttgggantggggttgaaagtgttaccagattggaacgggtccaaccgaatgccngggtaaaaccccatnggacagggaaaatgaagaaactatnccttaggcctgattcggttccttcctgtgagggtcctttaaactggatggccctcagcctgttaaattggaattcaggatcctacttaaacaattcttaaacaaaagcctcatgattcctaacacccagagatcccaatctaaggccagaaatactatctataggaacaaccaggatgcaaatggtcagtatccagtgttatgtgactttcagttacaaggaagtgggtcaaagcacagactgaataatgcttaattatagctatatttctgtctagaattctttttaaccctgtgaacatggcttcagcaggaaacaatan

SEQ ID NO: 691630 - DNA, 219 bp, Homo sapiens
agattttgaaacctactcagcaaggtgatagtattagaaggggggggctctggaaaggctccaccttaggaaagtcatcagtggctcagaaaagagtgcccagagagctggctggcctttccaccccatgagaacaggtggaaggcgccatctattaggaatggccgtccccagactccaaatcttgtgggaccttgatcttggacttcccaggctcca

SEQ ID NO: 691631 - DNA, 426 bp, Homo sapiens
aaatgacttgtgtctcagcttcttcatctctaaaatagaaatagcaacaaacccttccttacacacagaatggttataaagattatattagataatatatgtaaaacatagattgctgtctggcacagagtaagcactaagtaaataaaacttcattgattatttaaagaaggtaaaacatggttatcttaagagatactgaaaattttaggaaataaaaattcattgttaatgaagtccttagtaaccaaagttctttagcttgataaagggtgtctcttagtatcttatttcaaacactatatctgatggatatactacacctgtagtcccagctactactcaggaggctgaggcatgagaattgcttgaacctgggaggcagagattgcagtgagctgagattggtgccactgcactccagcc

SEQ ID NO: 691632 - DNA, 373 bp, Homo sapiens
gtaaatgaaaaagaaaataataaggtaaacgtaaagagagcataaaaaaaatgataaaaataaatcctaaaaagacataagaaagagaaattttaagagagaaacagaagcttgaagagtaatagcaaaaaataaagaacgaggatcagcgaaaaggaaaagacagaaatatgggaatgagttaaaagaaaaaaaaaggtgagagtgttgatgtaattataggaaacgacacgagaaaatttaaaaggaagggaagcgaaagagaaaaaagaggaaacaaaaggaaaaagggtgagaatgggagaacacacaatctctctctctctctctctctctctctctttctctctctatctctctcaacgtgcgaaat

SEQ ID NO: 691633 - DNA, 1309 bp, Homo sapiens
  misc_feature (333)..(333): n is a, c, g, or t
  misc_feature (750)..(750): n is a, c, g, or t
aatatgatacaagtggtaaataaccaccctggtgataaactcgagtagcgatcacggcggcgttccttgcggtccattgatccagttgcataagtcgaggacgggatggtccatacgtatcgtgcacgtatcttcgtccgcgagttcgcttgaggcgtgtcgttggcgagtgctaccctgataagcgtagcgtaagagcgaggagcgcggagatagtctacgaaagctagctcgacgctgtgcgttcagagcgcgcacagtctccggaagtgatggagagggcctcatctcgtgatcactcgaacgaccgtgatgtcgtggcatgtatgtctngagtgccacgccctagtgacaggtgtaataatgtaacttaatcgcatcactcgagtgctatgcggggaatgaatcagtccccgataatgggtgaacgtgtcacatagatccgggggataagaagcaatgaatggatgttagcgatgaggataagggtaatgggtcttggaggcatatgaatatcgaaatgtatgtccttctcctaaggaggtgttcctcgggacgtagatgcgagaacgaaattaattattgtcaccaaagttaggggagattataacggttagcaggcaacttagcaataaatttacgaccgatctcgactaactcatgagatcatcgccttattcccgacacggaggagtcaatgagatattgtggaactggactcgaaccatgacgtcgcacggaaaaagccanatcatgcaagcgtggaatgcgtgacgtgttcaaggggtgcttgcctggacgttgcactgagggcaattacaatgcttctctcatgtatatgcgaacgcggaaaggggttggagtggcatggaaactggggtaaatttggtgatttaaggcagaaaacgtaccaattgcagtaaggaaacattccggttaactggaggagcggaactggtgttacacttaccgatttggtgatgggataaaacttcatactcaaactaaattgggttgcacttaatttcacaataaggggaagggcctggtaacattttaaggcgggagtacgaataagggaaaagggggtgtcacgagctgtgcaacttttgggagatattgggcccacgcgtagtataagtaaatagggctataaatggccgggtagaaaatgcgatggatcctgtataggcacagagaagatttccgagtttacacacagttacttgggtaattattcagattgcgtgggagggtatagatgtgtgttatcatttgtgtgtgttccccataaatcagggtatatgtc

SEQ ID NO: 691634 - DNA, 363 bp, Homo sapiens
  misc_feature (250)..(250): n is a, c, g, or t
  misc_feature (259)..(259): n is a, c, g, or t
  misc_feature (274)..(274): n is a, c, g, or t
  misc_feature (306)..(306): n is a, c, g, or t
  misc_feature (353)..(353): n is a, c, g, or t
gcgtgggaatggctgcattgtgatcgagggggttgggccgcgcggaaactcacagcacagccctgcgaggagtctgtaatgtccgccatgttggccatggcgtattgaaccagggaggaacagcggaccgcggagaacagggagaccgaccgacagcgaccgacacccgggcctgcgcggctccgttcgcaccgcaccttgaagcccgccgtccccaccgatcaattcacggataaacaccaatttcctncatgagatnctcggagcagggttnctgttcatcttggctttggatcgcataggttnatgctgcgctgcatattgtagagaaatgagtaaactgttgttttcgngcccgggctt

SEQ ID NO: 691635 - DNA, 194 bp, Homo sapiens
  misc_feature (169)..(169): n is a, c, g, or t
aatgcagttaatacagactcattataaaaagtacatcatggtttcatggaaacaatgccccaccatgggtgggctgcctggagatggatccctttccaaaaacctgaaaatgcagaatggaagatgacgggggtgaactggacgtgtgtgtacggggtgcaggtgtcancttcagcagaggttcccctgggttt

SEQ ID NO: 691636 - DNA, 740 bp, Homo sapiens
  misc_feature (174)..(174): n is a, c, g, or t
  misc_feature (176)..(176): n is a, c, g, or t
  misc_feature (212)..(212): n is a, c, g, or t
  misc_feature (223)..(223): n is a, c, g, or t
ggtatctcctgttaactgttggaagatattgatgaggttttatttttccctgttttctttttccttaagtcactattgaggctgctctggtttgttgtgggtttttggcttttgtcagccttttctgggctatgcagtgatgttcttgtgcctgctcgtgagtcagagggcctntnagcctgtgtctgtggctgactgtggctttcactcanaggcacctggntgggccatttccttacagcacccttgtcagcttctttgggtttcttcagattccccagagaaatatcttgtagccctttgcctggctgagtggccaagtgaggagagaggcctgggagcacagcagtaaccataaaagagcttacttccctcttttcagaattgtttccctcctctgtaactggtgtccccagtccaaagattctacttccctttgcagacagaaaagcgatacctttttgccaggataggagagggactgtgcaggttggctctgtgtggctgtgcagagttgtggggtgcatcttagggatcttcgtgccttttaaacctatcagccaactctgtttttaattcaggtctcctggcttccagtcatattgccagttggccttccccattgccgatacaggattcagcccttttaggtctgtttccagtttctagcctccagtattttaatgttcttatctctattcttattctttgctttcgtgatttgtatcttaaaaaaaaaa

SEQ ID NO: 691637 - DNA, 462 bp, Homo sapiens
gcacccaggaaaaaggccccaaacccattggggcccaacagcgccggcacctagccagggcgtaaggtgaatgtgagcccctgccgcactaagacatatgggcggattgtgtaggcgaacgagacatcttggaactggacctggtcctccatgtgtgacggagctaacacaccactgggtgtccagcaagaggtgcatcccaagcactaatacattctctctgaagagcccacagacttctgtactgtggggtacatggaaagcactgcctccacagtctgggttaacagcatctggataataacaaatgtcacaaggctgccattgcttacagtccatctgattaccaggtgccctctaatgtacaggatggccactttcataagcatacctgacacttataatgacaccataaaaaattggactgtagtctagaaatctggaggggacacaacgaaccgc

SEQ ID NO: 691638 - DNA, 213 bp, Homo sapiens
ttttgggaaaccgggggcccctttttttccccttttaattttaaattattggggtcaaccatttccgggaagggaggggttaattttaggggacttttggggccctttggggaatttaagggatgggaggggtttttacaggggtccggatttggccccaaccggggtattgggggtatccagggttttgaaataaaatttaaaaccccccca

SEQ ID NO: 691639 - DNA, 117 bp, Homo sapiens
gccccgtgtcctgtcatccatgtggccgtccatgtggtcacttttgggcattgccctgcgcaggtccatggggactgggcacctttggcattctttctttggttgtctgtgcaagta

SEQ ID NO: 691640 - DNA, 203 bp, Homo sapiens
aggtagcccggcggcgccacccactcccagggagaccaaaagccttcagtacatctcaggtggggggacaaaaaagggggaggggggggcacgaaggctcatcattcaaaatagaacagaataaaaaagtattaaggcgaagatgaaaaaaatttggcattacataattaacacgaaagcaatgctatcacctcccctgtgtg

SEQ ID NO: 691641 - DNA, 396 bp, Homo sapiens
  misc_feature (1)..(1): n is a, c, g, or t
  misc_feature (45)..(45): n is a, c, g, or t
  misc_feature (259)..(259): n is a, c, g, or t
naataaaaagacgacagagggtacggccgagaagacgacagaggnacagacttaagagagcaaaatgtaaaacagtgctactcttataaatattctttcctttagaaatttattttgaggccaggcacggtggctcacacctgtaatcccaacctttgggaggctgaggcgggcggatcatgaggtcaacagttcaagaccagcgtggccaacatggtgaagccctgtctctactaaaaatacaaaaattagccaggcntggtggcaggcgcctgtaatcccagctacttgggaaactgagccaggagaatcacttgaacccgggaggcggaggttgcagtgagccgagacagtgccattgcactcccgcctgggcaacaaagcgagattcgtccc

SEQ ID NO: 691642 - DNA, 249 bp, Homo sapiens
gtcgacccattaggctcttctgaagtggaccctgtgatcccagatcaggtctgttctggtctactctattctgccacaggtacagcatgtccccactaggtggtcccattagaccgaaatataaggccagggacctaaaggacactactgtaagcaacattaacaacacacacacacacacaccacacacacacacacacacacacacacacacacacacacacacacacacacacacacacgtcgacg

SEQ ID NO: 691643 - DNA, 152 bp, Homo sapiens
cccgcagcctgctcgcgcgggtcgtgttcccggagatcggcatcctcaccagagcagggcgaccatgtgcgggccaactggccaatcacgaaaccggccctgcccctgcctccacctcccgcgaagctcggcgacgaagcgcacgacatcgc

SEQ ID NO: 691644 - DNA, 725 bp, Homo sapiens
ctcgccgcgttcgccacgggctctgccagcagacagccttgtgcacacagtgcacaagggctggagcccagagatgagatgtgcccaagggagatgtgagcctggccgggctgccctgctaacctgtcgctgaagccccagaagcgggccctcaggccagtgcctaccctgcctcctggcccagcatgcgcctgtctggtgctggagggtgctgctggccatttcggctgcgccctggtcctgtgtgctggcggttcaggctgggacagcaggtgctagagtgccgggcggtgctggccgggcctgctggagccccccggggggccatgcgtgctgagcagagagagagctaggttgattggtgaggcacacaacacagcggtggaaaatacccgatatggcacatgcccatgccagctcaatcatatcgtggagttgtccagttgcctcgcaagttggcaaccaacgattgatgcgcgccaaatgctggaacagccacaacccagaggggttgcggcatgggtcgcgaagggaagaaacacgcagtcaattcccgagtggcgattgactgagccaaatgctacccatgggccattggatacaaaggttcgtgggccggaggacaaacccttggcgaggactgggacttcacgggccggggggattgaacgagatgacaggttacaaggaacggacgaccaaatgctagggacataaccatccag

SEQ ID NO: 691645 - DNA, 318 bp, Homo sapiens
gttatgcacaactagggtcagtcttgcaggtgagtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 691646 - DNA, 472 bp, Homo sapiens
caggacctcacagtgatcatccggcctcggcctcccaaagtgcttgggattacaggcctgagccacggcgccgggccgggttggtttttggtttttggagatggagtctcattctgtggcccaggtgggagtacagtgatgcaatctcagctcactgcaacctcggcctccggggttcaactgattctccttcctcagcctcccgagtagctgggagtacaggcatgcaccaccacaccgggctaattttggtattttttagtagacacagggtttcagcatgtggctcaggcgggtcgagaactcctgacctcaagtgatccacccacctgggtttcccaaagtgcggggattacaggcatgagccatggggcgggcctgtttggttttggtttttgagacaaggtttcgttgtcgcctaggctggagtggtgcggtggcgtaatcatagctccctgcagccttgacttcc

SEQ ID NO: 691647 - DNA, 420 bp, Homo sapiens
gggatctggctcccactggtgcagactgtggaggtgctaggagggtggcttgccaagagagggcttggaaactctgtgcccctatactttgccctgtgcatctcttcatctgtatcattttaaagtccttcataataaactggtaaacgtgtttccctgatttctgtgagctgttcgaccaaattaatggaacccaaggagggggtcatgggaactccaatttataactgatcagttcggagcacagttcacaacctgggactttcaattggcgcctgaagtgtgagacagtcgtgtcgggactgagtccttactctgtgagatctgacactatttagaggtaaataatgtcaaaatcgagctaaatcataggacacctagttggcgtacacaggagaataacttcggcgtactggggaa

SEQ ID NO: 691648 - DNA, 889 bp, Homo sapiens
ggcaccaaagcagtgcttcctggctgagcacggtggctcatgcctctaatcccagcactttgggaggccgaggcgggtggatcacgagatcaggagatcgagaccatcctggctaacacggtgaaactctgtctctactagaaatgcaaagaattagccgggagcggtggcgggcgcctttggtcccagctactcgggaggctgaggcaggagaatggcgtgaacccaggaggcggagcttgcagtgggccgagatcgcgccactgcactccagcctgggcgactctgtctcaaaaaaaaaaaagcgggcttccagacaccaagaagaggaaaggagccgatgtgactcacgcctgaatcccaggcttgggggaggccaaggtggggaggattgcttgaccccgggaggttgaggctgcagtgagctgagatgtgcaccattgtaccccagcctggcgaagagcaagactgccaccgagaaaaatttttttaaaaagatggacaggattgtgggacatgctgccatggggcatcacctgtgtgctgctcacaacacagctcacagtcccctgcctacgtattggattcactactgggtctgcaaggggaccggggatccatctttagagaaaccgcgggaaccagctcggttccctcagggtggccggaccggcattaatgggcccgcgatgtggtgaaagccgctcgggcagggggggatcacctggaacccagctcggagccaggagagactgagccagagtgacaactggaatgaacctgctcgcatagatccgggggcacgacacacggtgaagaaacgaacacaggaatgaagacgacgaaccaaagagggggcaagaagggaggaaaagatcgcagccgccgg

SEQ ID NO: 691649 - DNA, 143 bp, Homo sapiens
tttagaaatccagagtgtatctttgatgatcaccggagttgtgcggcagtggttgagccgtggaggggaaattgagggctttcgccttaacgcccactgctcctgtgacagcaggcataacacactgcaagtggacatcaacg

SEQ ID NO: 691650 - DNA, 291 bp, Homo sapiens
ggggaggcacatactacgactctccgctcagaggcaagacgggggcgtaatctctgcccaattagcagcacgagaacatcagggaaagacaggtgtcacaagacttttcagtccttcctattatgaagcgtctgtgagaggggctgggtcaaggtccctggactctggcttcagggcgcattaggcctgagccaaggcggctttgatgtgcggcaccaacttcagaaacttgctttctgtgttcacgtagacatcggcttcttagagtgaatcaactccccgggatacagg

SEQ ID NO: 691651 - DNA, 356 bp, Homo sapiens
cggaggatccccgcacgtaggcacctggtaatacagatcatttcctggtatgatactggacaggacaaaactagtgaatgccacctacaaaaaaatcagaggattcatagaaacctgcatataccaagaccccattgatgctctctcatgagatctggactgctgtccctccactacagaaacctcacagaacacagcaaaggataagtgcaagaaggctgcttccagctccaacagcacctgataatggaggtaaagcgaaggattcacgcatacgactacagaggacatttccaagcccaaagatgactaaagaattacaagttaacgtatctggtatctgcatgtaaaatctt

SEQ ID NO: 691652 - DNA, 126 bp, Homo sapiens
atgctccctgggcacaaatgggcatcaaaatgactgttgtgagaggaacgcaagccgaggggtcatatgggatttaccatggtttagaggctgccctgtcccgcctaggatgctcagacaggcaga

SEQ ID NO: 691653 - DNA, 234 bp, Homo sapiens
gcagcctcctgtattgtcttctaatagttttagttactatatttaggtcattcattcatttttagttaatttttgtacatagagtgaggtaggggtcctacttcattattttgcatgtggttcctagttgtcccagcatcatttgttgaagagattattctctcctcattgagtagtctctggtactctctgtcacaaatcaactgccgtagatttttgggtttatctctgact

SEQ ID NO: 691654 - DNA, 517 bp, Homo sapiens
gagggtggaggcccctgcgtccgagggccctggcgatctctgcctgctagtggtcttgctgtgctcggcgggctacctctggctctgagcctccccgtctctgggtcctacggtctctgccgtttcctctcaggcgcgccctgagtgggggacccgcagggctggaaggaacgcggggctgggtgccgtgccccccagcgctaagtggaaacagactgcggaaaccgacgcccggggcgctgatccctgggctgcccgcttccctgccccgcgccccgcgcgcccctgagggggagggagcgaacgttgggaaggtcaccgccttgtccccgccgagaaggggctgtcgcaggcttcaagccctttacaaccgtcagaggcccgggggttgaaaggcaggcagccagggcccaaggccctgcttgaccttaagccgggacccttgaccttcggcctcgcctcttagcccgaccagcttcaggagcaaggattcgcggccggacccggaaagttgccc

SEQ ID NO: 691655 - DNA, 967 bp, Homo sapiens
gggggcccgccggtcgcaccgtcctctttcctttccttctccctccccttttcccttccttcgtcccttccttccttcctttcgccgggcgcgatggaagccggggcagccggggggccgcggcgcgtgctagcgctgctgtgcgtggccgtgcgcgctgcgcgccgggggcgctcaaatacgaacgctacagcttccgacagcttcccacgggacggagctgatgccgctcgagtcggcctaccggacacgcgctggacaaagtacagcggagagcatctgggccggagagcgtggggctaccctggagatcacgcctgcggggtggcacgggtgtgttgcgccgacgggcggagggcctgtcttggccaaccgcaaggtgaggcgctcgcgccgaggaccgagtcccgccgcgcggctcgccaagataatcccgaagacgtgcgcctcctcggggggccctgctgcggccggggcgcacattgccttaagggcgctggaaaggggggcctgggcaagcgctgtcggggcacgtcccccagaggcccacgcccgaccgaaggagggcgggtgggggacattcgcaaagcagcacggggagaggaccataagaaagttgccttgggcccgggatccggcgtacattgcaggggagatgtagtcctccccccaaaagggcaattccgggcagtggtcacaacccttttcataatggaagcgcctgtctggtaggtcagactggcgcacagagggacctatgggatattataaataaagaggccgcccctgggagccgggagaacaacttaataagagcgggcaccacgattcttagaaggcgtcgccccgaccagcggggaacaccgggaacaggggagagcatcacccaccataggcggggggccactccacacgcaacaatgcgcacagcgcgccggggacaagcagctcatccctctaccgtagg

SEQ ID NO: 691656 - DNA, 532 bp, Homo sapiens
acaagccccctttgtcccacgattcacatcagaaccatctctcagcatccctcctagacaacatctagcccgtcacatcctcagaggccttggtgatgcacgcggacctcccgtctacccttggtctcctctgtctcattctgtctagtgtggcaaaactaaaccagtttctgtcactggcggccttgaccccgccattgcccttctttctcccatcctaagtccctctcctggggggcctgggtaatcttcccccaacaaagtctctcctctccgggccacaccggcagctggctggctttcagcaccacaggttcctgtctgcacaggcttgcttccctgtgcttggagaccctcccagatctccacttgactcagctccgtctctctcaggtatctctctgcccagcggtcaccatacaaagccttcccacctttggaggaacactaaggtcttgaagtgaggaattaagttagcctttttcttcttcgctcccctcttccttgctgataatttcctttgaattttctt

SEQ ID NO: 691657 - DNA, 163 bp, Homo sapiens
tctcagcgaaggtaggtaatggaaatgatttggaagattgatacaaaagaggaactggaacagcataccgagatggggatgtgaagaggatgaggaagaggaaaatgatggagaaacacctgagatcttcacatgaaaaatcataatctgactaatttgggga

SEQ ID NO: 691658 - DNA, 411 bp, Homo sapiens
atggggagggtgttcaggagaaaaccagcagtcacagcagaggacatgcaggaaacacaagcaaaagcatgcgagggctgggggacatgcaaggggggggccagtagaatgagcagtagccgggggggcttggttgggccctgggccctctggggggaatccattcagctctgtctcccttgcatgcccctggcgggcaccaccatccccagccatatctggccggttcgggccagccagattgtctcgaccccattccttgggggtaggagctcagcagcatctcttcccccccagttctaatagaggggaggcggaaggggaatgtggtccaaacccgtccccttctggctgcgattcgtgccctcagttcagtcgggctctggggcacaagccgaggtgattcacttg

SEQ ID NO: 691659 - DNA, 287 bp, Homo sapiens
cgtccctgtgtgttccatgtaccttaagatactttacaaagtttaacgatgataatgtgtgtggtatggtttgggtctgtgttcctgcccaaatctcatgctgaatggtaatccccagtattcgaggtggagcctggtgggaggtgattggatcatgggggtgagttcatcatgaatggttttgcaccatctctttgatgctgtccttgcaatagtgagtgacttctcatgagatctggctgtgtctgtgtggtagctctctttcgctcctgcttatactgtttgaa

SEQ ID NO: 691660 - DNA, 317 bp, Homo sapiens
  misc_feature (298)..(298): n is a, c, g, or t
  misc_feature (305)..(305): n is a, c, g, or t
aaaggtctttttacattgtgaatgctgtgggaagcaattttctctgcacacaaaggctacgtttggaaagtgatgtatgtatttgatgctgaaaaatgacctgtaattgctctaaaagtatattctcttgttgacaaaatttaacttcaaaaaaaatttacaggtacccacccctggttggggccccaagctaaaagccttttaatggacccttgcccatgttccaagtgacaaaactattttaatgttaagcaccatgttgatttccaaggtatttggggtattctattaagggaanctttganctatgtctaaaa

SEQ ID NO: 691661 - DNA, 262 bp, Homo sapiens
  misc_feature (63)..(63): n is a, c, g, or t
ctcattgcatgtagtgaggacacagcgggaggaagattatgatctgctgaggccctctcctanccagattacgatgttatactgatgtgtttttccatcgacagccctgatagtttagaaaaaatcccagaaaagtggacccagaagtcaagcatttcttggtccaaacggtgcccatcatccctggttggggaataagaagggatcttctggaatgattatgcacacaaagggggggagcttagcccaatgattgaatgca

SEQ ID NO: 691662 - DNA, 506 bp, Homo sapiens
taccataggctaagagaacatacagtaacctacactagctatggacacacggaacaagcaagtagtatcaactacagaataccactgacagactcaacaaataacaaaaacactagctctatcagatccatacgaatctaagtgatcttaggaaataccctactacactggctaagcaaccatcttaatcagtctaagtgacgacccgtattagccttcaatctacagatcaagtaaatcaaaactcttacatatattggctacataaaatctgaggcaagtgataatttctctagcaacttattcaacatgtgcaagtagtaaacaataacaaaaaacaccagtaaagtaacacatgaataaaacatatcagaatcagtcatctttaataaatgaacactggatattaaaaaagaatctctatctgaaaaggaatctataggactgaaagaagaaaacaggctacagttaattaaggtaaacgtatagtgtagtccgtcccatta

SEQ ID NO: 691663 - DNA, 108 bp, Homo sapiens
  misc_feature (102)..(102): n is a, c, g, or t
gactctagaggatccccctatcaactgaggcgattccgatctaaacacatcatagacgggccacatggcgttccatcttctacatagccctcatccgcttanccaatg

SEQ ID NO: 691664 - DNA, 662 bp, Homo sapiens
cccatgatggtaacttactactccggaaaaagaccatttggatacataggtatggtctgactatgatatcaattggctttcctagggtttatcgtgtgagccaccacccaaatatttacagtaggaatagacgtagacacccgagccatatgttcacctccgctacccattatccatcgctatcccccccggcgtccaagtatttagctgactcgcccccctccccggagagccatatgaaatgatctgctgccgtgctctgagccctaggattcatctttcttttccgccgtaggtggcctgactggccttgtattagccaactcatcactagacatcgtactacacgacacgtactacgttgtagctcacttcccctatgtcctatccataggagctgtatttgccctcataggaggcttcattcactgatttcccctattctcaggctacaccctagacccaacctacgcccaaatccctttcactatcatattcatcggcgtaaatctaactttcttccccccacactttctcggcctatccggaatgccccgacgttactcggactaccccgatgcataccccacctgaaacatcctatcatctgtaggctcattcatttctctaaccgccgtaatattaatacttttcatgaatta

SEQ ID NO: 691665 - DNA, 130 bp, Homo sapiens
cagggacgagttgcgcagcttgttggggaggacgaagcctttggttttgcccatcttgcccaggctgcccaggtcaggatcctctatggctgcagctggaggaggattggatgaggcccctgccatcatc

SEQ ID NO: 691666 - DNA, 133 bp, Homo sapiens
tgctgtgtgttagatcgaggggagagcgtaggtccctggttgcgttttagcgatatgagtaacctatagaactaagcaactatttttgtttatttcagatgctctacatatgtagatcttgattcatcgcatc

SEQ ID NO: 691667 - DNA, 572 bp, Homo sapiens
ttgcagccgcctactctctcacactaacacgtagacaacacacacataccgcgtcacacacaccaagcagcactcatacacaccaacacagtagacagacacacattctgacatacactctcttacactcacacgatacagaatcatatgcacacacacccacgacacactctttcacactcacactccccctctacagtcacgtttccgccttcctgctgtgacccagaatggtttgggctcacgttgctgagctgctgtctttgtcccgagatgtcctgatagccccagaacaagaaatggggcataagtgtcctccctgcctcctgggaaaggtggttggattttctagggtgctaggagccgagtactgtcctgagagctggtcttagcccacggatcccctgatgcctggtgatacattggtgggatggatgacggctctgtggcttgaattctgctttccgctgcttactagctgtggacggatcactcatgccattagcaactctagtacctcactcgtgcagttactgaatcccaggccatccagggatgaatgacgatcatgt

SEQ ID NO: 691668 - DNA, 297 bp, Homo sapiens
cagaatataagagttaacagaatatattagctactacatatcgatttccattatccattgtttctctgatttcactaatgttttctagtcttttaatttccttagttatgtttgattgaatactgtgatggttaatactgagtgtcaacttgattggattgaaggatgcaatattgatcctggttgtgtctgtgagggtgttgtcaaaggagattaacatttgagtcagtgagctagtgaaggcagacccacccttaatctggtgggcaccatctaatcagccaccagcaaatataa

SEQ ID NO: 691669 - DNA, 124 bp, Homo sapiens
ttataggaaggactaggtaggggtagtatctcgtagtcagagggggcttggaagtaatcagaagaatatttgacaaaggcccccgtcttggactgcatagaccagtttgtgacttcctgtgcac

SEQ ID NO: 691670 - DNA, 609 bp, Homo sapiens
ggtctggacggagtagctccaagagctctcactgtgacagcccacctcgctcgcagacaccacaagataccaacagggcttctgaaacagatacccatagcatggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaacactaaacagaatagacactaaaatcatgttgatctataa

SEQ ID NO: 691671 - DNA, 725 bp, Homo sapiens
cgaagaagcatcgttaaatgtctctcttcacgcctgcgcgttcatgtctaaggtcatgagttctcctaagagagcccgaacagtctgaggaagctcttcattggagggttgaggctttgactacagactgatgagagcctgaggagccatttgagcaatggggaacgctcacggactgtgtggtaatgagagatccaaacacgcaagcgctccagggctttgggtttgctcacatatgccacgtgtgggaggaggtggatgcagctatgaatgcaaggccactacaaggtggatggaagagttgtggaaccaaagagagctgtggtcctagtagaagattctccagcgtaccaggtgcccacttaactgtgaaaaacgactatttgtgggtggcatgttaagaagactactgatagaacatcaccctaatgagattattccgaacaggtatggagaaacacttgaccgtgaattgacaatcagtgacgtgaccgaggcgagtggcatagaagaggggctgtgcctgtgtaacctttgactgaccatgactccgtggctcacgattgtcattcagaagataccatactgtgaagtggccacaagtgtgaagttagaaaagccctgtcataagccagagatggctagtgtttagccaggccgaagaggtcgaaagtggtgtcttggacactttgggggtggtcgtggaggtgggttgcggtgggatg

SEQ ID NO: 691672 - DNA, 210 bp, Homo sapiens
gaatgccttgttttcactaagttgggaggttttgtttctgggttttttttttggggtgtttttttttttggaaacagagtctggctttgtgccccagtcaaaggggcacgggggcaatctggaatcacggaaaccttggcctcgggggtaaagggattcctcctgcctaacccttggaaaaaccgggaattatgggcgggcccccccccc

SEQ ID NO: 691673 - DNA, 725 bp, Homo sapiens
cgcctcccgctcctagcagtgttgctactgccccgaacccgcgctgcagggaacagcgtgggcaaacagtgagtggggttcagcgtagactctggaccagtgagagtgccctgcggtgtgacctgagtgcctggtgccccggaaaccaatagagccatggcgactccctctgctgacttcgaggcccttatgaatggtgtgacaagctgggatgtacccgaagatgctgttccatgtgaactgcttcttatttggagaggcttcatttcctgtgatggtgaatgacatgggccaggtcctcatttgctgcctcctcctatggccgtggccgcactggtggtcgtagtcccaatgacggactacattggtggaatgcccatgctcacgccacgtttctcctgaaacagcagatgagaggttggcttatgcgtcttccccatgtgggatcccaattggtgtacacccaatcaccatggcaccttttggccaaaatcctcgaggtgctctggagtggatgcacacggttgagccacgaaggtgagcagactcccttgggcgtttactgtacttggatgccttacaatgaaaccatgacccgtaaccagctggtcaacgttcatgaacatggtcgtggctggcttgctcagtaggaggaccaagcctgggattgggccaaccaagggggcaggctgcaagggttctgttacacgtaccctgcgcaacca

SEQ ID NO: 691674 - DNA, 287 bp, Homo sapiens
  misc_feature (77)..(77): n is a, c, g, or t
ttttgggggccgggggggccccccccccccttggccccttccctcccgattttgggggttaaaaccccttggggaangggccctagggggggaagggccccctggggggggttttaaaaaaaaaaggcccccctttggggggggccccttaccccggggtgccccccccccggggggggcccccccggggggggggttccccgcttttggccggggggttttttttttttttttttccttttttttttttttttttttaaaaggaaaaaaaacccccggggggggga

SEQ ID NO: 691675 - DNA, 205 bp, Homo sapiens
tcgatacgagttcttttttctcaaatagagtaccgtcatagttaacaatttcataacgttctccttcttctcctccttcttagttgttcttcctacgtctcagtcttgctcttcttcttagccgtagtattccttttgttcttttattcatagcctttcttgtgcctgcctcttctgcgtactatcccccttctgtcgtcttctc

SEQ ID NO: 691676 - DNA, 346 bp, Homo sapiens
acacataaacgtatatgacagcaaaatggcgatggtttcgcttccacactgacaaagcctccccttcaccctagctgtcaccagattctgctcttgatcaaacccttagcccactgatctggtctgtgcttctggcttttcctttgcattctggccttggtcatctactttcaggattattttcttgtctttgaacgttacagtctcgattaggctagttgatgtgtatatcctgcgaccctgtgtgatttttttcctcgtagaacacattagctccctacatgggacgcagtctccctctgacatgtgtctctgcccttaaccaagacagaaagggggtaaatgg

SEQ ID NO: 691677 - DNA, 799 bp, Homo sapiens
  misc_feature (569)..(569): n is a, c, g, or t
  misc_feature (599)..(599): n is a, c, g, or t
  misc_feature (646)..(646): n is a, c, g, or t
ggtcatcgcacagggaaatctttctggaaccgggcaccaacttgcgtgttgttttcatgctctttgtgcggggattagctgtcgtgccgggcctgaaaatgctgcgagcgccgggcgacatctaatccaggatttgcctctgcctcgcggttgatggaaaacagatgtcttactgctctgggcctgagcacagaatggaaatgaccgaccagagagccatttggagccgaggacacccggtgaaagccattcagagtccagccaggaggccgactttcctcctctggtctgtttttactacttgagccgctcgctcagaaaacggccttagataaagcagtttcaccttcagatcgcctgaggctgcagaagggcggctgcgggggaggaaggaggaggcggagaggagcgggtgcgaagtcctgggtcgcctgcccgctgcctgatgtcgtgagctagggcacctcggccctggctgggggcgcagcgaggcccaggcccgaggggtgaggcccaggccactccggagcgcgcgctgttcccgcgaagcgagtcgccgtctcgtagtnaagtcgtggctcgggctgtgccctgggaancctaccgccgggcaaggtccggtggccggagcgtgcgggagctgccnagagtccatttccggacgggcagctgcggggcttggcagccggctggagccggtgcaggggtccgcggggccagtgtttaaggccgtgacagaactggacagggtgtcaggcgccgcggacccggggggggacctgagcaacgcagagaaaaa

SEQ ID NO: 691678 - DNA, 1086 bp, Homo sapiens
tggtggaaatggagtctcactctgttgcccaggctggattgcatggggcaggatctcggctcacttgcaacctcgtgcctccgtgggttcaacggtgcttctcatgccatcaggcgtcccaagtagctgagattataggcacgacaccaccgaggcccagtgagattcaggggtttcaagtagcagactgggggttttggccatgttggtgccaggctggtcttcagaattccgtgacctcagggtgatccaacacaccttgggccttcccaaagtgcctgggaattacaaggcggttggagccttgggcctagctaatctcgacggtaataacggggacagcgcattgttcgccactttacaagtggacggtggaaacacccttcgtacaatgccccacctggaacttggttgtttgcccaccccactcgagggcccaaaccaaaaagggtgggaccgtgtaccgtgcatttaccaaggggtttcacaacaaccgtgtgacctttctgttaggacccacacctgatacgtggttccacccccaggtgcaacatgttgttacccccattgtgccatataagcacgcaacaaagcacttgcaccggcgggcaactttccacacattagtggcggacgaacaacttgccccgggggaagcggcccacccaaagcgcgcccaaaacaatgcgcgtagtgtagacatgggcgcaccaaatacgccaaggctaccaattttacacacccaccagcttgcggatacagccaccatcggtgtgccacggggagcgcacatatcgcacagcagacagtcccaacatccattagtccgaccaaggcctcaactcacactaagcaccgggggggtggccagcacaaacaaacaagggggttcaaaacagaccggcgcgggcccatagtgaacgcatccacccattgtgaggacgacacgcgaccgacccttaagagacaaaactagtctgcccactaaccacaccggtgggacgggttcataacaccggacccaagcaaccaaatagttggcggccccacaccacacggctagtctgaggagcgacactgcggtaa

SEQ ID NO: 691679 - DNA, 871 bp, Homo sapiens
  misc_feature (12)..(12): n is a, c, g, or t
  misc_feature (612)..(612): n is a, c, g, or t
tttggcaaagcngcacctgcataaacctgttcaagaactaggacacagcttacacagcatgttaagttcatatacattatcagcagcaaattagaaacagaaaaccacactaaactacaagtctcctataattttgagagagagaagggaagaactaagtcagttatgtccaatctgaacagctgagtgtttacaggacatcacctgccatcttaaggtttatttttaacaatgcctagttttaaggtacaaagcagcttattgtatctaccacctgctattttttgaccccacttcaaaagctttaaaaggaaccctcatctctatttttttagtggcatctaacaaatttccaaattccagggatctaaacttgaaattggggggtgttatcaatgccccaaaaggcgttttgttaaattaatatccggaccgaatttaagcctcccaaaaaaaagagaggcccctcccttagaattcattggagaaacctaactttttacattgttaccaaaacccatttgtcttaattttttgcacggtaaaaatttcgccgctgttgaggtgatattccacagatttaatattgggggccccctgctcttgggtttngcttcacggcgggtgcaaaagtcaaagggctaggaaaagggggtttatctacctgaaaaaccgtggtgggagctcgggaccacctccctgctgtggttggggaacagcctcgagctggaacggggttacgcggccaaaaatggggggacccctggacgggtgcacgaatggaccccgatggaattgaactgaaggtggggcggataacaaaaaaccatggatgtaaggcgcgaccagatggacgactggaaaaaaaaac

SEQ ID NO: 691680 - DNA, 107 bp, Homo sapiens
agtcccaaaatctcaaaagtagggaagccagcagtgcagccttcagtctgtggtcaacggtccaagagtccaaagctgaagaactggagctattgttcagggcgaag

SEQ ID NO: 691681 - DNA, 721 bp, Homo sapiens
gcgctgcccgcccacccatgtctgtctccgtcgcacactctggggccttggcctctgcagtctctgtctccttccgtcagtctccctgttgccccctctcccgcatggcagggatggacggacgagcagtgttctggtgcgggggacaggggtgtggcccatcggggtcatggcgaggcgcccggtatcgtggagtgcagtggctgacgacggggcagccctgtgtcctgacacgaaacagacgcgtctatggcctagggcgtacgccttctagctgctgcacgggctcggctccctcgtcctggggcatgtgtggccgtccaggcacacgacgtttcgggggacccaggccaagcgagagatgcatggccagaggtctgtcgtctgaagagggccctagaactactgagagggaccagctgggtggcagactgacccccgttggggccctggagcaagagaacgaaaaggctggatgaggccatctagggctccctttcccgtgatcgcgtcccatgtcctggccctcatgttgggaaagcatgccagcagatgaagagcaggcctgggtatgtgacccaggtcaccgtgctccgtcccaggggccatgtgatcctgtgcctcgttctgctaccgttcctggtgctggggactgtggagccttctggtcgatgggtgtgcggcggggtggggggcggctgagagctgtgggtgtgtgact

SEQ ID NO: 691682 - DNA, 553 bp, Homo sapiens
tgaacctgtcacccaggtactaagcgtagtacccaatagatagtttttcagcccttgcccccctcctccctctagtagtccccagtatctattgctcccatctttatgtccatgtgtacccaatgttgagctctcacttgtgggaacataactgcatttagttttctgtttctgcattctgtttctcctgttctcttaggataatggcctccagctgtatccatgttgctgcatgtactacattttctttttagcctgggcacccacagtggattgggcactgggcccttgatgggcacctgggttcattccacatttttgctcttgtgaatggcgttaagatgcatacaggtgcatatgttcttgtggcagaatgcaaaaatctatactcttaagaggactctgacctccatcctctttttgcctttgctacacagttctctggccatcctctatatggaaatacttagggtaagtagtcaatcagccatggccaatgaagggttgggtcatacacccaacacttggctatttatcacccgacacattcaga

SEQ ID NO: 691683 - DNA, 193 bp, Homo sapiens
ttggacccgggcccccttttttccccccggggggggggggtttccccttgccttttttaagggggcgcccggttttccctggttcccgaattgattttggggggggattttttttcccattggttttaatttttttttttggggggttccccccccccccccccccctggttttggggcggggtgggcgggga

SEQ ID NO: 691684 - DNA, 308 bp, Homo sapiens
gggggggggggttttccccccccccccccccctttgggaaaataaaagcaaaggttttagagaattcccttttgaaaggggggtggggttcccccgtaaacctggccgggggggggtggggggctaagggcccccccttttggggttaggggggggggggcccccccgggcccccgcttttgggccttgggttcccccccggtcccccggtcttgggggccgcgggcccccctggccccctttttttttttttttggccccctgttctccccccccctttggggataaggggggggggttttttttga

SEQ ID NO: 691685 - DNA, 636 bp, Homo sapiens
  misc_feature (396)..(396): n is a, c, g, or t
ttttaatactagggcagtgccccaccataattacccccatactccttacactattgctgatcacccaactaaaaatattaatcacaaactaccacctacctccctcgccaaagcccataaaaataaaaacttataacaaaccctgtgcaccaatatgaactttttttgggggggggcattcattgcccccacactcctaggactacccccccgagtactgctcattctattccctcctttattgatcccccccttcaaatatcccaccaacaaccggctaatcaccaccgaacagtgcctactcaaacctaccccaaaaaccttttttccccctccacatctcttttggctgtccctgtcctgttatgctggctccctccaatatatgttttcgcnacaacccacttccccgacctgtcctcttctcctctttcacccaccgcccacctctcttttttcctatgtctgctcacctccccttttgctctgcgcaccttttatcatctctctgttttatgtcttttcctccccctatcacctcctcccccccgtcccctccacaccccaggatggcagccctgggttcttcggcaccttattcctcctcattctcttttctgttcagatatacaaaaa

SEQ ID NO: 691686 - DNA, 346 bp, Homo sapiens
tggagactgagactcactctatggcccacattggagtgcagtgccacaatcttggctcacggcaacctccgcctcccaggttcaagtgattcttgtgcctcagcctctagagtaagtgggatcacaggcacccgccaccacgcccggccacttttggtttttttagtagagccagggtttcaccatgttggccaggctggtctcgaactcctgacctcaagtgatctgcccgattcagcctcccaaagtgctgggatcacaggcgtgagtcactgcgcccagccatgacctttttcttctttttcagctcccatttttctctgctttctataaattatatgcttgg

SEQ ID NO: 691687 - DNA, 352 bp, Homo sapiens
  misc_feature (1)..(1): n is a, c, g, or t
ncataagaatagtccaccattgccagattcaccgaggtttcagagatccagtctttcaaatgttgaatgtcctgagaagttaatggcctgcataagtgaagggctccagtaagcctctgcaaaccactgccagtatttgagagtcgcctaaaatcggtagttccgatcttcataaatacaccacaaggtactaaatcctcaaactgccagatagggccagaagctgcaagagctccaactaccatatgaggatatttcatcctaacccaggcggcaagcatgccaccataggagcctcatatggcaatgacaggttgattttcagctcctgggagtgctcttctcgcgtgcc

SEQ ID NO: 691688 - DNA, 827 bp, Homo sapiens
  misc_feature (37)..(37): n is a, c, g, or t
  misc_feature (68)..(68): n is a, c, g, or t
  misc_feature (71)..(71): n is a, c, g, or t
  misc_feature (76)..(76): n is a, c, g, or t
  misc_feature (79)..(79): n is a, c, g, or t
  misc_feature (119)..(119): n is a, c, g, or t
  misc_feature (133)..(133): n is a, c, g, or t
  misc_feature (156)..(156): n is a, c, g, or t
  misc_feature (159)..(159): n is a, c, g, or t
  misc_feature (165)..(165): n is a, c, g, or t
  misc_feature (182)..(182): n is a, c, g, or t
  misc_feature (196)..(196): n is a, c, g, or t
  misc_feature (221)..(221): n is a, c, g, or t
  misc_feature (258)..(258): n is a, c, g, or t
  misc_feature (296)..(296): n is a, c, g, or t
  misc_feature (347)..(347): n is a, c, g, or t
  misc_feature (378)..(378): n is a, c, g, or t
  misc_feature (380)..(380): n is a, c, g, or t
  misc_feature (387)..(387): n is a, c, g, or t
  misc_feature (463)..(463): n is a, c, g, or t
  misc_feature (466)..(467): n is a, c, g, or t
  misc_feature (636)..(636): n is a, c, g, or t
  misc_feature (766)..(766): n is a, c, g, or t
  misc_feature (793)..(793): n is a, c, g, or t
ctaaaggttacagagaaatagctggagcagtttcaanagcctgtctccaataacatatcagcaatggnggnggggnggnagtattctcttcccacttcctgaggcttttaaatataatnatgcgaatgggggngtttgcctccggagtcaactggnggntttgantccaccactcaaaagcnttccttaaccaganacacctgaaaaggggagtcagaagnctgcagaatcacttccaatgacgaaagcctgactgtntcccagcctcaaaaaaggatacagcctagtagtaatgngaatcatgactggcagaggggactgagcctgacgttgaacggcctggaagnaacacagcagtattcaaacaccggagggtcngngaggganccggagggggaatgggggagacacacttgtagcgtgggagtccaatttttttgtagtctgaggggaggagaatatnaanntgggccacagcaagccagactatatgtgtaataaaggaaggactgcatggatcctttatcatacactcctctcctccatgcaccaattcctatgccaaatcacagcaaagcagatggctgagcaaactgaagcccagacttcagagtaagtagtcatcttcaaggttantcatcaccagacatggaagcagcttctgataagcttgaggcaggacagggtatgtgttatctctccagagctcttttttggtctcagtgagccacgtgctgagagaggcatctgtttctgtggccatgtncttcaacatgtctgggacagctctgtnttcatctatgttttcaggaagctcacttgcgtat

SEQ ID NO: 691689 - DNA, 380 bp, Homo sapiens
ttttttttttgcagggggctccccaacaagaaaaaagggggggccaactggaaccccatttgcagtgcacgtttttattaacccccccccgtctggcttgcccctgtcccgaaatttaaggttggtacaaaaaatgtttgtcaggctcagagggccccctccccccccctacaggtcaaaaaaactaagggcacttccctaggttcattacccccctgggcaaaaggaaagggagacagccacccatcccctgccccccccgccccagggccttgaatccttttttgttttcaacagtcttgctgaattaaacaaaaaggcccttgaatcctggcctggaatttgggcaaaaaaagcattaataaaactgggcatcccca

SEQ ID NO: 691690 - DNA, 2174 bp, Homo sapiens
  misc_feature (2155)..(2155): n is a, c, g, or t
ccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaaagagaataaaatgttttgacccttcctggccctttgctctggcatctgcattgtctccagtctgtgagccagagctgagcccgacctggacttggggtgcagcaagctgctgcatgcgggctgtgggcacccagcctagtggcaggtggggcactctgcctctcccagacctgtccagcatgtgagtgctaggcaggccccggctgtgcctctgggcccagcctaacatcagtcacagagaagcgagttcagaaagcatgctcactttacggtggggccccagaaatcactagaagctgtgtgtgtccaaagctcaggtgggtactaaaagctgtgtgcgtccaaagctcaggtgggtactnacctagacagggcagttta

SEQ ID NO: 691691 - DNA, 243 bp, Homo sapiens
catgataaccagacctgctgacgagacaaccgacacggctgggccttctgttcctaccgccagggcgtctgatgtgctgaacggcgccactgtagtcctgatagattccgatgcgcagccaggggtaccaaatgtttgcgcatggaggccccgcgctgggacgcccctttcagggacccaaacttgtaaccagcgctatgagggatagtaattaaaactatgcatccctcgggaccccactct

SEQ ID NO: 691692 - DNA, 1953 bp, Homo sapiens
ccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaaaaagaacacaaacagctcctaaaaaatgcgcacgtggaactgaagaagagtaagaggaaagattactacaagattctaggagtggacaagaatgcctctgaggacgagatcaagaaagcttatcggaaacgggccttgatgcaccatccagatcggcatagtggagccagt

SEQ ID NO: 691693 - DNA, 2085 bp, Homo sapiens
  misc_feature (2066)..(2066): n is a, c, g, or t
ccggcctcccacccagctctctggtcccggcggtaagatggcggctgccgcggagtgcgatgtggtaatggcggcgaccgagccggagctgctcgacgaccaagaggcgaagagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaaagagaataaaatgttttgacccttcctggccctttgctctggcatctgcattgtctccagtctgtgagccagagctgagcccgacctggacttggggtgcagcaagctgctgcatgcgggctgtgggcacccagcctagtggcaggtggggcactctgcctctcccagacctgtccagcatgtgagtgctaggcaggccccggctgtgcctctgggcccagcctaacatcagtcacagagaagcgagttcagaaagcatgctcactttacggtggggccccagaaatcactagaagctgtgtgtgtccaaagctcaggtgggtactaaaagctgtgtgcgtccaaagctcaggtgggtactnacctagacagggcagttta

SEQ ID NO: 691694 - DNA, 888 bp, Homo sapiens
  misc_feature (259)..(259): n is a, c, g, or t
  misc_feature (720)..(720): n is a, c, g, or t
  misc_feature (784)..(784): n is a, c, g, or t
taaaaaaaaaaggccttacatatttataactggaatccagccaaccaagcgtgtccataacagattcagagaggaaaacacgttcgaaatcctccagataggtgggtgacatttttcagctggatagtggttaacagtgatcgtgaccttcagaacagcataaatattgtgttgccatctcagtgtgcaatctccttatagacccagctgggttcttctccaagtgtcctccttttgggacagttgtgtcaccgtgaantttaatttctccgagtgtttctcaactccgaaactccacgtggggaaaagtgggacacgaaatattgtgcttttgtggtatctcttggtggccgaggaatatccggcttaaaaactcccgtgaaaagagttcttgtggtgaaagaacagagaccatgtggcgcagagagacaagcggaaggtctcaagaaaaacaacaccacacgcagaggttgtgcgggagaccacaatgtgtgtgcgggctctcaccaaagggacaagaatgtgccaggacaaagaatctcccgaaatgtgtctccccctatactcggccggagaaaccgcgccgtgagttggacggtgccgtaggatgtgcgggacaaaagaaaaaccacccatgtgagaatgtgcgcgcaatagggtgccacatctcccgagaagggtgcgccgcacctctgtggtggagaaaaagacgaagccccnacaatggcccttcgtggggacagaacaacaccttgtgcgttggccccctacaaaattaactccncggggcgcgggacagacaaccttgctgtgcggcgccctcttgtcggtgggttctccacccaacagggtggaaggcgacccttacacgcttggagagcacctccg

SEQ ID NO: 691695 - DNA, 753 bp, Homo sapiens
agaggctggtcgtggacttgtggttggggtgatgtgggagctgtttcaacctgtgatgccccctctcctgttgccggcgtgggcatcccccgggggcagtggcaaacgctggcgctcctccagcttccgagtccagccagcctggcgcgcgtgggcgccgtccccggatgacacctcggacggagtcctgttccttccctgagttgctgtggacttgtggacgctggtctcgttgtgcgctcagcgcccgttgcgtggtggttcgactgcgtacctgctggcagtgtccgtcaccaagtggctgtgacggagcgagtgatggaagtggcatgagcctgagcttgagcgacactccgtgctcgcaaacgtcgtacaactcgaagggtgtggcccattgtggtaggggtgagagatcctccatgttgctttatccggagttccacgaccttggtgtgggtatgacttgcgtgcaggatgaacttgtcagctcgcgaggtcgctggaaggttgtcggtgcgagggggcgcgcagtgtggcaggagtgcccattgctgaggctgtgctgcacgtctggtgcttctgctcccggcaggatgatgggaagttccagatacaatgatggtgagggcgaccgtcctccaatttgcgcaccgttgggaccccaggagttttactgtgacttcatcgagttcagttatgttcgtgtctcttgtgaggactggatgtgccctgccaggcgtgggggtcagatcc

SEQ ID NO: 691696 - DNA, 2664 bp, Homo sapiens
  misc_feature (2645)..(2645): n is a, c, g, or t
ccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaaggtaggtgggcctgctgttcttgggagttcccagatcacaagccaacacactcattgcctcttaggcagctctttgggagtcagaggggcccatgagcgggggcagctgaattctcatctagcagggcatctatccactcggctgttgctaaggatgaagacaggaaggttcccaggcaccccttgccttgggacctttagccaccgcatctctgcagggtcagggaggcatctctaactgcctagtaccaaggcttctctgcaagagcaaaggtactatatagataatgctgaggtcagaagctacccatgtataatacagtcacgtgctccctcttgcacccaaaaacagcctgagctgtttgatacccatagagtttctctctgtgtttgagtttgaagcagcccttgaagacttttccataatcagagcaaagtgatcttccttagaaaatccatagccaactaccaacccctcttttctctttcagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaaagagaataaaatgttttgacccttcctggccctttgctctggcatctgcattgtctccagtctgtgagccagagctgagcccgacctggacttggggtgcagcaagctgctgcatgcgggctgtgggcacccagcctagtggcaggtggggcactctgcctctcccagacctgtccagcatgtgagtgctaggcaggccccggctgtgcctctgggcccagcctaacatcagtcacagagaagcgagttcagaaagcatgctcactttacggtggggccccagaaatcactagaagctgtgtgtgtccaaagctcaggtgggtactaaaagctgtgtgcgtccaaagctcaggtgggtactnacctagacagggcagttta

SEQ ID NO: 691697 - DNA, 2663 bp, Homo sapiens
  misc_feature (2000)..(2000): n is a, c, g, or t
  misc_feature (2005)..(2005): n is a, c, g, or t
  misc_feature (2012)..(2012): n is a, c, g, or t
  misc_feature (2644)..(2644): n is a, c, g, or t
ccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaaggtaggtgggcctgctgttcttgggagttcccagatcacaagccaacacactcattgcctcttaggcagctctttgggagtcagaggggcccatgagcgggggcagctgaattctcatctagcagggcatctatccactcggctgttgctaaggatgaagacaggaaggttcccaggcaccccttgccttgggacctttagccaccgcatctctgcagggtcagggaggcatctctaactgcctagtaccaaggcttctctgcaagagcaaaggtactatatagataatgctgaggtcagaagctacccatgtataatacagtcacgtgctccctcttgcacccaaaaacagcctgagctgtttgatacccatagagtttctctctgtgtttgagtttgaagcagcccttgaagacttttccataatcagagcaaagtgatcttccttagaaaatccatagccaactaccaacccctcttttctctttcagcatctggtccagggaattcttttttnaattnggctaangaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaaagagaataaaatgttttgacccttcctggccctttgctctggcatctgcattgtctccagtctgtgagccagagctgagcccgacctggacttggggtgcagcaagctgctgcatgcgggctgtgggcacccagcctagtggcaggtggggcactctgcctctcccagacctgtccagcatgtgagtgctaggcaggccccggctgtgcctctgggcccagcctaacatcagtcacagagaagcgagttcagaaagcatgctcactttacggtggggccccagaaatcactagaagctgtgtgtgtccaaagctcaggtgggtactaaaagctgtgtgcgtccaaagctcaggtgggtactnacctagacagggcagttta

SEQ ID NO: 691698 - DNA, 2122 bp, Homo sapiens
ccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaaggtaggtgggcctgctgttcttgggagttcccagatcacaagccaacacactcattgcctcttaggcagctctttgggagtcagaggggcccatgagcgggggcagctgaattctcatctagcagggcatctatccactcggctgttgctaaggatgaagacaggaaggttcccaggcaccccttgccttgggacctttagccaccgcatctctgcagggtcagggaggcatctctaactgcctagtaccaaggcttctctgcaagagcaaaggtactatatagataatgctgaggtcagaagctacccatgtataatacagtcacgtgctccctcttgcacccaaaaacagcctgagctgtttgatacccatagagtttctctctgtgtttgagtttgaagcagcccttgaagacttttccataatcagagcaaagtgatcttccttagaaaatccatagccaactaccaacccctcttttctctttcagcatctggtccagggaatttcttttttcaatttggctaatgaagggcaacgagggcgtagaagacgggagatgatgaagagggaatagtaagtggaagacggaagagtgtggaggaggggggggggaggggcagatagggaagcgaaga

SEQ ID NO: 691699 - DNA, 2173 bp, Homo sapiens
  misc_feature (1510)..(1510): n is a, c, g, or t
  misc_feature (1515)..(1515): n is a, c, g, or t
  misc_feature (1522)..(1522): n is a, c, g, or t
  misc_feature (2154)..(2154): n is a, c, g, or t
ccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaattcttttttnaattnggctaangaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaaagagaataaaatgttttgacccttcctggccctttgctctggcatctgcattgtctccagtctgtgagccagagctgagcccgacctggacttggggtgcagcaagctgctgcatgcgggctgtgggcacccagcctagtggcaggtggggcactctgcctctcccagacctgtccagcatgtgagtgctaggcaggccccggctgtgcctctgggcccagcctaacatcagtcacagagaagcgagttcagaaagcatgctcactttacggtggggccccagaaatcactagaagctgtgtgtgtccaaagctcaggtgggtactaaaagctgtgtgcgtccaaagctcaggtgggtactnacctagacagggcagttta

SEQ ID NO: 691700 - DNA, 1775 bp, Homo sapiens
  misc_feature (1510)..(1510): n is a, c, g, or t
  misc_feature (1515)..(1515): n is a, c, g, or t
  misc_feature (1522)..(1522): n is a, c, g, or t
ccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaattcttttttnaattnggctaangaagggcaaccacccaaaacccagaaaaggcagatccactcaatttaaacttgaagggggaaacagattaccctcctcccttaataacagatccggggggctaaagcaatttcgttatctaaagaggaagcccctgggccttgggaatggggggggaccaaggggaaccaaggccgaaaaaacactaagcagaagagcattatcgttttgcacaaattgcaaatacatttgatctggatactgagacacacag

SEQ ID NO: 691701 - DNA, 1794 bp, Homo sapiens
ccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgatttgagctagacggagtatggatgggcataataggcaaaactggatgattttactatgaagcatgggtatcagggaatgggattattcagtcgacgaatgcagtgttgtcactctgaggtgtgggagtggcagtagactcaggtatagctcgaatgtggagtgaggttagcggttacctcgataacgagctggtgggtatatgtataagtgtggatgttatatgagattgagttagttctatgggcgagcgaggcatggtggggaacaaaagatatggaggcacggattgtgatatttgcggggaaatagagtgggtggggaggagttgatttatagtatctttacgggtttgtaatgaaaccgaaagtaag

SEQ ID NO: 691702 - DNA, 227 bp, Homo sapiens
actgaatgtatttcactatgagtagtagaaatcatagttcataagggtatattggaagggaaacataatatatatatatataatagtcacagattgtccgttatcaaccagtataacatatacagctgcactttgtttgcctatgttcagtatataatggcttgttgtagcgtaattagtccaagctgagagatataacgcaaaacatacatgacatatttatgtct

SEQ ID NO: 691703 - DNA, 2120 bp, Homo sapiens
  misc_feature (2101)..(2101): n is a, c, g, or t
ccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttctctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaaagagaataaaatgttttgacccttcctggccctttgctctggcatctgcattgtctccagtctgtgagccagagctgagcccgacctggacttggggtgcagcaagctgctgcatgcgggctgtgggcacccagcctagtggcaggtggggcactctgcctctcccagacctgtccagcatgtgagtgctaggcaggccccggctgtgcctctgggcccagcctaacatcagtcacagagaagcgagttcagaaagcatgctcactttacggtggggccccagaaatcactagaagctgtgtgtgtccaaagctcaggtgggtactaaaagctgtgtgcgtccaaagctcaggtgggtactnacctagacagggcagttta

SEQ ID NO: 691704 - DNA, 650 bp, Homo sapiens
gccagagacgcagccgcgctcccaccaccacacacccaccggcgccctcgatcgcctcttactccgggagccaggtccgagccaccgaccgccggcccagcgccatgcgccaccctccgcagccatgtccaccaggtccggtgtcctcgtcctcctaccgcaggatgttcggcggccggggcaccgccgagccggccgagctccagaccggagctacgtgactacgtccacccgaacctacagcctgggcagcgcgctgcgccccaagcatccatgccgcagcctcgtagcgcctcgtaccccgggccggccgttgtatgccacgcagctcctcttgccgtgctgctctgcaggagccactcgtgcccggggtggccggcatcctgccaaggcactcggtggacctccctcgctgggccgacccgccatcgagcagcggagtttccagagaaacaccctcggcaccccaaccgccagaacagcgcgagcacgctagccagggcacctgtagacatgaagccggctaatcgcgcgaaccttacattcggcgcacacggcttgccgccttcccggcgcccccagcccagacactacagactccctggcgggcccagcagcataagacgcagcctcacggggcccacggcacg

SEQ ID NO: 691705 - DNA, 1021 bp, Homo sapiens
gtccgcgtaaacataacagttaaaatacagcccatttagggcctcgctcataggtttgcacaccaaagtgctgcaaaaatccagcagacagcagagcagctagtacccatctgggcagcagggcacagcagcatgcagcttcatctcgcagcacatggcatacacagctcatatgctcaagttcaaaatagcacactcgttcacccagtgtgcataaagcttcgcaatgacaaggtagacacacactgaccccaccacacattgcacctatctcgacagcttggcaaaatcatagagtcaaccctatgggcttccctgacgtagaagaccatatcatggacaagagtcagtgatacttactgacgttgctataccatccgtacgactatatctagacacggtctcatttcatctaaactacgaaatgcaggtacacatggatgctgctcccttagggcaaatgggagaaaacaagaaaaaaagaaatattcaaagggagtgataaacaataggggcttcaaaggggaagaattaaccaaaaagtcattggaaacaaattgcaatatcatataaggaggcatggataaaatgaaatatgggaagagaaggcaagtcagtaacgtggacaggccagcaacgactcacaggaacaatatcccgcacaaaaagtggaaatgacacacaaagaggccaaagaagcacaacagacaagcccagaacctcaagggccagaaaacacactggtggtacctggccagaaaccgagtactgtaacaaaacgactaagggaaccccaacacatggctaccagcacttggggaaaatctaattgggagccaccaaaccaggcaatttagcacagagaagtccactcgaaattaccccaacacaaattggcaagagtggattaaaaacatctctcccatcaatgagaagcacgtcacttggtgcccaatacgcaacagacaactataaaatccatgctgagaggggaaatattgcgccacgacaattggagcat

SEQ ID NO: 691706 - DNA, 315 bp, Homo sapiens
  misc_feature (164)..(164): n is a, c, g, or t
  misc_feature (186)..(186): n is a, c, g, or t
  misc_feature (198)..(198): n is a, c, g, or t
  misc_feature (207)..(207): n is a, c, g, or t
  misc_feature (249)..(249): n is a, c, g, or t
  misc_feature (266)..(266): n is a, c, g, or t
  misc_feature (275)..(275): n is a, c, g, or t
  misc_feature (295)..(295): n is a, c, g, or t
ggttctgctctgccatgtatttagttttacccctatctcatctctgtgtaagaaaaaagcccatgttttaggggacggtgggctaggagtcaagatttctgatttctagtgtgttggcctctttgcagtcttgagtaagctttatgcgttgcctgggcttccancattcctcctttgcaaagcagnatggatttcacntcttatccnttaagacatcttccagactcttactctctctggtatttctangaattaacctctatccnttatccctngagcctctcgtaatctatcnatttaatacactaggcacga

SEQ ID NO: 691707 - DNA, 108 bp, Homo sapiens
ccacggtgtgcttgcggaagtgcctggttactcatcacttcttgcaaaagcgccactcacacccttcccatgagcatctgtaaggcttttctccgcgatcgaagtgtg

SEQ ID NO: 691708 - DNA, 131 bp, Homo sapiens
gtccgcccccgggtccgaattaagaaaaaaattcccatggctgggctgggggtggaggctttatttaccaagatgtttacttttcccttcccctactcatggccctaattttccctccccccccccttgga

SEQ ID NO: 691709 - DNA, 277 bp, Homo sapiens
  misc_feature (59)..(59): n is a, c, g, or t
attatcgagctctgtacatgtcgcggcgcgagacgcgtatcgatggcgcagctgaggcnggcgcaatatgcatcctaggctacttactattcccggagtatacgtaggcggctaacgtaaccaccgtacctctagaactatagctagcattgcgccaaatttaaagcgctgattattcgatcgcgcgcagattctgtcatgatgctcattgcaattggctcccaatatataggggccggggttaataataacctcagggtcgacgttccccatggcc

SEQ ID NO: 691710 - DNA, 404 bp, Homo sapiens
taattgattgctcaccgctcctcacctaagagattattttgaacagtatggaaaaattgaagtgattgaaactcatgactgaccgatcgcagtgcaaagaaaaggggctttgcctttgtaacctttgacgaccacgactccgtggataagattgtcattcagaaataccatactgtgaatggccacaactgtgaagttagaaaagccctgtcaaagcaagagatggctagtgcttcatccagccaaagaggtcgaagtggttctggaagctttggtggtggtcgtggaggtggtttcggtgggaatgacaacttcggtcgtggaggaaacttcagtggtcgtggtggctttggtggcagccgtggtggtggtggatatggtggcagtggggatggctataatgg

SEQ ID NO: 691711 - DNA, 1070 bp, Homo sapiens
  misc_feature (358)..(358): n is a, c, g, or t
gtggtgttggaagtcactcagagcctcacacgatggcagatcactaagctgtaatctatgtttccaagttgtaacaatacttgtgactatgctctatgaaaatagggacatttaaagatccaggtcaagaccttgtctgttttttgttttacacaggagttttgctatgtagctagtctagtacttgctgtacatgagacaagccttctgccttagcctttgtgagtggtgtgattactgaaatgtgccatctcacccgaataaatgttctaacataaaggagagatttactcagggtgggtggtgtccaggcagggagaaaaagggcattaaaaaaaaatacttagaataattactntggagaactgtaagcctaagtattaactgagaccatgagtctaagaagagagaattctttacagatgaaagatacatttttattggtgcttaagtagagcggaggtgtagctgccctgggtggcacacattctcagcactgatagtccagtccttgtccctgagcttgctgcttcccccctaggtatgcagtgctctgtggtcagctggctgagcatgagggcatctcgaaacgcatccagagtggctttagcttcaaggaacatgtggacaaagccatgaacttcagccagaagaacccaggggtcacttttcttcttggcacgtggtggctaccaaggtttctcacttgaactgggtttgcgcacaaacaaacgggtaccggccttgtttgaaagccccttaggcgtacgtgcaagaacgctgaaaattcctaaggtgagggatacagcggattcaaacgggagggataaaatccaaggggctgacaaaattgggaaaaccgtggcgcacaggggggaacgggccacgaagcggaaggccacaagagaaaggtcaaaacaggggaaaaacagctgagaaaacagcagcgaagtcagcccaaggaaaaaacagaagcatcgtgacccagagaaacaaactgcgcgacggaaccacgcagagaaacacaagcgagagtcgacgacacgccgccccctccttcctcatctctt

SEQ ID NO: 691712 - DNA, 513 bp, Homo sapiens
  misc_feature (34)..(34): n is a, c, g, or t
  misc_feature (257)..(257): n is a, c, g, or t
tctctctctctctccttatatatgtaatatattntctatttcattaccacctatactataaatgaacatacaacttgggactgtaaaaaaatatgaaacagcaaaacaattacatgtgctcttaccagtatctgagacttttgtacccaatgtaattataatgatgtttcggaaaaacttttcatttttctggctttctgaagattttgctatgtcagcaacattctttgtgctcatcagaaagtaccgaatactcnctgagggcatatgcagccttccacaaaacaaagtaaaaaaacaaattggacaagcatttaaaaaagcaaggaaagcaagtcagatacatacagtggcacatgtcagacagatgaagagttgactgcaacacttctttcatgttttccctgacgtgaggttaagtgttgaatataagcccttatgatttggggaatgtaatttactgttgtattctgttgattttaatataaatgattaaataaaatgttacagttt

SEQ ID NO: 691713 - DNA, 110 bp, Homo sapiens
catttgatagctacgaactccttgcagtagacataatcatcaccatccacactcaattgtattctgtattgcgctgtatgaactcttcggcagccctggattcatatatg

SEQ ID NO: 691714 - DNA, 354 bp, Homo sapiens
tgagcattcgtgaaggaagcggatcattgaaaacaggtgattacgagttcacaaattgcgaacactttgacataattttaacttcatggggtatacacggaagtctggagtttcagaaagtgattttcagttcccacaaaagtcgagcacttgagaggctagaactttcagtgttaactttgccctaaaaagtggagacgtattctgataatcataacagtcacatgattactgatgctcatctggtctgttaataataaagtcgttcatttggatgtattgttcttcaatgtaaattacaggaaactggatataggatttcgttgcaatgctattgaaacttctaaaactagg

SEQ ID NO: 691715 - DNA, 248 bp, Homo sapiens
acttcgtgaactcagccagccagattgcgatcaaacactgggcaccaatggcggcggcttcttcggcgtcactcggcgcacccgtttgaagacccgacggcctgggccaacctgttcgagctgtcggcaatcatcctcatcccggtggcgttggtgtcaccttcggtcactacgtgaaggacctgcgtcagagtcgcgcaattctcggctgcatgctggcgctgttcctgatcggcggcgcgacttcg

SEQ ID NO: 691716 - DNA, 1226 bp, Homo sapiens
ttttttatttttttttggtctaaaaacattttttattggggtaacaggtcccaaaacaggtcagttaataaaataaattctaaagaatatgtccctatgcaaagccctcccatccccaaaaataacgctgggggtaggcattgcccttcccccattgggctacctcgggtgttttcaaaacaacatgtttagggaagctacagggttaaacatcgtgggactgtgggacaccagtttccagtgtgtccccaatattccctagggttacagcagccagctaaagtgggttgcaaaaaacacttcactccatacccacaagcccaaaaaacatatatacagtgagcacacaacccacgaggaattaccgggacacccaaaaataccgacaccaaaacgaggccccccatataaaactgagagggcgacgagaggaaaaggagaaacaagtgacacacaattacacggcggcccatgaggacacaaacaaggggacaacggggacactaaggtatgtgcggacccatccttacaaaccatcataagcagcgccattaacaagcgcgcagactactgactacgaaagagcccaaacaagaatagaattaccccacaacaactttaggcaagagggtagacagaaacaaaatatgtgcggcgtgccacgctcccccacatacgacaacacagcggcgagaggacacggcgaaacaataacgactacattaaaaggggataagacgagcgcataaaacgacgataactttaggcaggggaggaagcaccacacacgacaacagtgttggcgtctgggataaatgcagtcgaaaaagctagggggataaataggaaccaaacaacgacaccaaaccagacaagatgcacacagaggatctcattgaggacaatcgttctcaataacacgccgatgtaccacacaagagaatgtggctgcataacaacaacactaacacaattacaccccaatttatataccataataacctaatatatatataaaacaccaacaccaccactaatatataaaacacaaaccaaaaatatttcattcaccaaccaatcaaataatataaccccccacaaacatatactacaatcatccaacatgaaaaaccaatacatgttaactcaaataaaaatatcgagcacccaacatattattagcacacacaccaatctataaataaaacacaatacaccaacaaaac

SEQ ID NO: 691717 - DNA, 240 bp, Homo sapiens
  misc_feature (88)..(89): n is a, c, g, or t
  misc_feature (97)..(97): n is a, c, g, or t
  misc_feature (105)..(105): n is a, c, g, or t
  misc_feature (110)..(110): n is a, c, g, or t
ggcttttaaatgctttttcatcttgttttttcccccccctcaccccatttaggtatgtatgagctaatctgtccctaagaagttctcnngctccttngtatcccnttctngtcttcctcctaccttttgtctcttggtgtttggactttttttttggccttttgtacaaagattagtttcaatgtagtctgtagcctcctttgtaaaccaattaaaaagttttttaataaaaaaaaaaaa

SEQ ID NO: 691718 - DNA, 783 bp, Homo sapiens
agtcggtccaagttccaaaactgaagaacttggagtctgatgtttaagagcaggaagcatccagcatgggagaaagatgtaggctgggaggctaggccagtctaaccttttcacgttcttctgttgctttatattcgctggcatctgattagatggtgcccatccagattaggggtaggtctgccttccccagccactaactccaatgttaatgtccttggcaacaccctcacagatacacccaggattaatacttcgcatccttcaatcaagttgacactcagtattaaccatcacactaagagttggtggtgcatgtctgcaatcccaggtactttggaagctgaggcgagagagttgcttgagcccaggagttggaggctgcagtgagttatgattgtcttactgcactccagccagggtgacagaccaaggacctgtctccaaatatatgtatgtttataatcagttggaagaaacagaggttcactacgattcagggattaccatattgaataatctaaaaggcaacttccagtatcacttgaagtttaaaaaactaagtaggatttcaaaaaagagttgaatgcagaaattgaatgaaacatggaaaaggatcaagaatgggtattttaataacaggtcccatgaatcggccaatatgaaatgtcaaataatgggtgtttactaaaaagaattggtagcattattggggaggttagggttttacaatacgcaattaagtgaggattcagaaaataaaggtgcgtaatcgaaaaggat

SEQ ID NO: 691719 - DNA, 102 bp, Homo sapiens
  misc_feature (91)..(91): n is a, c, g, or t
cataaatttttctccttaaagtcactctttcccattcctccatttctatcggtgttaagaaaattaaataattaaagtgagctccgtaggnacataagttaa

SEQ ID NO: 691720 - DNA, 250 bp, Homo sapiens
tacccagaagggggtggttaaatggacagcggggataataaaattacttttacttttccctaaaccaaaagcgggaataccagacagcagacagattcagtgatgctggcaaaagaaatacacacacacacacacacacacaaagcgtattctaagacctgcctgtagctagatgtgagcaaagcagacgcaggtggggggggcacaggaaaatacttctcactagggggggtacaaacagggggggcgg

SEQ ID NO: 691721 - DNA, 966 bp, Homo sapiens
  misc_feature (2)..(2): n is a, c, g, or t
  misc_feature (122)..(122): n is a, c, g, or t
  misc_feature (425)..(425): n is a, c, g, or t
  misc_feature (500)..(500): n is a, c, g, or t
  misc_feature (507)..(507): n is a, c, g, or t
  misc_feature (509)..(509): n is a, c, g, or t
  misc_feature (551)..(551): n is a, c, g, or t
  misc_feature (748)..(748): n is a, c, g, or t
  misc_feature (797)..(797): n is a, c, g, or t
  misc_feature (812)..(812): n is a, c, g, or t
  misc_feature (846)..(846): n is a, c, g, or t
  misc_feature (905)..(906): n is a, c, g, or t
  misc_feature (957)..(957): n is a, c, g, or t
gngcacaaagaccaggccctggcagccacgaaagccctccagatgccttgaggacgccgtctctagccgggtgggccacgaccgggtgggggcagacaatgacaagaggcaagacagccgcncagcccccctgccagtcccaggccctgtgccagagcctgccccctcctgtgccgggggctaaggccccagggcggcgggggcgcgggccagactgggcggtcgccgtgcccggcctccgcggacctgcggctcgggctcgcggcccccggcctgcggccccttgctcggggggggggcgtcctgcttggggtcccggccccgggagcgcctcagcctggcgctggcctcctcgggaccgccgggtctccgggtgccgcttctgtgatccctgcccaccttgctgttccgggcaccctcctgcntgccgcgcgtgtggggcctgtccctggggtacgcctcgctccgccggtccccgtcgtgctgggcgtcgtagccanctgccananggccgaagttgcaggcatgttggttcctggcgtggccgggancccgaggatctcctggcagagccgcgcatactcctcggcggggtctgcgtccgtctgcgtgtgcagggcctggtccaccttggcgaggacgatctggcgcaggttgaagaggcacctgtgttggcctgccgggactcaatgagcttctccaggagctcccggggcacggcgctgcctgtgcggtagtgccgcgacanccgcagcagcggctcctgctcccacacccagttctccagcatctgcganggcgcctccacaaantcccgctccacgtgggtcccgctgaacatggcgnactccgcctgggagcagagctggtgcatcacgtggccaaactcatggaagtaggtctcnnctcgtcatgctgcagcagcgagggcgcgtcggctgtgggcttggtgaagtnggccacatg

SEQ ID NO: 691722 - DNA, 147 bp, Homo sapiens
cgtcgtcctttctgctctgcgtcgaccttctgctcttggtatcgcaccatcgtcatcctcatcatcttcagctgcccgcttgcccgtagctgacgatgatgcggatgacgatgtcgataccaagagcagaagggggtaccgagctcg

SEQ ID NO: 691723 - DNA, 601 bp, Homo sapiens
gcatatgacggagagaatgtttaaacatgattatctcagagcttacgaagtttctctctgtagtgcatagaaatagggaattatatgacaaaggaggagaacaggcaattaacgagggtggatctggtggcggtttggctcccccatggacatctgtgatatgtttataggaggacggaggaaggatgcagagagaaaggagaggtaaaagatgttgtacatctagctcttcagtaatcctagaagacgttatagtagatggtgcaataagaagactgagcatctgggaaagaatgtgatttgtgacgaaatgtgaaggtagaggaggtaagaaaggagctagcagagtgtctgatcccgagattgtccgaggtatctggaatgcaagagtatagaataatcatctagatatggatcctagtgcacagtggtgtgcagcgagattcagtgctgtggttgcatggatgtgccatgtgcatggggagcggatcagatcctatatgatagatgtacaagtgtgcgacggaaggaagatagtacgagagaagaaaatgtgagacagtctgtattgacaatggtatgagagatgggcagaagatcc

SEQ ID NO: 691724 - DNA, 210 bp, Homo sapiens
tgcggagcctaccactgaccagtcctagttcattgatttttataaaagccctccctttttaaacaacaattttaaagcaaatttggctaacgcaccaagcagtggtttttccagtagggatggtacccactagcatggggcccgtccaccatcttgtttatctaagcaactctaacacacattatctgctcaaataaacaaactcggcag

SEQ ID NO: 691725 - DNA, 157 bp, Homo sapiens
gaagagcgccggagctggagctgaagctgatggcccctcggcgcatgaggacgtgctgggggaccggcctctccaggggcagtaccggcagctcgtaacacactcccattgaatacgcccgccctgcatccgcgcggcgcccgccctgccgcggccg

SEQ ID NO: 691726 - DNA, 150 bp, Homo sapiens
gtgcatgtgtaactattagggtcatctgagacagtggcgaggggaggggaggtaggactctgagatcaagcagacctggaatttacttctatgggccattaggaactgtgtgacgctgggcgcatctgtcttcacctatactagagatct

SEQ ID NO: 691727 - DNA, 377 bp, Homo sapiens
gcacgaggagagagagagagagagagagagagagagatagatatactgagagagccgtataagaacgtggtggttcgaatcctgagcagtgggattattgtgtcacttctagtatgtgtagagaatgcctatgattatttccaagctgtcaagatctgtattgcctgctccctggctgatccacttgacaccactccagattctacacatggattagtggtggagtcaatccatgactcatacatgtcatagatgttatgcacacgcgtattagctgtggctgtttatttgatagctgttgctgtgtatttaataggaatcctttctcatggattgactcgtgacttgaatactgtctctttacaagtatcttcttg

SEQ ID NO: 691728 - DNA, 310 bp, Homo sapiens
accccgcaactggttggatgccttcgaaggggggcgacgccttcttgggatgctttctgggaagctatcaatccccagccctcattcatagtttgcagccgaggagggacttcttccctgtccttttccaaggaaaagaatgctattgtcgtactcacctcccacgaactccggggtcttttgggagtattctcccctaaccattacaactatttttttggatactcgctcttgcatgcctcccccgtccttttttctttgccagttccctggggacagttaccagctttcctgaatggattcccggccc

SEQ ID NO: 691729 - DNA, 748 bp, Homo sapiens
  misc_feature (239)..(239): n is a, c, g, or t
  misc_feature (313)..(313): n is a, c, g, or t
  misc_feature (357)..(357): n is a, c, g, or t
  misc_feature (366)..(366): n is a, c, g, or t
  misc_feature (393)..(393): n is a, c, g, or t
  misc_feature (400)..(400): n is a, c, g, or t
ggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgttttgttaacttgggttaaaaaaaaaaaaagtctgatgggtttnaattgaaggaaagattggtactacagttctttggtggtaaagagtggtgtggttcttttcccccaaagtggttncagcaatatttaaggagatgtaagagctttacaaaaagacactntgatactgntttcaaaccagtatacaagataagctnccaggcngcatagaaggaggagagggaaaaggtttggtaagaaaccactcaagataacaggaacagtgaagtaatccgtacctggtgttggtcggattactaacataacaaataaccaacccttccctgaaaacctcaatgcatacatacacatatatacacacacaaagagagtactcacctgacagtggttccttcagttgcggaatatagaatggcaagttttacagcagcccccatacagggatctaacctttttagaaaagcttaattcctttaccaaacggtggtactttactacacagttcccggaacactacgctcaagaagaggtctcgagccaaagaagctaaaa

SEQ ID NO: 691730 - DNA, 285 bp, Homo sapiens
  misc_feature (71)..(71): n is a, c, g, or t
ttcaacagtgaatagtctcttgggtctgaatatacctgggtttgtttttgtgtttttgagacggagttcgnctctgtcggccaggttggagtgcagtggtgcaatctcagctcactgcaacctccccctcctgggttcaagcgattctcctgcctcagcctcctgagtagctgagattataggcctaccaccatgcccagccaatttttgtatttttagtagaaacgggacttcaccatgttgcccaggctggcctcgaactcctgacctcaagtgatccacccg

SEQ ID NO: 691731 - DNA, 959 bp, Homo sapiens
aacgcggctgaggaaggggaagatagaaggacaatgtggcaaatgatccagattatgagccaatgaaggatcagaaactccagctagagtgcatccgaagtgatgctagatgtagtgtggtcttgacgggtaagcctgatatgtaatagctcgtaagagatataatcttatttacttagcagaaccttatgttttagtatgttactgggtagaataggtaatctgttcttaccaggatcagggaactgtttttttgaagaccaattcggttctacctagtcatttcaaactaatctgactggcagctatggttgactggcctagatagcggtcaggcgtgtcattcatggctactgtaatgtgggttctgtctggaagtatttgaatgtaagcggctttggagatagatgtataatgaatattaacaactagtttggaacgtgaaatactatttgttaaccatacggtgaaagagttattctgtgtggagagccaaggtgcattgaattacagggggggtggagacacagagtgatggcggcgttggaagtagagttgccctccagtgtgcttggtaaccaaggaatgtgggtgggtatgatttaggacatttgtggtaaatatctagctttgcaagtgacttttacctgcgatacaacttcacaaggtttggcccggcccgcgtaatgtgggtggaacgcggcagggaaacatcgggctccggggagaatcacgacggcggaggacgtgctcacatatggctgggtcccaagggagggtgtacacgggcttgccagataccgggtttactggattggactgacccaggaataacctgttgggggggactgccgccagaaggattctataacacacaagaaaggcgggggggggagcaaaaacaacggtcagatggtatcaagagacgtgtacactggcagtgtaaacaacccggtctc

SEQ ID NO: 691732 - DNA, 354 bp, Homo sapiens
gctcgacgtcggtttgagcctggacgggctgtatgtgccgggccgcctgcgttcccgtggttttgcctggcgattgcggcgaatctgcatcgggtcaaggacgcgccggtgacgggcagtggcgctatctgggctggttgctgctgttcagcgtgatcagcgaagtgccgtaccggatgttcattgacgacgccgatacgctcaacgtactgccgaccctggcgctggggttgctggttgcccggggatggcagcagaaggcggtcattgatcgaggattggcgttgatcgcactggttttggcggggttgttttcggcgcagttgatgttcgggttttttggtgtgctggtcg

SEQ ID NO: 691733 - DNA, 209 bp, Homo sapiens
tcgacctttacaccagacacagcttctaagattgcatacagtgatctccttccatgacttctgccactaactactactccaggccaccactgtcgcctacctggatagctatttatagccttcaacaactgattcctccttgattcactctagctataatatagtatccactataatgcttatccaataacaccctattcaactatatt

SEQ ID NO: 691734 - DNA, 581 bp, Homo sapiens
cgatctagaggaccccggaatgtgtggtgtatggccactttgtaaaataattgatggcttctaaatatattaaacatagaattgtcatatgacccagaaatttattcctaggtatacacccagattattggaaagaggtgttcaaacacaaattgtacacaattatttttagcagcagtatttaaaatagccaaaggctgaacacaactcaaatgtcaataaaaatattattggataaacaaaatgttatatccatgaaattgaatgttatacggttataaaaagaaataaagtaccaatacgtacatgaaccttgatagcattatgccaactgaaagaagtcaggcacaaaaggccacctattgtatgattctatttagatgaaaacagaataggaaagtttatagagacagaaaacagatttgtggttgcttaggattgagtaggggatgagtctataggatgttaacagctagagaaggtggggtttctttttgaagtgatgaaaatgctctaaaattcattgtgatgatggctccacttatctgtgcataacaccacacaattccgggtaccgagct

SEQ ID NO: 691735 - DNA, 627 bp, Homo sapiens
  misc_feature (532)..(532): n is a, c, g, or t
  misc_feature (626)..(626): n is a, c, g, or t
cctgtgagtgaacggaaggggtgtcgtctgcagatccctgccttccatactcctgtgttcaaggctgcaaattgggagaagcttctgacttcatcgtccgccagggacactgatccaggtgccgtcctctgcaggggaagttggttgctacaagatctgttcctgtggacaaagtggcctcttggaaaactgtatggaaatgcactgtatcgacctccagaagtcttgtattgtcggaggaaaaagaaaaagccacggaacatcctttactattgattgcaatgtctgttcttgttttgcgggtaatttagtgtgttccacccgcctgtgcctcagtgagcacagttcagacgacgaccgccgcaccttcacaggtctgccctgtaactgcgcagatcagtttgtcccagtgtgtgcacagaatggacgcacttaccccagtgcctgcatcgctcgctgtgtgggtctccaggaccatcagtttgagtttggaccttgtatctccaagaatccctgtaatcctaaactctgncccaaaagccaaaggtgtgtggcaaaaccacaagtctggctgacgacttttgataaatttggatgtaggccatatgagtgtgtgtctagaaagnt

SEQ ID NO: 691736 - DNA, 268 bp, Homo sapiens
tggttatcagctaatactggagcagtatgttcctgaatccgtgcccaaaacatcactggagaacagctcctgcagttggatggaaactaaacttaaggctcttggaatgacagcatcccaggaccgagcagtggtcaacacagacactcaaggaaatgaagatgtctctagagaaggctcggaaggcccaagagaaaatggcaacacaaagagaaaagctaaggagagaggagcaagagcaaatgcagagaaaccgtcgaattcgatg

SEQ ID NO: 691737 - DNA, 108 bp, Homo sapiens
agaggtatccctacaagtagaagagacgaaaggactgagcgcatctgggagacatctttggcctgcttgctacacttggggttatagtcacacaggccgggccacccg

SEQ ID NO: 691738 - DNA, 115 bp, Homo sapiens
gacctagaggatcccgtgatgttatccccaacacattctaaagaaactaagtagggcatgtacttggatctctgcgtcgataaccattgcttctctccttttgtgcttggtgctt

SEQ ID NO: 691739 - DNA, 435 bp, Homo sapiens
  misc_feature (84)..(84): n is a, c, g, or t
ctcctcttcagagatcctgaccatgtgggtcatgggcggggcatgagtgatgtgatgggaaactggctcctggctccagtagangtgaacaactggagcctgacaggaagtccctggcactggtccagcccatcaaaccaggtaagtccttggagtctgagtagggacaagagactgttctgtgctttggcagggatcaggaagatgttagaatgtggttgttggaacttatctttggagctgaacaaacatggctttgcatctccactttgctatcaactgagtggctttaattaagtggcttcatttcttagatcctcagtttcttcatattcacctgtaaatttttttttttacatttttagactgttgagggcggtaaattagatcatgtacataaagcaccgagcactgtgctagacacattggtactta

SEQ ID NO: 691740 - DNA, 393 bp, Homo sapiens
acatgtacgccgggttagcagatgtgctgcttttagtattcaaagagttggatatcctccgggcaatcttaaaagtacaggcattcatgtgctggaggtatacggcccatccacttctctcccatgcaggtgcgccagcagatccatccggtcagagccaaataagcatgtgggttgggccatccacatgggccacggtgatgtcgacagcccgcaggctccgtttctgcaggctgcctcagatggtctccttgagctggttcttcacctttggcgttgcgatcttttccagaagtccctgggcttgttctgcagacataccagccttctctgcagccgccaggatgctctgcggctcggtgatgtcttcattccttaacccgagcgctacca

SEQ ID NO: 691741 - DNA, 175 bp, Homo sapiens
gagagcaagtagagcccgaacagacgagctactagactgctaaagagcacccgctatgtgcaatagtgggagattataggtgagcgacaactacgagctgtgatagctgagttgtcagatagatcttagtcactttaatttgccacagaacctctacatctctgtaaattaactg

SEQ ID NO: 691742 - DNA, 262 bp, Homo sapiens
atgttggtagtctgctgacgtgtggatttagttaacatttatcaatctgaattagaatattctatttctgtgtctttctcacatatgtacaccagtccctgtgaagataaaactccatgttctactcagctcatagttagccccagcacctagcccagactcttggtcagtgtgtcaagtgatgaatgaatgaagagaacatatataaatggacacatgcataaatcctcttatcataattcccagggaattctatcgagtg

SEQ ID NO: 691743 - DNA, 252 bp, Homo sapiens
aaccacgccaccggagaaggcttcagagagacagcagggccctggagtagcagatataggttagaattcgctcccactcagctgagtaactctaagctagttcactgggtgccagccgccacagtaagtgtgcagtacccacttggctccctgctctttttagcacagcagctttatgaccacttacattagagcttgttctcacacggcttgtaattgcatcccttctccggtggcgtgtggccgccactg

SEQ ID NO: 691744 - DNA, 123 bp, Homo sapiens
gcacatgaggtgttccattgggggtgtcataaccaatgatgcccttccttgttgctggctccagatccacattgtccacgacctgtgccagccctgcccaccagctggagtttctcagctgcg

SEQ ID NO: 691745 - DNA, 1630 bp, Homo sapiens
  misc_feature (690)..(690): n is a, c, g, or t
  misc_feature (1123)..(1123): n is a, c, g, or t
gcttgtgtttgttagccgcgacgtgtgcgtgtgatgctgccgcacgacaatgtagaatcctatgaccccctttgtgggttctaaagcaccctattatcgtagtttttggggggacacccctcgtggagactccctccctgaagggggtcgccagcacggaggtgtgtgcaccacaatagatgcccatggcgcttgttgataaataccgtgtcggggccccctcattgtacctgttttagccggggtgtcttattagggtttttgccgtagggctccctttgggggtgtggcgccgacaattttcctgcgggccactcacgtgggccgaagagtaatattttgaaagagactatatattttttgttgtcacgccaacatgtatcatcggggtcctggtgttggagcacacctcttttccccccacagagaaaaaattgtgtgcggcaccacaacaactaatacctcctctcgtaaagagtgtgagaccgcccaccccacgccgtgtatttctctcttgatatagggggccccccccccaccgcagaggggagaagaccccttctctcgcgagaggaggaagactttttctcacttgtcacaacactgctcacacatgttgtagatgatacttctcacccccctcctctcgtttctgcgagataagagatataatataaaagaggaggtctnctctccggggtgtgatgagacacacacagtgggtgtgcgggggtgtaaaacacagagacaaagggagatacctcttggggttgaaacccgcctgttttcggcggagactcatctatgttgtgagagtggtcacagctggtggtgacacccgagacacactctgagttctcaaacagagggtgtgtgtacacacactctggggtcgtcttcttctcccttctgatcaccacacagagtgagagaggagtgtctctgtgtggtgatatggtctctcacactactgtctctctcacactctcacacgcgctgtgtgtgatactccacagagagagagatattgtgaggtctcttctctgtgtgtgtgatgtatactcttctcaggaatatttttctcttgttgggtgtgaaaatataacacactctcccacagagngtgtgtctggagtaagtagagagagacccacagagtgtgtgtgtgtctctggtgtgttcaacagtagagtttctctcacacagccccacgagataagagtatgagagttgtaatactctctctctgagaagagagaaaaagacgacactctgtgagagctcttgtgtttcacacatatttcacagccggctctgttgagtagttcacagccacgtcccccacacacctgttataaaacacacacagcgatatatactcacggagagaaaaatttgttgggagtgtggtgatatctcatagtgtctgtcttgagaaaataagagagaactctgttttcacaccacagggtctgagtgagataaaagattcttaaagagagtttaaccctgtggtcaccacaaaagataagaatgtccccgatgcgccacctttagaaccctaccttgtgtgataaaagttataatggaatgcccattataaggaccctatttgtgatttgtggaaata

SEQ ID NO: 691746 - DNA, 1375 bp, Homo sapiens
  misc_feature (46)..(46): n is a, c, g, or t
  misc_feature (69)..(69): n is a, c, g, or t
  misc_feature (73)..(73): n is a, c, g, or t
  misc_feature (75)..(75): n is a, c, g, or t
  misc_feature (86)..(86): n is a, c, g, or t
  misc_feature (94)..(94): n is a, c, g, or t
  misc_feature (110)..(110): n is a, c, g, or t
  misc_feature (130)..(130): n is a, c, g, or t
  misc_feature (607)..(607): n is a, c, g, or t
  misc_feature (1350)..(1350): n is a, c, g, or t
cggggaacggggggcccccaacaaagggccgcccatcgggatcacngaagccacgcgagaagacatgangaangngcctaagaacncacaccgntggaacgattctgccngcatcaacctggcagggggntttgactgtctctgcccctctggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggcncagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtgacttttgtcccatctactgcatacttagtgctgagatccctgtaaaatgttttgatgaaaatatgtatgtagagtccagtcgcattatacatacatttcatagtgctgaaccttcttaaatgcctactcattcagcttaaaacaggctgaagccaagtatgacaaagaggggaagggccaaaaacataatcaaagaataattttaaagagaantcttgtctctcttgcaaaaaaaaaa

SEQ ID NO: 691747 - DNA, 121 bp, Homo sapiens
agttcgacggagactctccaggatacggaggatagctgctggattatacgtatcctggcagagtccaataagaattcgtgggctcgctagtcgccagtacacgtgcaggaggaactgcatc

SEQ ID NO: 691748 - DNA, 823 bp, Homo sapiens
  misc_feature (24)..(24): n is a, c, g, or t
  misc_feature (65)..(65): n is a, c, g, or t
  misc_feature (67)..(67): n is a, c, g, or t
  misc_feature (72)..(72): n is a, c, g, or t
  misc_feature (76)..(77): n is a, c, g, or t
  misc_feature (80)..(80): n is a, c, g, or t
  misc_feature (172)..(172): n is a, c, g, or t
  misc_feature (174)..(174): n is a, c, g, or t
  misc_feature (178)..(178): n is a, c, g, or t
  misc_feature (203)..(203): n is a, c, g, or t
  misc_feature (270)..(270): n is a, c, g, or t
  misc_feature (408)..(408): n is a, c, g, or t
  misc_feature (418)..(418): n is a, c, g, or t
  misc_feature (763)..(763): n is a, c, g, or t
  misc_feature (804)..(804): n is a, c, g, or t
ggccggcagcttcaaccacttggncaccttgcccaggctcctcttcacgggctgggccgtccctngnatggncttnnttnggaccagcgccccctcctcagcagctggctcagacttaggtgcagggtcaggggctggcaattttgaaggggacccggcggccctggacatntncctngccaccagcacatcggccgcagatngggagatggcatgctccagcaggccaggctccaggtagacacctgccggctcctcggctcccaagtncaccagagcggccgggaagaggttcgcctgaaagagggtctgcgtgtggtcgtccaggactgtttttggaggggtgatgaacaggtaaaatgacagctcggggttccccaggtggctcctcacgaagtctcgcaagtnccccactgtntcgctggggcggaagaagccctgtaggacgtagcggtcggggaacaggaccctcagagccacctttgggtagcgctccagcttctcctttatctgcgcctccctgaaggccttggtcaccaagggggcttcttccaggcgcttccgctcactcttgagctgggccaagcgtcttctcacgtcgtccaccgtcagctcaaagaactcatcaggcagctccgctggccaggcctgcagccgctcctccaggtcggggtggcacacaccgggctcccggtccacgggctcccggtccacgggccgctcccgctcctgctcctgcttggggatcccgctcccgctcctnctcctgctcctgctgggggatcctgggccgacttggacttnttttggtttggagggggct

SEQ ID NO: 691749 - DNA, 849 bp, Homo sapiens
  misc_feature (81)..(81): n is a, c, g, or t
  misc_feature (824)..(824): n is a, c, g, or t
ccctcccagtgcacattgctggccagtgctgtaaggtctgccgaccaaaatgtatctatggtgtttcacggcttagtggcncagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtgacttttgtcccatctactgcatacttagtgctgagatccctgtaaaatgttttgatgaaaatatgtatgtagagtccagtcgcattatacatacatttcatagtgctgaaccttcttaaatgcctactcattcagcttaaaacaggctgaagccaagtatgacaaagaggggaagggccaaaaacataatcaaagaataattttaaagagaantcttgtctctcttgcaaaaaaaaaa

SEQ ID NO: 691750 - DNA, 119 bp, Homo sapiens
ttatgttggagtgggagggagacggtgtcttagcgtaggctcatctatgtactgcatttatagagatgtagctttaatatttctgagagatgtaaaacattctgctttcttagtcttac

SEQ ID NO: 691751 - DNA, 989 bp, Homo sapiens
tagtaaaggcagagtttcaccatggttgggccagggattgttctcgatctcctgtgacctggttgatccgcccacctcggcctcccaaagtgcggggattacgggtgtgagctaccgcacccgtgccaatataaactattctatagctcaggggcatagtgcaaagcctttaggcgtgaccccgtgaactccagaagcggctctctcggaagaacaagccattttctggtgagcgtgccccgagtggtgataacgtgagtgtgtggtgcagatagcgtgagtgtgtggttatagtggccttctccacatctcatacgtgacattgtgctcaaaacacaaattgtgactgtgcaacagcggacacagtgtgtggaggggcggcgcgtgacattattgcacaaacacaatatactcttttcaaatagaaaggtgctcctttcagtggagctcttcttctctcttcctcttacatatcacgtgacatcaccttcagtgtgtagaaaaccactatcaaatttatttcacccccgagcaccttaatcctttgttacaccccaaagtggtgcccatcgttcattccctagggtttgggggactacaaccgtggcaaagggagaagtaactgcactgatgaaatactctcataaaccattaatagtgtgtgtcccaataaaaattcactccctcaaataaatctggagagatagacaaaacctcccacaccctttgttacagcccttcatccatgcccctccaatacatcaattcacaaagaagattaaagagggacagacagcatgaaaaacgtcagagcagacccaaggcccagataaggattaccacagatacaggccccagagaactcccctaggagaaatacaaccaaagatacccacgagagggggacaaaaaacccgtaagaactctcaagataataacccaataccaataagaaaattgggagccagtctataaaaaaacgcgaccga

SEQ ID NO: 691752 - DNA, 170 bp, Homo sapiens
gtgctccaggacactggcacgtggcagagcgactctcttcctttcgccctttccattgtctaccccaccgcctccccttgaaagtgttcaggtttaactttccctccctattcccttagttcccgttggtaggcaggtctccctcccctgcaatcccataccatgttcaa

SEQ ID NO: 691753 - DNA, 759 bp, Homo sapiens
  misc_feature (26)..(26): n is a, c, g, or t
  misc_feature (414)..(414): n is a, c, g, or t
  misc_feature (494)..(494): n is a, c, g, or t
  misc_feature (533)..(533): n is a, c, g, or t
  misc_feature (540)..(540): n is a, c, g, or t
  misc_feature (566)..(567): n is a, c, g, or t
  misc_feature (582)..(582): n is a, c, g, or t
  misc_feature (594)..(594): n is a, c, g, or t
  misc_feature (606)..(607): n is a, c, g, or t
  misc_feature (613)..(613): n is a, c, g, or t
gcattaattactgcgcttaatcagcnaggctatcagctggggttattctcatcagatggctttaccagcccgctgtatcgccaggcattgttgtcagatttctcgatgccgagcgtacgcacccaatccgacgagcagaccgccacgcaggggatcaactggctgggacgctacgcacaagaagataaccgctggttctcgtgggtttctttcaatggtactaacattgacgacagcaatcagcaggcatttgcacggaaatatagccgggcggcaggcaatgtcgatgaccagatcaaccgcgtgctcaatgcactgcgtgattctggcaaactggacaatacggtggtgattatcactgccggtcggggtattccactgagcgaagaggaagaaacctttgactggtcccanggtcatctgcaggtgccattagtgattcactggccaggcacgccggcgcagcgtataatgctctgactgatcataccganctgatgacgacgctgatgcaaggcctgctacatgtcagnacactgncagcgaatattcgcaaggtcaggatnngtgcaacctcaacgncgcttactgggntaccgcacggannaacgantacgctggcgagtaaccaccacgaacaagacgcggtactgaaccaatagcggaaactaccgcactagacacttacgtggtggaaagagtgacagatgaaaagcacagaaacgatggaatgcactgcatgacacacgcaaagcgaaa

SEQ ID NO: 691754 - DNA, 368 bp, Homo sapiens
tacaggacctcgcgtatccgtacactcccaatatcttacatttcgtctgcgtaagtaatgcgtaactaggctataatgacgcacttctccctgcgtcatggattcaaggtcttttaatcacttcgtttaatctctttaaagatcgcttcaatatttaatcactacaatttaaactaaactttaagctgttaagtcaccttcattttaatctaaaagccatggcctttctattggtattaattcggggcctctgtagtcctttctctcaattttcttttaaataccattttttactccatgaaggagcttcatctcaacctcccgtcatgttttagaaaccttttatcttttccttcctcatgctactc

SEQ ID NO: 691755 - DNA, 207 bp, Homo sapiens
cccctggtgcccactggtagcctttgggcccacccagcacccacctgccactctagggcccacccagcacccgcctgatgagcctttgggccccccagcacccgcctgatgagcctttgggtcccccggcacccacctgccagcctagggcccgcccggcacccacctgccagtctagcgcccacccggcacccacctgatgagcct

SEQ ID NO: 691756 - DNA, 649 bp, Homo sapiens
gggtagacctgtgggggatatctcatgtgtgctggacagatggactggctggggacaatggtggctggctggtctgagagtggctgtgagcgtcaagtcccctgtcggttcctccgtccctgagtgtccttggctgctgcttgtgccctgcccagcgcctttgcatccgctcctgggcaccgaggctgccctgtaggatacttgcttgttacttattacggctagagtgcatcatggacctgatctaaagaaaactgcatttcaggacctgttaagtgctacatgtccagtttggagtgtccaaaacgtgttctcgtgactcagcaaattccttgtcagaatccattacctgtaacatatgtggccatggctcagcgggtcattgtgtccttcaaattcttcccagctgcgttccttatgcaagcacaaaagcttgtctccagtcacaagccggttcagaatcagaagcagaagcaatctgcaggcaaccagtgtacctcatcctgtctccaggcactgaataacacccaaaagagcaagcagcccctgagatcgggacctgaaactaatcctgaggaggaacctgggatcacaaaggaaacatgcacgaatcaaacaaagatgcccgtcggctttggaagactttgaa

SEQ ID NO: 691757 - DNA, 128 bp, Homo sapiens
tgatatgatcttccccattggcatacgacacaatcctgaagccctcgggacaggagctgctccagcaggcacgtagtgactggaaatgtttatcctctagcatgctgctcccacgcacttgacctcga

SEQ ID NO: 691758 - DNA, 189 bp, Homo sapiens
ctttctaggcaggagagtgtgaggcagtgaggagggccacacccatcggtaggcaggagtcagtgcgatgatacagaggggggacgatactgccagattcaggataagttcagaggtgaatgccaagactgtgggatcagttggatttgctgcggctcggcagcgaccccgtgtcgggctagtcggggg

SEQ ID NO: 691759 - DNA, 261 bp, Homo sapiens
  misc_feature (55)..(55): n is a, c, g, or t
  misc_feature (75)..(75): n is a, c, g, or t
  misc_feature (93)..(93): n is a, c, g, or t
  misc_feature (138)..(138): n is a, c, g, or t
  misc_feature (178)..(178): n is a, c, g, or t
  misc_feature (218)..(218): n is a, c, g, or t
ggaggattgcttgagcctgggaggtggaggttgttgtgagccaagatcatgccantgcactctagcctggagganagtgtgagaccctatcgnaaataaatcaattaaaaaaattaaaattaggtttggctgggtgtnggtgcacgcctataatcccagcactttgggaggctaaggnaggattgcttgagcctgggaggttaaggattgcagtgggntatgatcatgccactgcattcccacctgggtgacagagtgagc

SEQ ID NO: 691760 - DNA, 164 bp, Homo sapiens
ccctataccagccagacaccaaaaaaagtcgtagccttctccacttcaggtcaactaggactcatagtagttacaatcggcatcaaccaagccagcacctagcattcctgcgacatctggtacccagcgcctctcttcaatagccatgacatatttatgtagct

SEQ ID NO: 691761 - DNA, 977 bp, Homo sapiens
atgcccctcatggacataactgtcatactatcatccatcatcgcagtgtctaggaataatagtgtatcgctcacaccgcatatcctcccgactatgcctagaagtgaatcattgctatctgtttgattcatatatacgttacctcatcataatccatcacatcagccacatcacccatctcttagccatactaatgtgtgctctaattgcgcatagctagtggtttgccgactgcgactgaataggtgtggctttgcacctactatatctctacactggaccaataaatcttgagactaataattaagtaacttaatcctacatccatatatctcaaatcgataaatggttattcgtacctcaaacaaatttgagaattagtacccatcttgaacatttgaatcgtatgttcccacagaagagatctacactcaatgtgcgacactccatactagaaatcacggcaccggctctatatctacataagtgatcatacacacttcatgactactctattctcaaatccataatcaaacaaaataatcttactttaggttagttcgctaaagccctttttccttcacgtactcctcatatactaattccatctatatgaatgagctaatgagcgtggattcttaccaatcacaagtctatggcaaagtcttagcatattcttcagtgggccactttggaggaaataaatatggtaggctctaccgtactactctactataaacattcttaattaaatcattcatatgctcctgaaataatcctgtgttctatctacttccgtacaatccttgttccagacccggtattatttcgcgatgggacggagatgagttgaacgttattcatttccttcttcccaagaggggcccccaaggggggaagccgccgagagtgaaatgggcgtcccggaaagaaactctgcaatttggggtaacctgagacctaggaataggggagcc

SEQ ID NO: 691762 - DNA, 342 bp, Homo sapiens
tgcaggatggcgacacatcaccgtgatcaggacctcaaggatcagggcacttccctggtggtcaaggtcggcaccaaggtcaagaacatccgcctgtgcgacggcgaccacgatatcgactgcaagatcgacgggatcggcccgatgaaactcaagtccgagttcgtgcgcaaagtctgaacctgctgcattccatcccgcgcccgccgcgggatggcgtttcgcactctgcgttgatcgaacgcaatacccacacagaaaaacccagaaattgccaatagacgcttgctattctacgaataagaattattctcattgaaacccatcaaggagaacgaccca

SEQ ID NO: 691763 - DNA, 534 bp, Homo sapiens
ttttattctaaatatttgcctgtacattccagagtgaatctgtagagcgtaatgtggcaagtcaagactgtgagtcaattagtgaggtggactttgtaccctatggtaagttcttaaattatactatactcttggcttgcaaacatgtttagaagagtagtttgtatggacatttggcatctttagcattctcatctatgcgtgtgtgtgtgtgtgtgtgtgtgtgtgtgtgcgcgtgcacacgtgtgcctgtgtaatccagagatccatattagatttccttctcaatcactctccggattattctttgagataaagctctcactgaacctggaactcaccaacctggctatactcgctagccagcaagctcccaggatccccttgactccatcaccctagcagtcagactgtagatgcaagccactacatctgatttaaaacaaaaccaaaaacaaagaaaaccatggttctagagatcaaattaaacaaatttactgattgagccatatctccagcttttatcacacagtt

SEQ ID NO: 691764 - DNA, 126 bp, Homo sapiens
ctgcagaaagatttcaagctttcataaccagttgtgtccggagcacgtgatcatgcctgtatcccaggcactttgggcggtggaggcaggcagctgacctgaggtcgggagtacgagaccagcctg

SEQ ID NO: 691765 - DNA, 343 bp, Homo sapiens
  misc_feature (16)..(16): n is a, c, g, or t
  misc_feature (23)..(23): n is a, c, g, or t
  misc_feature (55)..(55): n is a, c, g, or t
  misc_feature (59)..(59): n is a, c, g, or t
  misc_feature (94)..(94): n is a, c, g, or t
  misc_feature (110)..(110): n is a, c, g, or t
  misc_feature (167)..(167): n is a, c, g, or t
  misc_feature (221)..(221): n is a, c, g, or t
  misc_feature (241)..(241): n is a, c, g, or t
  misc_feature (263)..(263): n is a, c, g, or t
  misc_feature (342)..(342): n is a, c, g, or t
gcgccttgggattgantgtccangctcgcccggctcgtccgaagcgccctccgcnaacngaaaaaaaaaaccgcaagcaatgccgtgttctccntgcggctcggaaaaanaataagaacaataagtgtttcgtctcccaaccaatttctaaggaaaaaaaaagggancgggccaagaaaaaccactggcagctttgaaaaaagggaaaactttaaaaaaanttgaaattggaagcctcaangtgaaaaattaaaaaaacggantccggcaaaattcctctaactcgtcttgttgctgaataaaagtgcccctgtctccaatttttctccaaatcctgggaant

SEQ ID NO: 691766 - DNA, 2644 bp, Homo sapiens
  misc_feature (46)..(46): n is a, c, g, or t
ggagtccaggcaggtataaggccacctccgcaggccaggacaaccnagaagcaaaagagcagagctaccatgtcctcttggagcagacagcgaccaaaaagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccgacaccgtgcacctggccgtggaattcttcaacctgacccacctgccagccaacctcctccagggcgcctctaagctccaagaattgcacctctccagcaatgggctggaaagcctctcgcccgaattcctgcggccagtgccgcagctgagggtgctggatctaacccgaaacgccctgaccgggctgcccccgggcctcttccaggcctcagccaccctggacaccctggtattgaaagaaaaccagctggaggtcctggaggtctcgtggctacacggcctgaaagctctggggcatctggacctgtctgggaaccgcctccggaaactgccccccgggctgctggccaacttcaccctcctgcgcacccttgaccttggggagaaccagttggagaccttgccacctgacctcctgaggggtccgctgcaattagaacggctacatctagaaggcaacaaattgcaagtactgggaaaagatctcctcttgccgcagccggacctgcgctacctcttcctgaacggcaacaagctggccagggtggcagccggtgccttccagggcctgcggcagctggacatgctggacctctccaataactcactggccagcgtgcccgaggggctctgggcatccctagggcagccaaactgggacatgcgggatggcttcgacatctccggcaacccctggatctgtgaccagaacctgagcgacctctatcgttggcttcaggcccaaaaagacaagatgttttcccagaatgacacgcgctgtgctgggcctgaagccgtgaagggccagacgctcctggcagtggccaagtcccagtgagaccaggggcttgggttgagggtggggggtctggtagaacactgcaacccgcttaacaaataatcctgcctttggccgggtgcgggggctcacgcctgtaatcccagcactttgggaggcccaggtgggcggatcacgaggtcaggagatcgagaccatcttggctaacatggtgaaaccctgtctctactaaaaatataaaaaattagccaggcgtggtggtgggcacctgtagtcccagcaactcgggaggctgaggcaggagaatggcgtgaacttgggaggcggagcttgcggtgagccaagatcgtgccactgcactctagcctgggcgacagagcaagactgtctcaaaaaaattaaaattaaaattaaaaacaaataatcctgccttttacaggtgaaactcggggctgtccatagcggctgggaccccgtttcatccatccatgcttcctagaacacacgatgggctttccttacccatgcccaaggtgtgccctccgtctggaatgccgttccctgtttcccagatctcttgaactctgggttctcccagccccttgtccttccttccagctgagccctggccacactggggctgcctttctctgactctgtcttccccaagtcagggggctctctgagtgcagggtctgatgctgagtcccacttagcttggggtcagaaccaaggggtttaataaataacccttgaaaactggatcggatgaattggctttcattgtgttcctagcatcttctcaaatcaacttcccaggactccagggtgaaggaggaaaagaggcatggcccaggccctggggtgtgggatatggtctccctaggggatgacagttgggatcaatggcctgtgacttctcctctcccttcccccatcctgggacctaactggaaataaaaccttgactgttgcccgggtgtcattttaccagtggatttctgccagggcttgtgtcctaggagaaggtttaagttaaaccagattgcccaggtctccaaacgatttgtcatgctgacctgagatcatcgaagggggcacctgcccccgggcaaggttgcaggggcaggatggggctgaagggatgagcagggtcccgggcccacctgctgatacagcattggccatgtgggggctgcaatcggatttggaagaccctggggcttgggggcatgtccagttttcccagctccctaaaaaatgaccatgcagcctggcgccgtggctcatgcctgtaatccaaacactttgggaggctgaggcaggcagatcaccggaggtcaggagttcgagaccagactggccaacatggcaaaaccctgtctctactaaaaatacaaaaattagccaggcacagtggcacgtgcctgtaataccagctacttgggagggtcaggcaggagaatcacttgaacctgggaggcggaggttgcagtgagccaagatcacgccactgcactccaggctgggcgacagagtgaaactgtgtctcaaaaataaaaataaaaat

SEQ ID NO: 691767 - DNA, 133 bp, Homo sapiens
  misc_feature (54)..(54): n is a, c, g, or t
acaaaagatgactttttctttgagcctattttgggcacagatatgtaagctgantttgtatcccatgcctgcctgagttcgaaatgcacagcagtcaagggaaagagaaggccaaacggcagattcctaaaac

SEQ ID NO: 691768 - DNA, 1838 bp, Homo sapiens
  misc_feature (46)..(46): n is a, c, g, or t
ggagtccaggcaggtataaggccacctccgcaggccaggacaaccnagaagcaaaagagcagagctaccatgtcctcttggagcagacagcgaccaaaaagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccgacaccgtgcacctggccgtggaattcttcaacctgacccacctgccagccaacctcctccagggcgcctctaagctccaagaattgcacctctccagcaatgggctggaaagcctctcgcccgaattcctgcggccagtgccgcagctgagggtgctggatctaacccgaaacgccctgaccgggctgcccccgggcctcttccaggcctcagccaccctggacaccctggtattgaaagaaaaccagctggaggtcctggaggtctcgtggctacacggcctgaaagctctggggcatctggacctgtctgggaaccgcctccggaaactgccccccgggctgctggccaacttcaccctcctgcgcacccttgaccttggggagaaccagttggagaccttgccacctgacctcctgaggggtccgctgcaattagaacggctacatctagaaggcaacaaattgcaagtactgggaaaagatctcctcttgccgcagccggacctgcgctacctcttcctgaacggcaacaagctggccagggtggcagccggtgccttccagggcctgcggcagctggacatgctggacctctccaataactcactggccagcgtgcccgaggggctctgggcatccctagggcagccaaactgggacatgcgggatggcttcgacatctccggcaacccctggatctgtgaccagaacctgagcgacctctatcgttggcttcaggcccaaaaagacaagatgttttcccagaatgacacgcgctgtgctgggcctgaagccgtgaagggccagacgctcctggcagtggccaagtcccagtgagaccaggggcttgggttgagggtggggggtctggtagaacactgcaacccgcttaacaaataatcctgcctttggccgggtgcgggggctcacgcctgtaatcccagcactttgggaggcccaggtgggcggatcacgaggtcaggagatcgagaccatcttggctaacatggtgaaaccctgtctctactaaaaatataaaaaattagccaggcgtggtggtgggcacctgtagtcccagcaactcgggaggctgaggcaggagaatggcgtgaacttgggaggcggagcttgcggtgagccaagatcgtgccactgcactctagcctgggcgacagagcaagactgtctcaaaaaaattaaaattaaaattaaaaacaaataatcctgccttttacaggtgaaactcggggctgtccatagcggctgggaccccgtttcatccatccatgcttcctagaacacacgatgggctttccttacccatgcccaaggtgtgccctccgtctggaatgccgttccctgtttcccagatctcttgaactctgggttctcccagccccttgtccttccttccagctgagccctggccacactggggctgcctttctctgactctgtcttccccaagtcagggggctctctgagtgcagggtctgatgctgagtcccacttagcttggggtcagaaccaaggggtttaataaataacccttgaaaactgga

SEQ ID NO: 691769 - DNA, 389 bp, Homo sapiens
  misc_feature (294)..(294): n is a, c, g, or t
ctagttttagaagtttcaattagcaaatggggtggaaagtagagttctcatttactccctgccccgactcatgtataaactctcccactatcagcatcctccaccagagtgtacgttggttacaatcagtgaacttatattgacacttcattatcaccccaaatccacagtttatatcaagcttcactctgggggtacattcaaggggtttgggcaaaagtataatgacatgtacccaccattacaatatcatacagaggtgtttcactgctttaaaattcccctgtgctctgnctattcctccctctcttccccctaagcactgatctctggtattggaacttctagaactaggtgctatttgaaacttctaaaaactaatgggggat

SEQ ID NO: 691770 - DNA, 649 bp, Homo sapiens
gcaagggaacagatcaagctatggatgaatgtgcttcacattccacacccaagtcatttgccttcttagtagagacggggatattcaccatattggaccaggctggtactcaaactcctagacctgaggtgatctcatccacctcaggctcccaaagtagctaggtgatcaccaggcgatgcaaccaacgactgcctgtggtcgacctttgactttatactataaggccacacggcattccatggcgtgaaccaaccgcgcccatggcgcgaagcgctaagtcgactatacgttagggccaacacgagattgaccaaaaatgcacgtccgcgttcgtagccaagtgggcagaacagacaagattatccagtaaacaatcgcactatgaaatctagatacacactatgaacactggaaggaagaagagtcagaatacacgcacacaggcagaccaccttgatgacaacgaaaaccgaggacaacgcctcaaccacacaacaaggagcggcgagcacagacgcgggacgacaccccacaggcccaaggtcgcacccacacaggcctcccggacagcccaccaagggcgcagaacacaaacagagctgagagccaccgcaaagaaggaaaagacgagcgaacacacaagaca

SEQ ID NO: 691771 - DNA, 345 bp, Homo sapiens
  misc_feature (261)..(261): n is a, c, g, or t
gtcggagtggttagctggcagtacgggctctggagcagtttgccactgtggtggaggccaagctgatccacaagatggggattgtcaatgaacagtttctgctgcagtggctggcagacggggccatcgacctctatgccatggtggtggttctgtcgagggccttaagatccctgagtgagggccaccacacggtccaccatgagtgctatgtgacacctggtgtatcaaggctgcagctcggatccgagagggcatgancggcctgaagtctgacccctggcatcaagagctctaccgcaacttcgttggattatgaatactactgtgcagggtctgttcttt

SEQ ID NO: 691772 - DNA, 762 bp, Homo sapiens
  misc_feature (46)..(46): n is a, c, g, or t
ggagtccaggcaggtataaggccacctccgcaggccaggacaaccnagaagcaaaagagcagagctaccatgtcctcttggagcagacagcgaccaaaaagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccgacaccgtgcacctggccgtggaattcttcaacctgacccacctgccagccaacctcctccagggcgcctctaagctccaagaattgcacctctccagcaatgggctggaaagcctctcgcccgaattcctgcggccagtgccgcagctgagggtgctggatctaacccgaaacgccctgaccgggctgcccccaggtgggcggatcacgaggtcaggagatcgagaccatcttggctaacatggtgaaaccctgtctctactaaaaaaaaaaccaaaacaaaaaaaaaaacttttttgggccccgcccgagggcccctgcgaaaagaagttgtatgagcacatcgcggttgtgcgcgccgcggcgcccagagggtaagcggaaccaggggcacaaacgggtgtcaccgaggacaaccccggggacagaacaaggggctgtggattccaacaaatgaaaaacgcgcgcgggacaacggagggtgtgaga

SEQ ID NO: 691773 - DNA, 2048 bp, Homo sapiens
  misc_feature (46)..(46): n is a, c, g, or t
ggagtccaggcaggtataaggccacctccgcaggccaggacaaccnagaagcaaaagagcagagctaccatgtcctcttggagcagacagcgaccaaaaagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccgacaccgtgcacctggccgtggaattcttcaacctgacccacctgccagccaacctcctccagggcgcctctaagctccaagaattgcacctctccagcaatgggctggaaagcctctcgcccgaattcctgcggccagtgccgcagctgagggtgctggatctaacccgaaacgccctgaccgggctgcccccgggcctcttccaggcctcagccaccctggacaccctggtattgaaagaaaaccagctggaggtcctggaggtctcgtggctacacggcctgaaagctctggggcatctggacctgtctgggaaccgcctccggaaactgccccccgggctgctggccaacttcaccctcctgcgcacccttgaccttggggagaaccagttggagaccttgccacctgacctcctgaggggtccgctgcaattagaacggctacatctagaaggcaacaaattgcaagtactgggaaaagatctcctcttgccgcagccggacctgcgctacctcttcctgaacggcaacaagctggccagggtggcagccggtgccttccagggcctgcggcagctggacatgctggacctctccaataactcactggccagcgtgcccgaggggctctgggcatccctagggcagccaaactgggacatgcgggatggcttcgacatctccggcaacccctggatctgtgaccagaacctgagcgacctctatcgttggcttcaggcccaaaaagacaagatgttttcccagaatgacacgcgctgtgctgggcctgaagccgtgaagggccagacgctcctggcagtggccaagtcccagtgagaccaggggcttgggttgagggtggggggtctggtagaacactgcaacccgcttaacaaataatcctgcctttggccgggtgcgggggctcacgcctgtaatcccagcactttgggaggcccaggtgggcggatcacgaggtcaggagatcgagaccatcttggctaacatggtgaaaccctgtctctactaaaaatataaaaaattagccaggcgtggtggtgggcacctgtagtcccagcaactcgggaggctgaggcaggagaatggcgtgaacttgggaggcggagcttgcggtgagccaagatcgtgccactgcactctagcctgggcgacagagcaagactgtctcaaaaaaattaaaattaaaattaaaaacaaataatcctgccttttacaggtgaaactcggggctgtccatagcggctgggaccccgtttcatccatccatgcttcctagaacacacgatgggctttccttacccatgcccaaggtgtgccctccgtctggaatgccgttccctgtttcccagatctcttgaactctgggttctcccagccccttgtccttccttccagctgagccctggccacactggggctgcctttctctgactctgtcttccccaagtcagggggctctctgagtgcagggtctgatgctgagtcccacttagcttggggtcagaaccaaggggtttaataaataacccttgaaaactggatcggatgaattggctttcattgtgttcctagcatcttctcaaatcaacttcccaggactccagggtgaaggaggaaaagaggcatggcccaggccctggggtgtgggatatggtctccctaggggatgacagttgggatcaatggcctgtgacttctcctctcccttcccccatcctgggacctaactggaaataaaaccttgactgttg

SEQ ID NO: 691774 - DNA, 317 bp, Homo sapiens
  misc_feature (32)..(32): n is a, c, g, or t
  misc_feature (57)..(57): n is a, c, g, or t
  misc_feature (71)..(71): n is a, c, g, or t
  misc_feature (180)..(180): n is a, c, g, or t
  misc_feature (182)..(182): n is a, c, g, or t
  misc_feature (261)..(261): n is a, c, g, or t
ccttgattttgaaaatttccccccaagaatgnggcagtaaaaacaacaagacacccnaaggaataatgtcnccattgtcttaaccctgttccaaaacaaaaatcacctcccttccttaagagaaaggaatctccataaaattccagtatttaaaaagcagtttactgttctggaccttcngntggatcacaatcaggtaaaagcccccttaaactgaggaaacggcaaaatgtgttttaaagctctttggatttccccagntcctgaccctgtaaaattggaaaaaagcaccaaaaaagccttttttaaaatcctga

SEQ ID NO: 691775 - DNA, 453 bp, Homo sapiens
ttgcctccatgcctgcatgtactcaggaagaccgatcacaggtgaacatgcttgcctacaaggcagcgacacacccacgcatatgcacaaacacacactcaaccacttccccgtgcaggatcttgtgttttcaaacacacacataactgcaggcatgcaccatgtttcacaggccacactccccaaaggacaagggcgcacttagaaatggacagggatgcacttgtgtgagacaaagagagcgagggagggagagagagagattagctgactcccttggatctccttaggaggttcttagtggactgaggagtagcgcttctactcccccgaccgcaatatcttctccccagatctctggagaaactagatttttttttttttttttttcacagagtcttgctttgtcacccagactagagtgcagcggcacaatcatagctcactacagcc

SEQ ID NO: 691776 - DNA, 716 bp, Homo sapiens
aggtgtaaatgatggccagtgtaaaaaggacgagcaagtgtaaaaaaagagggcaggcacaacgacgtgtagttcatactgatgtcaaggactatatacgcaggtatgtatactgggggactagtcacaatagcaaacaattggaaccaacccaaatgtccatcaataatacactggataaagaaaatgtggcatatatacaccatggaatactatgcagccataaaaacagatagagttcatgtccattgcagggacatggatgaagctggaaaccatcattctgagaaaactatcacaaggacagaacaccaaacaccgcatgtactcaatcataggtgggaatttaacaatgagaacatatggacacagtgcagggaacatcacacaccagggcctatcatgaagtgtaggggctgggggagggatagcattaagagaaatacctaatgtaaaatgacgagttaatgggcacagcaaaccaacatggcacatgtaaacctatgcaacaaacctgcacatttgtgcacatgtaccctagaacttaaagtattagaataaaaaaaattaccaaacaccacaaaaaattaagatgggcaagaaaattccacgtccccgaaatccaaaaatagaagacaagaggaagtaaccaacttggcccatggcaagtgccaagacgacggggaaaagttgctgtgcctgagaccaagtggcga

SEQ ID NO: 691777 - DNA, 369 bp, Homo sapiens
  misc_feature (82)..(82): n is a, c, g, or t
atgttgtatttttagtggagatggggtttcactatgttggtcaggctggtgtctaactccctgacctcgcgatctacccgcntaggcctcccaaagtgctgggattacaggcatgagcgactgtgcccggccagcttacaaactttttaaggcattgaccactgcccagtgaaaagaaagaaatagtcaacatctatattttgtgaacaggcaacaatatgagtgaatccatcaaatggagataaagccccatactgacttctcaaggctgggcacccacctctaaaaggatgcagagtcacaagatactatggattggggagcagatccgtcgacgcggccgcgaatttagtagtagtaggcggccgc

SEQ ID NO: 691778 - DNA, 149 bp, Homo sapiens
cgatctggttgctttttaaaaaactttctatagagacagggtcttgccatgttgcccaggatggtcttgaactcctgggctcaagctatcctcccacctcgtcctgccaaagtgctggaattataggcatgaaacaccccacccgatcg

SEQ ID NO: 691779 - DNA, 197 bp, Homo sapiens
ctacttggaaggctgaggcatgagaattgcttgaacccaggaggcagaggttgcagtgagccgagattgcgccactgcacgtccagcctgggcaacatagcgagactgtctcaaaacaaaaaaaaaggagcaatgacttccgccttcatacaggctgaggtttttaattcaaaagtccttaacttttattatgttat

SEQ ID NO: 691780 - DNA, 241 bp, Homo sapiens
  misc_feature (20)..(20): n is a, c, g, or t
  misc_feature (36)..(38): n is a, c, g, or t
  misc_feature (63)..(63): n is a, c, g, or t
  misc_feature (75)..(75): n is a, c, g, or t
  misc_feature (89)..(89): n is a, c, g, or t
  misc_feature (110)..(110): n is a, c, g, or t
  misc_feature (118)..(118): n is a, c, g, or t
  misc_feature (138)..(138): n is a, c, g, or t
  misc_feature (141)..(141): n is a, c, g, or t
  misc_feature (219)..(219): n is a, c, g, or t
  misc_feature (238)..(238): n is a, c, g, or t
ggagcatgtataaataagantgtaggcatgtataannntgtatgcatgtataagttctttganaattatattatntccacagattttcnttctggatactaatgatgtgncagatgantcaggtactgattcatcttntgncatcatctaatgtgttttatccagttatcttctagcagtgtgcaattcaaaaacatcattggtgtctaaactcttaanacatccgttagagcaaatntaa

SEQ ID NO: 691781 - DNA, 609 bp, Homo sapiens
  misc_feature (106)..(106): n is a, c, g, or t
  misc_feature (179)..(179): n is a, c, g, or t
  misc_feature (249)..(249): n is a, c, g, or t
gcttctcgcctaacgccgccaacatggtgttcaggcgcttcgtggaggttggccgggtggcctatgtctcctttgtgacctctattgccgggaaaattgggtcgcngatctggtagaatgtttattggatccaggacacgaaggcgctttggtcgcatggcacctgtgcaactcaaagntgacggaagacaggccatgccccttttcaaagtgcatggcaagctcactggggatttcatgcctcaaggntttttccccgggccaacaaaggtggcgccccaacccaaggaaaagcttaattggttccccggaccataaggccccttgggccaggcaaaaggggccaggaccgagttcaaaagttagcgaaaaaaaagtgggggggccaacggcccccaaactcacccgggaaattgggggggtccccccaaaaaaagggaaaacacaggcaaacatttttgggagaaaaataaaccccaagggcaggcaaaaaaaggcggaagaagaagccccaaaaaggcgaattggaaaaccaaaaggcaacctttttcttctttgggggaaaattttccccgggggttttttttctttttttacacaaacaaacgg

SEQ ID NO: 691782 - DNA, 374 bp, Homo sapiens
gatgaaacgtgcccagcatatataatattaccaatcattggttttggtactaatctcatgcttttatcgtttttaccgagcaaaacataagcagccagtacggagtcgggagctgaaggcacattgtgagaagtgagcagaggactcgagtgaaagtcctctgtcacgccctgattagggctgcctgatgacaccttggttctagacagtagcgccgagtgcctggtaagggcacccgttacttagcatacctcagatcttgcggttgcgcctgtgcctgggaaggcaactgttacttagcagactgggacagggaactctccttgggggagtccgagaacactgctccaccagctcttgtgggaggcctgaca

SEQ ID NO: 691783 - DNA, 132 bp, Homo sapiens
ggagtcggtacccccacttcatgcgtgggaccaaaccctcgatctggcgcgtgacgacgcatgacgccaggcggcctcacctccggctcagttcgtatctccccaaccaaaatatatcccttatacaaatta

SEQ ID NO: 691784 - DNA, 964 bp, Homo sapiens
gcttcgtacatagtaatacccatcataatcggaggcttaaggaacctgtctagggtaacgaccagatctacaacgttatcgtcacagcccatgcattggtaataatctatctacatagtaatacccatcataatcggaggcttaggcaacatgagcgtacgttccccgtaagtaactcggtgccccgcgatatggcgttgccgccgcgataaacaacagtaagcttcgtgactcttacctccctctcatccgtactcctgctcgcagtcgtgctatagtggaggccggagcaggaacgagggttgaacagctctacccttccctgtagcagggaactaaaagaagaaaaaaaaaaaaaataaaaagaaaataataaaaacagagaacatcacaaacagaaataaacaacataaaaagaagagaatgcgccggtgacgcctgcagatatctggggagcgtgaggggggaaatggagagacaggcacggaagagaaaaaccatggagacctagcgtgcccaatgccagcgcgcacctcctgccgacagccactccgcggggcgcctatcggcgaacgcggcaaacgcgagcgcgctgacaaaagaatccaggggacgaccacgcccaattaatggacgaggggcaagcaaggccactcaacagtccaccacggaaatccaacccgcgccgccgacgacacagaccgagcgcacatagagaccggaagcacaagggcgcccaaccccgacaccggcaagcgcggcacactcggaacgctacacctagaaaggcccctggaacagactagtggcgcccccaagggcgcacttccccataaacgtgggggacaaagccgggacgccaccgcggcgtaacccgacacaaatcaaagaaaacaaccccaagagccccccagaggacaaaccatggacccaaacaacaacagcagccaatcagccaaccagg

SEQ ID NO: 691785 - DNA, 870 bp, Homo sapiens
attaatcccctggccaacccgtcatctactctaccatctttgctggcacactcatcacagcgctaagctcgcactgatttgttacctgagtaggcctagaaataaacatgctagcttttattccagtgctaaccaaaaaaataaaccctcgttgccacgagaagctgccatcaagtatttcctcacgcaagcaatcgatccatagatccttcgtaatagctatgctcttcaacaatatactctccggacaatgaatcatagccaatactaccagatcaagtactcatcattgaataatcatgaatggctatagcaataaaactaggaatagccccctttcagttctgagtcccagaggttaccccaagggcaccccctctgtactatccggcctgcttcttctgcaacaatgacaaaggaataggccccatctcgaagtcatataccaaattctctcccgtcactaagagcgtaagccttctcctcagctcttctcaatcttatccatcatagcaggcagtttgaggtggattgaaaccaaagccagtacgcgaaaatctttaggatactcctcaattaccacataaggatgaattaatagcagttctacccgtacaacccgtaaataaaccagtgcttatttaactatttatatttatctaataagaagcggagttcctaatactcaacttaaaatccagagcacgacctataatattttggctcggaaaaggtacatggttacaccttattaatcgacctctttcctagagggggcccggaaccggtttgcgccagggcgtcttcgcgccacaaaaagggtttcccccatttggaagccttcctttcatcgatacccacacaacctta

SEQ ID NO: 691786 - DNA, 149 bp, Homo sapiens
gtttgagaacccacgacgtgggggctgggcgtcgacatgtgtgcgctcccgcacactcttcccactgggtgtggtgctcacggacacctgcgctttgtgggacgtatgcagtgaggcacggagtagaagctgcctgctgaaaggcaggc

SEQ ID NO: 691787 - DNA, 197 bp, Homo sapiens
tcccccacttgagccccttgtatgcgcagctcctccagcattcatgagcgtggaccacttggagcggcgctagggaggataactcccacgtgcttgtcgtctggcgagggttaggaaggcgtcgcgcccctccattaggtcacagctcagcagggggtcggggtcaacgattggtggcagggtgttgcttacagtgc

SEQ ID NO: 691788 - DNA, 422 bp, Homo sapiens
ccccgattatgcaccactgtgagctaattaaacctctttcttcataaattacccagctttaggtattctcttttttctttttttttggagacagagttgctctgtcacccaggctggagtgcagtggcgcgatctcgatctcagctcactgcaaactccacctcccaggttgaagcgactctcatgcctcagcttcccaaagtgctgggattataggcatgagccactgagcccggctaagtattcttttatagtggtgcaaatggactaacacaagaggtatcatgctttcttgcttcctcatcattcttgtgtccttatcattgatatcttacacctggtttaatgatcccttcttccaattttatggattagctttcagaggcaaagactttttcctgtagatgtatttatacggggat

SEQ ID NO: 691789 - DNA, 100 bp, Homo sapiens
ttgggcaacatccatggtatcacaaggccttcaccacggagaagcaacagtcctgacaaattcaaacggcccacgccgcctccatctccccgggatacag

SEQ ID NO: 691790 - DNA, 528 bp, Homo sapiens
gggcgcgtcggacgtgtatccagtaatgcgatcattcggtgggggctcacatctgtattctcagcactcttgtgacagctgagatggaaggatcgattgcagtcacgcaggttgagaccatcctaggcaagatagaccccaactctagcaaaaatttaaaaataagccaggcatgatggtgtgcacctgcggtcccagctacttgtggaggcagaggtgggaagatccctggcgcctgagaggtcgaggcagcagggagccgtgatcatgcccctgcattcgagcctaggtgacagcgcgaacgaaaccccagtctcaaaaacaaaagaaaagacaacaagacagccatatgggttccgggaagcagaactcaaagaagaccagagaatctagaaacaactctcatagcggcagaagttgcataagaatagatatgatgtagaattaagtgttgaaatagatgtctttgcatatatggggaaaagtagaactagattcgtatcttaatagtatatatagaattagttc

SEQ ID NO: 691791 - DNA, 643 bp, Homo sapiens
  misc_feature (7)..(7): n is a, c, g, or t
  misc_feature (156)..(156): n is a, c, g, or t
  misc_feature (165)..(165): n is a, c, g, or t
  misc_feature (169)..(169): n is a, c, g, or t
  misc_feature (185)..(185): n is a, c, g, or t
  misc_feature (190)..(190): n is a, c, g, or t
  misc_feature (194)..(195): n is a, c, g, or t
  misc_feature (243)..(243): n is a, c, g, or t
  misc_feature (257)..(257): n is a, c, g, or t
  misc_feature (264)..(264): n is a, c, g, or t
  misc_feature (289)..(289): n is a, c, g, or t
  misc_feature (303)..(303): n is a, c, g, or t
  misc_feature (312)..(312): n is a, c, g, or t
  misc_feature (362)..(362): n is a, c, g, or t
  misc_feature (366)..(366): n is a, c, g, or t
  misc_feature (388)..(388): n is a, c, g, or t
  misc_feature (400)..(400): n is a, c, g, or t
  misc_feature (409)..(409): n is a, c, g, or t
  misc_feature (445)..(445): n is a, c, g, or t
  misc_feature (453)..(453): n is a, c, g, or t
  misc_feature (481)..(481): n is a, c, g, or t
  misc_feature (639)..(639): n is a, c, g, or t
gtatggntttggtggtttcttacactgtaacattgtccatgtacaccttaaaaacagaactggcctaaagggaaaaataagacgtcggtgtgactaaagaacaagcttatttggcatcaattatacatccttcattattttatattcctttaaaanacacaaaanacangtttgttctttcttcnctctnaaannagtgatcaacctgtacaaagtaatactcaacaatacatttcaaacggngcactgtatacttnggggaanatacgtgaaccggtatacaactaanatccataatttccnggttttgcnttgttttattattattttttccaatggggggggccgacacttggccatcnaccnggggcgggaagcaccaatcgcnacacatggcccnggggcatgncgccgttgtgggccataagggtccatcgggggcgcngcgctacngtacacttttcaaaacagaaagatgggnggtcccaaaaatgagatgccaattctgtgagcaatggtgtgattttttttttttgtttttgtttttgtttttctttttttctaaaaagaacaactgaaaaaaaacctttcaacaacatgctaaatgattctcaccctttgatatgattatactatggncggg

SEQ ID NO: 691792 - DNA, 119 bp, Homo sapiens
tccatggtgctcggtagtcttaagtcctggctcaagctatctcccgctcagcctcccaaagtgctgagatcacaggcgtgagccaatgccgccaccccaaaggtgctgtcaaagcttga

SEQ ID NO: 691793 - DNA, 395 bp, Homo sapiens
  misc_feature (2)..(2): n is a, c, g, or t
  misc_feature (28)..(28): n is a, c, g, or t
  misc_feature (30)..(30): n is a, c, g, or t
tnagtttccttgggggcgatgctgcccnanccctcaacagggctccagcgcagcaccccagcatgcttggagggtgagaacaaattgaaaaaaaatcccacatttttttcctctgaaaattttggtaagacggccaggtgcggtgctcatgcctgtaatcccagctcttggggattccaaggctggtggattatgaggtcaggagttcgagaccagcctggctaagatgacgaagccccgtctctactaaaaatacaaaaattagccgggcgtgatggtgggcacctgtagtcccagttaattgggaggctgaggcaggagaatcacttgaacccgggaggcagaggttgcggtgagccggtatcacgccactgcactccaccctgggcaacaga

SEQ ID NO: 691794 - DNA, 695 bp, Homo sapiens
ccggacctgatcagtgacaccgcttctacatttcatcttttgtgcttcatgttgtgagacatctctgagaatcgattaatgtgaagttttctgacaatgtcaattcctctgggatatcttcattcttgtaatcataaccactttccgaatgcacgttgataagctcaccttccttaagtttctctagctgcatatctggagtctcttgtatggcagcagtgtcaacatttccacagttggctatttcttttataactctctatatagagttcaattcaaatttcacttcttgcattattgttctgtttcattgtagcactttgtttgacaattccccattcaagtatccattttttgtaaaatatcatgtcagtttatcactgggagacaaggagttaacacaactatctgctttgcagactgtacagtgaaaaacatacacagtgaccagtcattgacagactttgaaagaagttatgtgattggttactaattatcacgtgcacttgttatttatgtagtgctttgtgaagtgagggctagcagctactactttacaagtactaatagttcaaattcttcggtaactgagatttgaacaaatgttgttaggagagactgatgtaatttaactaaaccagatttatgaaactggtgcatgtaagacccatgccacatgagaaactgctgtcatc

SEQ ID NO: 691795 - DNA, 749 bp, Homo sapiens
agcggagcggatggggccagcaccgcctcgcgccggtggtggaagcacgtgctgggggcgggagcagcaatcgcaggccatgtgcgtcgttactgtgtgggaggcgacgcaggggcgcggggagagcgagcggtgaacagccacttttcaagaacctcagacctaatcccggtaagaacctttggggtattacgagtactgcagtccgaaacatagatggttctattaataacatcaattgaacgatgatgaacgcacgatgtacgtggatttggcacgtctaatgcacgtcttaaacaagttactccatcgaatccttagtagaatccagtcaccgtgtggaagtttcacacgaaggatcccagctctccagctttagctgcagtaaacgacattttgaacgacgtctgcgcgctacacatggaatgagttactaacaaggaatctatgcaatgggatttaatacggccatctaaaatccaagagatggctctccctagtgatgctggcacatccagcccagaacctcatagcacagagccagttctggacacacggagagacagcggggattcgtgttggcaatgttaagcatgagttactgccttggaattgttccccacagtgcctctgcctagctcctacttatgaattggctctgcaaactggccgtgtggttggagcagatgggacaagtctgtgtggaattgttcaagtggatgtatgccattcgaaggaatcgaattccc

SEQ ID NO: 691796 - DNA, 946 bp, Homo sapiens
cacgcgtcgcctacattccggacatgatgtgtgcacgtggtggtctattgggagtcggtggtcagatgcaggagcttcggagggttcgtcctggagtcatagagtgaaaaggaccacatggtgacaatgcatgatgtgcttgatgctcagggctgtatgataaccacaaggatgcagagtcaccctgcggagagcttgtttacccttgggtaaaagctgtagacgatctcgataaacggctggttatgacagacagtgcggtaaatgccatctgctatgggggccacagattatgtcttccacggtgttctctcgcatatgaggacggcagttgaggtcaataccaggagattgtggtggatcagcaccaaaggagaagcaatctgcatggctattgcattaatgaccacagcggtcatctctacctgcgaccatggtatagtagccaagatcaagagagtgatcatggagagagacacttaccctcggaaggtggggttcaggtccaagaggcaagtcagaagaagctgatgatcaagcagggcttctggacaagcatgggaagcccacagacagcatcacctgccacctggaaacaaggagtatgttgaactacagtgagtctgcaaaaagaggtggtgctgaagtggtgaaagcccgcaggtagttggcgaaaacagaaaaaactgcgaagggaagcgagagagtgaaagtgaacgtgaccagactcttccagagtctcagttgatcaggagaaccacgaagagtagaggcagcaaagcaagtggtgggaaagggcagctggcatgggaggtccccagagaacaaaaagggggggcaaaaccaggggcagtcggccgtcggaaggcaatagaaaggggggtaactgaagatgctgagacttggaggcccacgaagttggacggcctaaacagtttctcggtac

SEQ ID NO: 691797 - DNA, 249 bp, Homo sapiens
aatttttttataaagtgctttgtaaaaaaaaaaaaatgtattctagcttttgcgggacatatgtgtgataacttttatacccctgcccgttaagtgccattatttcctccctctaaaaatgctatttttgtgtcagttcccgccggtgttttcatgtctttgcaaaatgacccctttttatgccttttttataaagtggtagaccttttgtagctttttaaaaactttgtattccttcggtatccatta

SEQ ID NO: 691798 - DNA, 187 bp, Homo sapiens
cagggaggtcctgacagcttgggggttagagaccctggaaaactgcagggaaggctcataaagaactctcaaagggagatcaaaaggctgaaaggtttgctcacccagcacgggatccccctacacgaggcccacagaaaattccaacttggagcacttgggccacgagacgcccaaggagccaagt

SEQ ID NO: 691799 - DNA, 148 bp, Homo sapiens
ctatcatgtgcgcgcagcatggtcacacatgcttacatacattcttataaatacacaagtttctcacacagtgcccacagacatgtttcacacacacgctcacacatgctcagcacagatgctcacacagcatgctcgcagcatattc

SEQ ID NO: 691800 - DNA, 515 bp, Homo sapiens
tcatgtctgtgtctgggtcgccatgcctgtgcgacgatactctgctgaatcgtgtctccattgacccaccgccaatttacggctgtctactcttcaactttgtggggaggctgattcacttgactggccctctccagtctgtgccatttcgcctgtctctctgtgtttttctctcttcgtcttagtgcgattcctctgtcgttgatagatcggccctatctgggcagctagcagctaggaagaacctagttgagtggttataggtgatttgggaatccactccccagaggctatgtatgccacataaagacatacacacccatataatttgacataaagatgtgtataattatatcatgtttgcatttttttaaaatatagtctttctgtttgcttgcattcctcctttcccatattcctctctttggtggttatttatctttccaaagtagattttaatatgcttccttccattttgccattttcattcaataatccctctctaaaatctttct

SEQ ID NO: 691801 - DNA, 507 bp, Homo sapiens
  misc_feature (22)..(22): n is a, c, g, or t
gcgcagtaggtggatacccacngtgatataaacaaatgtctacacaaaaacttgtgcacagatgttctttgcagcattatttataatagcccaaaattgaaacagccctaatctctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgca

SEQ ID NO: 691802 - DNA, 324 bp, Homo sapiens
ttccaagtagcagggaccacaggtatgtaccaccatgcctggctttttaaattttttgttgagatggggtcccactgtgttgcccaggcagatcttcaactcctgggctccagcagtccttccacctcggtctcccaaaatgttggtattacaggcatgatccactgcctgtcattattttaaagagtacttcaacttaaccaaaaaataaagttaattgtgaaacagctttcggcaggtctttcaggaggtattcctgaagaaaccattgttatcacatgttatttgccccttgaggccttccattgggacatgatgtaaaat

SEQ ID NO: 691803 - DNA, 264 bp, Homo sapiens
actcctgcgtggactgttgtcagtcgttcacctcataggtgttgtctggccgcacaatcatgtgtgtacaggtgtggtaactcatcatccttgccacggatgtccttgttggtcagcacgattcttgcccttgtcgttaaagatgacaagagccaggtggagtccggcaccttagaagacgattggaacttcctgtgtcacctacgacgctaaaggatcctgatgcttcaggaaccggcagggctaatccctgagttacgtggg

SEQ ID NO: 691804 - DNA, 639 bp, Homo sapiens
  misc_feature (157)..(157): n is a, c, g, or t
  misc_feature (279)..(279): n is a, c, g, or t
  misc_feature (290)..(290): n is a, c, g, or t
  misc_feature (313)..(313): n is a, c, g, or t
  misc_feature (586)..(586): n is a, c, g, or t
tcccgggttaagttcggcgggaagttcgagaatccctctcaggtcgttgaaaggttgaccaggaaatacaacgagctgttaaagtcctaccagtggaagatgctcaacacctcctccttgttggaccagttgaaagagcagtttaattgggtgtccnggctggcaaacctcacgcaagggaagaccagtactatttgcgggtcacccggtggcttcccacacttttgactcggacgttccttccggtgtcactgaggtggtcgtgaagctctttgactntgatcccatcnctgtgacggtccctgtagaagtntccaggaagaaccctaaatttatggagaccgtggcggagaaagcgctgcaggaataccgcaaaaagccccgggaggagttaaatgtggatgttgcttttgcccctacgggggcatttgagtccagctccccccaaaatgaggtgcagccccccaaaaagagctttgcacgtccccaagtaaccaggccccagcctccaggcccccaaatccgcccagcctttccccgctttggatcctgcactttaacactcgactttgctgctcatgggaanaacaaaattgctcctgcatgcaactaattcaataaaactgttttgtgagctga

SEQ ID NO: 691805 - DNA, 297 bp, Homo sapiens
tttgaccgtattatgaggacgtggtctttcccggacttgacaggtctcatcactatgtctgaagtgttcatccccttctcggtgacccttggagtatcggggatgaccaggacacggacctgctgcagtggtgcgcggcccatgcaatttggccacgtgcatgtggagctgcagcacacaatagcagccaaggccctgatgtcctgtttctacacctttgcgctacccgactgagtctcatcccatataattgcaggggcgttcaacacctatatggccagccctggtccaaagtca

SEQ ID NO: 691806 - DNA, 1733 bp, Homo sapiens
ctcaggtgccctgcccgcaggacaagggacttcctctgtgtgtccttcctgccaaaacatcttggtgctcctccacctcccctgagcccaaatgtgccagtgcagtgtctgaacaccatgctctgaatgtgtggcatggtgcccccacggtgaggacatgccactgtggacgctcatgtgccagctgtccctctgcctgtgccacctttgccgtcaatttgttgcatgctgtgccctgtccatgtgcgccccctctgtgccaccattgcatgcgttgcacacctctgctacgttgctgtgttctcaccgcatgtgtgccccacccttacttgcctcccatctcgcacggcggcgccctggcgacggacacgacccattccagcgccaacgcacccccgcaggcggcacaccggggcctacccttcggacctcgcgtcggccacctctctcaacacctcacgcgcccccaggcgacttggacgcaaacaccctaccatcacggcgcaccaacacaccaccggaaacctaagaccgggcccctacataccagccagcagaataccagaagcgacatccccacaccggcacccggccacacccggatcaggcagcagccccaccaggaggagcgcgccacaactgcaacccgaaacaccagcacgcgtaccctttcggcgccacggccacacccttggcgccccacataggaccaccagataacacgggacacaaacgccccacacaccactcacagcggttccgcatctcgcgccagactcgccagctggccgcgggatcgactacaccttgcgccatcgcacgccgtcggacccgcacacactcaccacgggatcggcgacaccacaaccaactagcgacgcaccagacgtgccgcccacaccgccggccgccactcaccccagcggccaggatatcgcgcccagacgccgctgcgctctccccctacacctcggaaacaaccgcccacgacgacacggacgcccccaagccggcgactccgtatggcccaccaccaccatgcggggtgactcctccacaccgcccacgcgcccaccgcccgccgccgcaccacacggcccacccgttggcctcacgcgaccgccaacggacaccaccaccaccgcccgtcgtgacgctcccacacgccaccccgcgcaacggccggcccacccccacacagcaaacccatggccgccccacacaccgtcgccacctccccatggtgccgcccccacgcccccgccctgggacccgccgggggccaccagcgcgcacagggcgtgacccgcgcaagcacacgcggccgggcagcaccgcgccaccctgcacgccccaacgaccgcagctctgccgcgcgcccccaacacgcacacgcaaacccggacccccacccgcccccccgcgacacctgcgcccgccaacctaccgggagtcgcgaccgacacgccaccccccagcaccaccacaaggacccacagcgcgcacacacgccgccatgccactgggcggcaaaccccccacggggccaccctcgcacacccgcgctaccaccgcacaccgcccgcatcacgcgcatatcaccacccacacccaacactgggatccgcgagacgcccacacggcgccaccccggcgacccacactctcacgcacgcgcaccaaccagcggcgcccccccccaccagacgactcccccacaccccccccgcgag

SEQ ID NO: 691807 - DNA, 892 bp, Homo sapiens
tgaactcagttgttacatctcatcatggatatgacgacgtccccagctggcctcccaccaagctgtccccgcccagtctgccccctcagcctgccgcggcccttctctttaggtgtcctggcctgggacgtggatatatatctgtccatcggaaacgtgatgctgccacatccttttgtgaacaccgcgcccatatccgcggtacagtcacattttgacctgtgcccgttctcgttcagttgatctccctgagcgctgcaggtgtggcgagtttgcttgcactggatgtgctaagacaccacaggccgctttacaagagtctccctcgtaaggagcgttagtccgaacccatggggggccccttgttcgcctctttgtggagacgttaatcgtttttaaaatcacgagccccactcttatgtatgagattctcccggccgggccaccgaagtatcacatttgtttctctctttccgtcgcccctccggggagctcccactcctcccttataaaacgctctcgagtctctgttcgcgattccccctcctcctcgtggcattcccacgggtatagcacatagaggcaaagctcgccgctatgagaagggtcgccattcccctttattaaggtccccgaaaggtccccttggcccttttataactcttgcactgtaaatttgcccttgctttgacagcccatttcagcgggcgcctatttcgaatgtttttccacagaatggatcaccaggaaccttccgccggtgacttcaacttacgggaggctgcggcacaccagttgtcattcggcaacttgtccccgttgtgtccgaaggcattttcacgtaccccgccgctttcctctgtcacacagcggggataactaccgcgggacc

SEQ ID NO: 691808 - DNA, 389 bp, Homo sapiens
  misc_feature (130)..(130): n is a, c, g, or t
  misc_feature (133)..(133): n is a, c, g, or t
  misc_feature (138)..(138): n is a, c, g, or t
  misc_feature (144)..(144): n is a, c, g, or t
  misc_feature (176)..(176): n is a, c, g, or t
aatgaagaatatgaagtaagcctagaaatcacatgcagataactgacatcatatgaaccgtcgtctgtgaggatctgtcatcttgttatgaactgcgctctgtcttctgctcagtctggagatcccaganacntgctnacaggntctacaggatgatcaaacttggtctgggtatngatgaagatgagcctactgctgatgataccagtgctgctgtaactgaagaaatgccaccccttgcacggacgactgaccgacctactcacgcctggaccacacgtacgacctacactctctgactgacgggatgacctaccctgttccgtcctctacaacttcctctgactaatactattttcacggctgtttttctttattctctgttacct

SEQ ID NO: 691809 - DNA, 321 bp, Homo sapiens
gagaattatctcaaaaccagctgcaaccaataattatttttagacagtttaacaacagcttgaccatcacctgatgatcacctgacatttctgttggggcgcgggccatctcctgccccgctcatgtggggctcagtctgcccaacctttccccaggggcctgtctttactcattgtggtagccccagcagatggactctgttatgatccaggactctcacggcactctgtgatgacactagcgctgctctaatacatgctgtaaagtgtcagatcaaatgggtactatgtagaagcctaccaagagtgtgggagcatagg

SEQ ID NO: 691810 - DNA, 187 bp, Homo sapiens
ttcctgatcatgatggccataccgatgaaggacacagacagtgtggcggagatccgagaggcgttccgtgtctttgccaacgctgggaatggctacatctgcgccacaaagctgcttcgcgtaatgaccaccttgggctggaagcttaccgttgaggaggcgcatgatatgatcaggaatctggaac

SEQ ID NO: 691811 - DNA, 626 bp, Homo sapiens
cttttaggaaaaaacgggggggtggggttatttaaactgggtggattaccccgggtttttttgattgaaaaaccttgtggttgtgttcttcaaaaaagaatccctaatagaatgtgaaagccagaggaatttttttttcagaaagaggattttatttcctcctttaaaaaaatttttttaaaggaaaggacaaggtgactaatactcaaggggatgtttcttttagtgaggctaagagtcgcataaacactcttaagaatatgaaaatgtgtaatatataaatcgccagttccaaaagtgagcaaacctgttggtctagcattggcttggatagtatcatgagcatattttactcattaacatttaaaatcactttagtctagtagttcatcagtaacttaataagtaaatgggaatcatttattcatattatcaatagagtatattgaatgtagcattaagatctgagtagtgagttatgtcagtcctttaagtactttgggtagttttaagtttgtaatttcacttaaagtttctatctcaaaggctgcattacagtggtgcgatcatagctctttttagcaatcatactctagtatctgtttatcttgctatctcaatatctc

SEQ ID NO: 691812 - DNA, 867 bp, Homo sapiens
cggtcgggactcttcctcgggccccggggcacaccatggaggtctcctgagtgaatggcctgtcgtcgcccgtagaggggacccagcgcctcacctcccccgagagctaaacttgggaggctgatgacaggaggcactagggccaccgataagcaagggagaaagggcagatcatagggggagatgtaccgtgagtctggtgactgcgtaccctaacgtgacctctaacccgatgattccgccctcagctcctggaagagaggtcctaactatctctatagggacccagagccccgtaaagttctcctcgtcccccacttgtgatgttaacggtggagagggcataggcatcctcgtgtcacgtgatataggtgtctatgagcatgaggcgtaagaggttgttgtagttgtcctggtagccgtccagtcgagactctcccgtacttgtccgcatatttgcaaggaggaggggatttcggggctggggctccgattcaccaaagctgaggtggcttctcattaaccctttaggactgctgaagggtatggacgctatcgtgaatgtgtagtcagggggagacttgctggtgggattagtggtcctcatggatgttgatagaaacagtgcagtataaaaaggaagttggaatgggagttggcgggcagtgaacgagtgtgggtgaaggattgatgctggggcaacacggaacggggcctcgggcctcgtttggctgcacataactttggtagctgcagtgtgcataatagagctgggactggggagggagctaagcttgggctgggctaacttggggcttggcatagggtggaaagggctaacctggggctctgaccacattacagccc

SEQ ID NO: 691813 - DNA, 588 bp, Homo sapiens
  misc_feature (168)..(168): n is a, c, g, or t
  misc_feature (234)..(234): n is a, c, g, or t
  misc_feature (241)..(241): n is a, c, g, or t
  misc_feature (250)..(251): n is a, c, g, or t
  misc_feature (266)..(266): n is a, c, g, or t
  misc_feature (278)..(278): n is a, c, g, or t
  misc_feature (293)..(293): n is a, c, g, or t
  misc_feature (306)..(306): n is a, c, g, or t
  misc_feature (325)..(325): n is a, c, g, or t
  misc_feature (332)..(332): n is a, c, g, or t
  misc_feature (335)..(335): n is a, c, g, or t
  misc_feature (360)..(360): n is a, c, g, or t
  misc_feature (376)..(376): n is a, c, g, or t
  misc_feature (379)..(379): n is a, c, g, or t
  misc_feature (383)..(383): n is a, c, g, or t
  misc_feature (420)..(421): n is a, c, g, or t
  misc_feature (426)..(426): n is a, c, g, or t
  misc_feature (428)..(428): n is a, c, g, or t
  misc_feature (433)..(433): n is a, c, g, or t
  misc_feature (436)..(436): n is a, c, g, or t
gctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagngccgcctgccagcatcgtgcccctcatgcgccagaaccgcaccagatgaggcccagcgcccttccnctcaacnaagagcccnncgggtcaccccgccncactgaggccangtagggggccaggcntcccactcctccnagcccgggagatgctccgngtggcancancctccttgctgggggtagatgagancctactactgaactcnagntttngatctcgtgacttttagaagaacacagggactcgtgnngagcnangcganggntcccaaggaaccccagccctctgggaacaggcccatccccccaatgttcctctctgtctccagagaagggcacgcggccctcccatcactggaagtctgcagtgggggtcagctgggggtggagagaacgactaagaggtgaacatttataa

SEQ ID NO: 691814 - DNA, 165 bp, Homo sapiens
gtttccccctcataaaagtttggggcctggcatggtggcccatgtttccaattccggccctttgggaggtggaggctgggaggcccaggtgggaggattgctttattttaaaaattcgagaccagcctggggaacatgattagaccctgccttttttaaaagtta

SEQ ID NO: 691815 - DNA, 131 bp, Homo sapiens
gagagacatctgagaagtagggaaaagtaatgggtatgtcacaaggcaggtagaggatgaggagcctgtgaagttgtcattgaaaagccagagagatagttgggaaatgagtagcatagcatgatgccaga

SEQ ID NO: 691816 - DNA, 533 bp, Homo sapiens
cactatactactaacagaccgcaacctcaaacacacaccttcttcgagcccgccggaggaggagaccccatttctataccaagcacctattcatgattttttcggttctacgcctgaagattaatattcgtatatcctagccaggacttcgggacataattctcccagtattgtaacttagcatactccggagaaaaacagaacgcatttgtgagtagcagtagcgtcatggatcctgatgctactggatacgtcaaataggcgtaccaatagggtaaactcgatgttgagcacacgcattatactaaaacagacaggcaattcgaccgctggaccatcacagaagcaatactgttcagccatcccgacataacacaattacactcgatcgggcataatcgctcgcaaacacgggacgtcccaaaaggatactgtctagaacttggagcctccgagcacaacaacgttcccaacgggacaaggcaactaactgaaacagtggatcatgcgatgcaggtgcctcgtgaagaccc

SEQ ID NO: 691817 - DNA, 209 bp, Homo sapiens
tacaggcccaaagccacctcctagcgcccaggtgattggggtgctgctctgggttcgaacatgcggatctgggattgggggatctggctggttggagagacgccatggcttccgagagcacctcagtatggaaaggagagctgactcctaggtacttggagcaccaagtataggcagatcacggtgggcagattaggttggttggttgt

SEQ ID NO: 691818 - DNA, 698 bp, Homo sapiens
cttcttaaaacagccgggaaggttttcttaatttttggaatttttaaatatgtacccggggcccctttgcatttataaaaaaaaaaagtatttctgtgtgatacggccatggtctgggttttccccaaagaaagaccttttaacttaggttccccaccccgcaagggccctcctaaatatagggaccaaacggtgatgcccggaatggtgattggccgctctaaaagcatttgagtcgtcaagtttgcacatcttaatatatcaccctcactgcttatatcaccaggcttggaatgtgtgatagaagaactccactttgttcatcgagcacatgctcaataaccggctgagatcgtggtctgtttatacagttccgcggtggttccacgcctaggcgtcattcattccaagacgtgaatacctttgaggaccacaaagtcaatctgcgccatggagtggtggatactgaatggtcgcgaggtgtgcatactgccgtattcctgttcacatctacggtcaggagcggtgggataaactttcaaacgcgttaagctctgttgatgtgaccacaaccagcgggtccaaagctttatgttccccaagtgcttccccaacactcagtaaacttgtgtgaccacccctggaaggtttgtgttattcctaccaatggcgcgcaatatagtaaacaattaaattgt

SEQ ID NO: 691819 - DNA, 393 bp, Homo sapiens
tttttttttgagagggagtcctgctctgtcacccaggctggagtgcagtggccaatcccggcccaccgcaacctccgcctcccaggctcaagcaaatctcctgactcagtctctcaagcagctgggaccacaggcgcccaccaccacacccggccaacttcagtattcttagcagagttggggcttcaccacgttggccaggctggcatcaaacccccgatctcaggtgatccacccgccttggcctcccaaagtgctgggaccacaggcatgagacactgtgcctgacctaaaaaaattttttattaaaaaaataaactcctacttctgaaattcactagtgatatgaacaaagtcacaaggaatatacctcccactctagcaaacaacaac

SEQ ID NO: 691820 - DNA, 578 bp, Homo sapiens
cgaggatcaggaagctgctgatcaccagcttcaggtgtttctatttattgggagactgtctttccctggcaccagctgcaaccaatgattactttagagagacagtttaacaactgcctgaccatcacctgatggtcatctgacattcccgggactccagataagagcccaggccaaaggacaccttgattttgaccttgtcagacctggagttgaaaaaccagctgcacccttctagaattcttacttacaaaactggagatgttacaagacaagatgatttcactggaagctgagttttgccagctttggggaaatgctgatgcagaacatcatttatttaaggctgatactcatggatagaagagtcaaagtgcgaatatatgcacccttctatacggattctgcagaaagatatgcttgggtcatgactcagctatttacaaagttgctggtgactaattgctggaaagaagctgggacgttctgtggcccctccattttatatcccctccctttggttctctaggaaattgagttcaggaaagctaccaggaataaaactcttactttttaaa

SEQ ID NO: 691821 - DNA, 565 bp, Homo sapiens
  misc_feature (499)..(499): n is a, c, g, or t
  misc_feature (528)..(528): n is a, c, g, or t
  misc_feature (537)..(537): n is a, c, g, or t
cgaggatcaggaagctgctgatcaccagcttcaggtgtttctatttattgggagactgtctttccctggcaccagctgcaaccaatgattactttagagagacagtttaacaactgcctgaccatcacctgatggtcatctgacattcccgggactccagataagagcccaggccaaaggacaccttgattttgaccttgtcagacctggagttgaaaaaccagctgcacccttctagaattcttacttacaaaactggagatgttacaagacaagatgatttcactggaagctgagttttgccagctttggggaaatgctgatgcagaacatcatttatttaaggctgatactcatggatagaagagtcaaagtgcgaatatatgcacccttctatacggattctgcagaaagatatgcttgggtcatgactcaggtgaatttcctatgaaactttgtctttggtaaagcatcccattcttggctgttccatatatanatatatggtaagtttgggagtggccttgntagtaaagnataaattatttacttggttctaggtaaa

SEQ ID NO: 691822 - DNA, 316 bp, Homo sapiens
ctgtttttacagccgattcccattgcttccgttactgcctgagccccacctcctgttagatcagcggtggcattagattctcataggagtgcgaaccctattgtgaactgcccacgcgagggatgtaggttgtccgctgcttatgagaatccagcacctgccgatctgtcactgttccccgtcaccctcagatgggaccgtctagttgtaggaaaacaagctcagggctcccactgattctacattttggtgagttggaaaaatggtaaggaatgcaaatgtattattaatagaaataaagtgtacgataaatgca

SEQ ID NO: 691823 - DNA, 254 bp, Homo sapiens
ttaacatgtttgccagtaaatatagggagttatttggtaagcaaatcgatataaccagcaaagatacctgctacttctatatagatacaatatttctcattaaatcacaagactaaagacagtaagctcgatgacctggctcaatggtgctgggctatatgtgttcctaacactcttacgtaacagatgaaaataggatttaacatagtgtaacacacctgactagggttgtcaagcaacggtcttacacagac

SEQ ID NO: 691824 - DNA, 800 bp, Homo sapiens
  misc_feature (6)..(6): n is a, c, g, or t
  misc_feature (548)..(548): n is a, c, g, or t
  misc_feature (724)..(724): n is a, c, g, or t
  misc_feature (727)..(727): n is a, c, g, or t
  misc_feature (767)..(767): n is a, c, g, or t
  misc_feature (777)..(777): n is a, c, g, or t
  misc_feature (785)..(785): n is a, c, g, or t
  misc_feature (791)..(791): n is a, c, g, or t
  misc_feature (794)..(794): n is a, c, g, or t
ttttcntacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagattcagatcgagtccaaggcagcttatgtctttttttaccaacgccaggacttggcgcgacgcttgttgtccccggccggtttatttggcgccccagcttcccttgcttgcagctccccacccagttttgagttcatggatgttatttgagagccctgggtcctgccacaaaaaaaaaaaaaaaaaagccctttttgcaatttcgcttttggtgtccgccccgctttttttatttgtgttaggtgcccccgccaggcattgcaggtttagtcgtggctactgttttcctgtgccgntgcatcgctttctcccgggaaaaaacaggttgtgtttcctcctagcagtgggcgccccgcctgtgtttgcccttccagcagtgaccctcccttttagtttttatttatggtggggcccttccctttcctcagcccagagtgttttgggtgggtggtgatgggggttcccctgaacncanagtgtatttttttattgaggccctgtcccttttgctgggngtgggtatanataaagcnccagtntgntcccca

SEQ ID NO: 691825 - DNA, 533 bp, Homo sapiens
cgaggatcaggaagctgctgatcaccagcttcaggtgtttctatttattgggagactgtctttccctggcaccagctgcaaccaatgattactttagagagacagtttaacaactgcctgaccatcacctgatggtcatctgacattcccgggactccagataagagcccaggccaaaggacaccttgattttgaccttgtcagacctggagttgaaaaaccagctgcacccttctagaattcttacttacaaaactggagatgttacaagacaagatgatttcactggaagctgagttttgccagctttggggaaatgctgatgcagaacatcatttatttaaggctgatactcatggatagaagagtcaaagtgcgaatatatgcacccttctatacggattctgcagaaagatatgcttgggtcatgactcagacaatttggagagaattccctgaaacattcactgtacaactctactttcttgaatacttactataattaaagttcatttctgatttacataaagaaa

SEQ ID NO: 691826 - DNA, 106 bp, Homo sapiens
cgagttcacagccaacagcacaatataacgtcacagcactcctttggtttgatttcaggtgggtgtggcttgaagaatcacgtgaaatcaaaccaaaggagtgctg

SEQ ID NO: 691827 - DNA, 896 bp, Homo sapiens
tgcggcgctgggtctgttcttgtgtattttggggggaggggcggtgtgtgcggtgttgttcgcgggggggtggtgtgcttctgtcagggggtgacgatgtcgtggtggtgcgtggccagcggagtggtggagtggcccgctgggggtttgtcggtggttttcttttgcgtgcgctcgcattcgggtcggggggcgttcgtcttcgctgtttggggcggtgcgcgactgcggtggttgcagaaacagtggtgtcagtgtccgctcggtccgcagggttgggcgccggtgccgcgctgtgtggaagacgtgcttggtggggcagtggggttgtctgctgtggaaagaaggatttcttgggagggcagctgcgagagagacagaggtgttcccgtgagggtgcgtggtgcgcgccgcggggccagaagtcaccacgctgcggggggatcacactctcattgatggttgtgcgtgctgtgcatgtgtaggatgacttggtcgcacgacgtggccgcccctctgggatccggggcggcatttgggcagtcctctcgcccgccgttggatggggggttcgtgcgtgatgctgcgtgggccgcccggttgtgatagcagctgcgggcgggctttaaacaactgcgtccatggctggtgagttctgcttcttttctgcggtcgttctttgccacgaggccctcttgtggcacaacgccaaggtgccccacagaggaaggccgcaagaaaaaaaaacatggtaagacaaccgccgcagttttttctgtttccaactcgttacaacccccctcgaggagtttcactactagctctgtgtcagccggcggggcagccgggggtttagaccccgtttttaagtattattattttcgtccaacataaca

SEQ ID NO: 691828 - DNA, 570 bp, Homo sapiens
  misc_feature (11)..(11): n is a, c, g, or t
  misc_feature (439)..(439): n is a, c, g, or t
tcgtcacgccncacaagactgggctgctctcgacggggggcgcgcccaccgctgtgtcctctctgcccagtcctggtcttacctaaggtgctacctcagtgtggagatgaggttggaggaacgaacgcgaggttcctccgtgctttggtcgagaaaagtattcaggcaagtggtgtgtgtgggatgacctgataatggcgtgcacaggacatcgagcgtggtcggcctggagcagaagggcggctggctgtcctggagctgctgctgtagcctgccctcagagtgtccctttccagctgctgtggcactactgtggctgcttccccaggtgtggtgacggtggggtcggggtctccagctgtgacagttcaggacgttgatggtggacgtgatgcctctcgcaggagccttccccatgttcttgccttgtggagaatgntcctcccatgccgctgaggtgttaggtggtttagggccaaaaggggaaaaccacttgagtcttgtggtgtgtggtgggcagacaccacagggtggcatcacctggtggcatttccagaaacctcagccccg

SEQ ID NO: 691829 - DNA, 232 bp, Homo sapiens
gcaatcttcttacctcggcctctcaggtagctgggctacaggtgtgtgccaccatgcccagctaatgtttctattttttagagatgggatctcactttgttgcccaggctggtctcaaactcctagcctcaagcaatcttcccacctctgggcttccaaaggtgcttaaattacaagggttagcccaccacacccagcccttttttaggcccatatttttaaaattttctat

SEQ ID NO: 691830 - DNA, 1340 bp, Homo sapiens
  misc_feature (152)..(152): n is a, c, g, or t
  misc_feature (201)..(201): n is a, c, g, or t
  misc_feature (284)..(284): n is a, c, g, or t
  misc_feature (328)..(328): n is a, c, g, or t
  misc_feature (372)..(372): n is a, c, g, or t
  misc_feature (862)..(862): n is a, c, g, or t
ggataaatatgatagcgtagacatatacgcagtctcacttgtaggaagtactagtatatcgctcacaccgtcatatcctcgcgctgactagtgcctacgcaaggaagtaactatccgtgatccgcgtgttcagttcatacgctacttcgtcnatgattaccacgtcgaagacaacactcaacatcctcgtccttaagaccnaatagttgtagccgtcattgcccatacgtagtctcttcgccagcgatggcgaaaagctacgcaggatggagccctatgcaccntacatagtcatcaataggctctcgaacgacattgatggccatangagcgtaccgtacggagtccatgctaagaacctagactccaatntgctacaaaactaactcgtccaccaaagtacttattactttactatccacgttgaccatgacatttccagggacacaagaacagtaagtttcgaatcagatcacaaaccaacccacgagacctccaacagtgtagttacgcaatacgattcaccctgctcactaatgggtttgtaagcacaccatgcaaaagcaacgaacctggtttgatgccctgtgtcgcccaaagctttgtgcctctcgaggtgctcacatcaacctccggctggtaagtgactgaactaccctgaacatccgttacacgcccttgggcgaaatctaatggaggcgggtgcccgaatcagcgctaggattattcccatggtcgagaacccatcataattccaggggagacacggaagacgtacgtgaccttcccatcctcaggtacgtgaattcttcgcacgtaaacacaagtcatcccttctaagggaaactaaagcatttttcancaaggtgccacacagaaagctaaaggtccacctatgtggtccactgaggttccttatccatgtacgaggacaccaacaaactttgagtacgccgcgcagaccctttggagggctcactacgagttcaaccccgggaccgaagagggctagaacgcaagggggcaacgcaaaaccggccgtggacattggaccaggagaggcatttctaggtaggttgtcccgctggatggtccctaatggaagcccccccttagggtaaggggagttcgccgccttttgtaccgccctaagcttcaagttgcgggactcttgagagtttgcaacaaggcattccatacacaaggaaaccccactaagaggggtgccagcggtaaataaggcattgtgctaaacaaaactgggcagggtgtggggtcacactcgtgggtcggcccaccagaaacttaattacagagaactaccctgggagaggcgcaac

SEQ ID NO: 691831 - DNA, 406 bp, Homo sapiens
gaaagtgtgagatacatctgcttaatttaagctgtgaaatcagtctaagttcagttcatgtataacataggggcaggactgcttctgttatttatatgccattcttgtggacgatagcccgcgattagaagacatctcactggctgtggataaggtatatatcattatcgcactcgtaatgcacgaagaattgatagataaagtctctgagcattaaaggattaatatgttattacattgtgattaggcgtgtacttagatgacccatatcgaataagctgtaaggaggcatgcagtcaatctcactaatgaggagggaggtacttgcctggcaacagtgacccgtacaaacgaaggactgagacgagatggaggtgtctcaattgtgaactcatagaacagtcgt

SEQ ID NO: 691832 - DNA, 289 bp, Homo sapiens
agcgaccgccactcactgtgagttccacttaattcaggtgagccgctcttctgcacctcctcctcacacctctctacctatactaaccatttttgaaggttcaacaatgctctgcaaatctttttaagacccgttacttcaacaactcccaataccttcctcctcaacggaacaacttaaccgttaccttttaaacccgacgagctacaaagcaagagatacttcgcgagccaaattctacaaaggaccaaaaaagaaacccattaccttatagtactcatgcaaaaaa

SEQ ID NO: 691833 - DNA, 497 bp, Homo sapiens
ccatcctgcgtatcagtggcctctcccactcatgcatgacgtactcgttgccgatgcgcagtgaatcgccggtgtagaccgcctctgtcgccagatagtccttgcgttgcgggtccatgaacactcctcttctcgtcaaccacgggtaggtacggcgatcactccaacaggcagacggcgttaccgcaccagtttcaattcgggcctgccgacgaaggcttgcgccggcgttacattcgatttcagcagcagtgtctggaacccgtccttgaacggaaccctggcgaggatcgcgatactcagctcttcgaggtacagcgaaaagccttggagcatcttcaatggcagaccggcaagtacggcatatgcgatttcgagcagtaactggtcgagatagatcactagggttctttcgctgtaccggtgcagaatcgcttccagttcgatggcaaatacatggtagagagtgttgaggctctggctaccgtagcgaccag

SEQ ID NO: 691834 - DNA, 258 bp, Homo sapiens
cggtgttgagcttcacctgctagagagatcctaaaacactatgtgagatcatgtcactcctctgctcacagccctgcagtggtagatgaggtctagagtatgtgtagtatctacaataatttctgtgaatcatggtaatataattactgcacaggaatttcagttcttatggtgtgatggctcgcatttctaattcctcatacttacatgctgtgtactgggatgtggaaggtggtccgacaacctgttggtacgcga

SEQ ID NO: 691835 - DNA, 266 bp, Homo sapiens
agctgacttagaggatctcctgccttcaccacccccctgctccctttgtcctgtgctcaccctctaacatgctctttgaggctgaagggaggaataaaggagcaaaaacaaccgggcacagtggcttacgcctgtaatcccggcactttgggaggccgaggcgggtggatcacaaggtcaggtgttcaagaccagcctggccaagatggtgaaaccccgtctctactaaaagtacagagaaattagctggggtgggtggagagcgg

SEQ ID NO: 691836 - DNA, 173 bp, Homo sapiens
tacgagggttaccctggaattcataaactggcgccacaggttcataacacactatctaaacaactgaatgttagttaaatcgagctcctttgatgaaaccgcttcagtgtctgtttcttataaagaggccctctccttcccacacctccatttgagagggcagtcgaatgatc

SEQ ID NO: 691837 - DNA, 824 bp, Homo sapiens
tagtaccacagaaatacaaaagatgatcagagactgttatgaacaactatacactaacaaactgaaaaacctagagacaaaggataaattctggacacacaatataccaagataaaattaagcagaaatagcaagtctggacagtccaataacaagtgaaaaaaacaattagttatataaagtgtaccaacaaataaaagcccaggatctgatggcttcactgaaaaattttatgaaatattaaaaaaattaatactacttcttcaaaaataatcgagaaaacttatgagagtacttccaaacacatttttcaaggctcctgataccaaaatcagacaaggataatacaacaacaaaaaggaaaactacaggccaatatcccttattaacatatatgcaaaaattctcaagctaatactaccatatcatattcaacaacacatttaaaagattattcattatgatcaagtattcgtgcagggatgtaaggatagttcaatatacataaatcaataagtgttattacccattcacattaagagaaagaaagacaaaaaatatatgatcatttcaatagtgcagaaaagcctgggcaaaattaaacattcttcatgattaaaaaaaaactctcaaaaagtatgtatagatagtcatgtatttcaccacaataagaacttattatatgacgagctctttgctaacatcatactccatgggaaaaacaagtatgtccttttactatctgaaaaatccagaaacagtgtttacattgccaaaaaatagatcagaagaattacaaaatcattcaaggttaactaatgtaa

SEQ ID NO: 691838 - DNA, 252 bp, Homo sapiens
cccaaacctacttcaccttactaccagacaaccttaggccaaaccatttacccaaatatagtataggcgatagatattgatacctggcgcaatagatatagtaccgcaaggaaaagatgaaaaattatacccagcataatatagcaggactacccctataccttctgcatatgagttactagatatacttgcaggagagccaagctagacctcgaaccagacgagctacctagacagctaaagagcacacgt

SEQ ID NO: 691839 - DNA, 765 bp, Homo sapiens
  misc_feature (10)..(11): n is a, c, g, or t
  misc_feature (29)..(31): n is a, c, g, or t
  misc_feature (53)..(53): n is a, c, g, or t
  misc_feature (55)..(55): n is a, c, g, or t
  misc_feature (77)..(77): n is a, c, g, or t
  misc_feature (81)..(81): n is a, c, g, or t
gcccctcggnncgactatttaggtgacannntatagaacacgcttcgctgttnanttacatagctagtgtcgtcgancggnacgtgtgcactgcagtgcaagctggtcggtggtggcgtgcagcttgtgcagctgtgtgcacacgtctctgacattactgtgctgcacatctgcttgcgcatcagctcctaggtcggtgaagtgacgcacgtctgggtctcagtgccttgaaggtcatgcccctctgagctgggcatcaagtggggctgaggccgaacatgggaagcacggggagcagtatgctcagggggagatgtggggagcaggacccagacgtcccggagccccaagcccaccaggagaagggaggtgtcacggagtgagctcagtccagtgatacccagcgccgcaacctcatcattgtggtgtgcgtgggcttcctggtgctcatggtcgtcctgggcctggtgcgcatccattcccttcaccgccgcgtctcaggggccggcgggctccagggcctccagtgaccccaaggacccagacctcttctgggatgactcagctctcaccatcattgtgaaccccatggagtcctaccagaatcggcagtcctgtgtgacggggggctgttgggggccagcaggaggatgaggacagcagtgactcggaggtggccgatttcccccagcagcgacgaaagacgcatcatcgagaccccccaacccgtataaggctacacctctgagggctccctccatggac

SEQ ID NO: 691840 - DNA, 246 bp, Homo sapiens
  misc_feature (34)..(34): n is a, c, g, or t
cccaggagtgcgaggttgtggtgatgccgagatngcgtcactgcactccatgcctggggaacacagtgagactccgtctcaaaaaaaaaaaacaaaaaaaaaaaaagggaacccaattttaattttttcgggttttttccccgttttgttttcttgggaaaaccccaggggtttgcccaatccaggaactcaatttccccctttggtttttgggtccaagctttccctttttattttccccccccc

SEQ ID NO: 691841 - DNA, 607 bp, Homo sapiens
agcggagtggggctgacgctccggtgctcgcacaatcccccgcctcggctggcaacgggcgtccctccactccccgagtccccggcagccgccgccaccccagcgcgccccgagagcccctcgagcgcagcaggccgcacccgccaggcatggcagaagctgaggaagatggtgcagtgctgatactgtcagagcagatgatgagtgaagaaaatgaaagtcctgctgaaacagatccgcaggcacaaactccagatgtgccgagctcagtggatgtttgaacttgctccaggtgtaacgctctagcaattttacgaaaatcgcaccttgcagagccagccacagaggcatctcgtccaagaggaaccactcggcagaataccaagcaggacaaacaagaaccaggcaaaagaaggaaacggctcgagaactcttcctaaaagccagtagaacaaagaaccacaatggagcatatcctatgaaggccatacaagattagatcgaacggggctatgcaacgttgtaccctgatatagcagttccacggattacttatacccgggtctcccagatggtgatggcgttggaaacgctacattgacgatac

SEQ ID NO: 691842 - DNA, 372 bp, Homo sapiens
  misc_feature (160)..(160): n is a, c, g, or t
  misc_feature (289)..(289): n is a, c, g, or t
gctttttttccccctgagacagagtcttgctctgttgcccaggctggagtgcaatggcgcagtcttggctcatggcagcctccacctcctgggtttaagtgattcttctgcctcagcctccggagtagctgggattacaggcgtgtgccaccacgctggncgaatttatctttgtatttttagtagagatggggtttcaccaagttggccaggctggtctcaaactcctgacctcgtgacccacctgccttggcttcccaaagtactaacattacaggcgtgacagccnacgcctgggcaaattttaactttctgtaatagatctgtgttcattttatgggtagtaaatgataaaattagactaccaacata

SEQ ID NO: 691843 - DNA, 185 bp, Homo sapiens
ctatgtgttttaggggactttggcttttctttttgcaagggcctttgaatctgtttgtgtccctgttagcacaatgtgaggaggtagagaaacagtccccctttgtgtttaccatgacccccttcctcacactgacctgtgttccttccctgtttttttttttattaaaaataagaacctgggca

SEQ ID NO: 691844 - DNA, 364 bp, Homo sapiens
tttttttttgttggagactgggtcttgctctgccacccaggctggaatgcagtggcacaatcatgactcactgcagcctcaacctcctgggctcaagcgatcctcccacctcagcctccctaggagccgggaccacaggcatacgccaccacatctggctaattaagaaatttttggttttttttttaagagatggggcctcaccacattgtccaggccggtctcgaacctctgggctcaagtgatcctcccgcctcagcctcccaacttgctgggattacaggcatgatccaccacgtccagctgactctgactcttttttttttttttttaaactctcccaggttgtcaagaggtcgacgcg

SEQ ID NO: 691845 - DNA, 281 bp, Homo sapiens
ccttttttggaaccactccagcccagctccccctcagccttggccttcacgctgtggaaacaaacaaggcacttcctcaccccctcagcgccccggaccttttttgggagtggccggaaaactcccgggcctttggcctgcagggcagcccaagtcattactcagaccaggtcccccacttagctgccccccctcgaaagccaaatatttttgtagtttttatgcctttggctattatgaaaaaggttagtgtgttccctccaataaacttgttcctgaga

SEQ ID NO: 691846 - DNA, 165 bp, Homo sapiens
ttgctctgttgcctaggctaggagtgcaatggcaccatctcggctcactgtagcctcaatctcctgggttcaatcgatcctcccacttcagcctcctccacacatcaccatgccctgcgtaagttttttttttttttgggtgaccgcaattccttaaaggcggga

SEQ ID NO: 691847 - DNA, 249 bp, Homo sapiens
ccagttacaacagctgaaggaatttgaggggaagactttaggtgtcagtcaccaacagaaggcctggtaacttccagaggatgaatgaagagaaaaagaagcaggaagagaagaaaacaaagttcgagaacctctgcaaaatcatgaaagacatattggagaaaagaagttgaaaatggtggttgtgtcaaaccggattggggacatctccattgctgtagttgtcacaatgcacattatggctgggac

SEQ ID NO: 691848 - DNA, 939 bp, Homo sapiens
gctgtcttgaactcctaatgtcgtatccacccgcctcagcctccaaagttctgggtttacaggcgtgagccaccgtacctggcctaaatcgctgttctttataaattacttagtctcaagaattctgttatagcagcaccaaatggactaaaacatcatggttcctgcttttttggctcactaagtgctcgtggcttttctctttcaaaattttattgctaaaataaataaagatgtcactactttacaataattcatcacattccatttttttgtaagaaatagtaaaagttggatttctatgcccttggaaaagaactctatccttgaggcaatctgaaactaagcatttaacaacttgaaaaattagatcactaccctctgaccaaacaccagaaagttttatactgaaattcagatactctttgcttgtttattggcagggaaaaagccaaaatatcaagaaagccagcacaaatatgtagtagtaatatccccttagctaacatagatttgcaccacccatctaccttctatcatgtcatcctttttatttctttcattttatgtatgagtctttgaaatgtttgtgtttttaaaaaccttttatttttttatttccttcattaaaatgtaagctctccaagggcaggcctttatgctcatatttaccaccaatttgctgctgcctagagcagctcctggcacacagaatgacctcaaaaaataccagtggaatgaaagagtaatgaaagaaatgactcatctggttttactccaaaagaagtagttctaattttttttaatgcttaaagaaagccaaatggatatacatataggatttccagtgtcataaaagtaacaaaattagcttactcttccaaactcttattttattaatattttttaataataaaaaattatagaatgcttaaaaaa

SEQ ID NO: 691849 - DNA, 104 bp, Homo sapiens
cagaggagctggagaacgaagacctaaagctctggacttagaccatctaccagttttaaagcgttttaaaaggggccccacaatgagagttttcattcaaaatt

SEQ ID NO: 691850 - DNA, 377 bp, Homo sapiens
ctcggctcgctacaacatcacctaccagcagcctgccttggcctcccaaagtgccgagattgcagcctctgcccggccgccaccccgtctgggaagtgaggagcgtatctgactgagcgcccatcgtctggagatgtgaggagcccctctgcctggatggccagtctggagaagtgaggagtctgtactctgtccaatcgttcgatcccatctaggtaagtgagacagcgcctcttcccgatcgccatcccatctatgtaacgtgcggagccttctctgtgccgtgtgcagccatcgtctgaagatgtggggagcgcctctgacctgtcgaccccgatccgggatgtgatggagcgtctcttccctggaacgacaca

SEQ ID NO: 691851 - DNA, 154 bp, Homo sapiens
cgtccctctaccaagacctggatttcaggcagaagcaggaagcagcagaagcaggaagagcagaacagggcagaagcaggaagcaggtgaaaagggtagggtaggaaagtgttgttttatgtgcgtgtaaaaaccctgtggcagaagcaggaag

SEQ ID NO: 691852 - DNA, 279 bp, Homo sapiens
cacacagcccggtctcagctgccctggtaggcccacaacttccctaagtcaagctccccaggcccagctcaggcctcgccgtggcctctccaggctcagctcctggcccttcgatgacatctgcagtccccatttgttctttgatctttgttttctttttatttagcttgttcctcccggcgtcctctcgagtcccaaatcgttcttgtttctttttttcatttttatcttcttttttttttctttttttgcttctttttttttttttttttttttttt

SEQ ID NO: 691853 - DNA, 219 bp, Homo sapiens
agctttaaatagcgacgcacaccaggctcattggtctacagctgcttcaacccatcatgtctttgttgatcagtttattcctattccttagattttcttaagtctgaagtccctgagatatatagacacatttatggctctcgatagcactgccaactgttttctaaaagggtgtaaccgtgtcaaatgccactgtggtaaaaatcgtcacgcaacagc

SEQ ID NO: 691854 - DNA, 992 bp, Homo sapiens
  misc_feature (992)..(992): n is a, c, g, or t
tggagatctctggatccatgaccatccttttccttctccttgctccttctccttctccttctccttctccttctccttctccttcttcttcatttgagatggagtctcactctgtcgcccagacctggagtgcagaggcgcgatcttggctcactgcaagctccgcctcccgggttcatgccattctcctgcctcagcctccccagcagccgggaccacaggtgcccgccaccatgcccagccatttttttttggtatttgttagtagagacagggtttcaccagcgtcagccaggatggtctcgacatcctgaccctcgatgaatggcggccccgcatgggcagcacccgaaagcagtcgggaatcgacacgtggctgagcgacccacgaagcgacagcacagggaacaaccagggaaccaggggaaacgcagagcggcacagagcgccgacagccgcaagacccgcaggggcacacacacaccgcggcccacaactgaaccccacgcgaagacctatcaccacgctcccctaagcgcctcaacaaactaacacactgcacacacgcgcggacaacaagagagtcaacaccgaaggacgcacattaagcgccgcgagacccggccagtgacaacccacccaagggacacaaaaccgcggagccctactgcccacaacgggaaacccacgcacctctcctcccgaccccgcgcacgcgtacccggaacaaaacgcggcgcagcagtagacagccactatcccgcaccgatggccagccagacacccccccctcacaggcccgccaagccggccccggcggatcgccgccacgcgacgccgcgccacgcctagccacaccgccacgcaccgcggactacacctaccagagagtccagcagagccccggacacctgcaccgccctccgtgcattaccctagcaccactactcacctacatcaacaaaaccgcacggtgcagtcacgccacaccn

SEQ ID NO: 691855 - DNA, 539 bp, Homo sapiens
gtttttctgtaaccagtgggccttatctatactcctaattccagttccttgtaaacatcctttgtaaagtcccataagatcctgtctcctttgccatacagctgcaaggtcataaagtagataaaacctaagttgcaattctggttttcctcagaatctaagacatgttacaaagagttaattgtctttgtttctcatctggtaacatctacccgctgcacatatttcttaccttaaagagtttaaaaggcaatcgtataatccaactctgcctacactttcgggaccccttccacactctggaagctttgtactcttgttctgctcgataaaacctactgctcattctcggtccgggtctctatcacttgccgtggtcagctgccgcaccagtttttggtgtggctaggcaagaaccttaggcattacaatgtgatgcccccagatttgttctttttcttagtcttgctttggctatgcggggttccaacctgagaatcaaataacaactcatccattttcacaatagctgcaaaaaa

SEQ ID NO: 691856 - DNA, 1081 bp, Homo sapiens
  misc_feature (664)..(664): n is a, c, g, or t
gtgcacgaactccatggcaagcagcaataccgagtaccagtgtatcccagacagcaccatcccccaggaatgactactcgctgctgagcatacctaccactcgatggagagctgtcgtcgcatttcagtgttcacactctggactgtatggcatgtgtgatgtcgtgtgagaagcctatgcccgagttgctcgggcctgtttgttggttcaacacgaatcctagtagctaccgtggcatctaggttcgagcagacgtggtctttctattcaatgcactggcatggatgccgacagtggttcccctggatacccatactacatgaactacctatatgatgagaggcactctggtcgtgatcggctagtcgtgcatgtgtgactcttgtgcctagacctactgcctgaatgctatctccatctcagtcacgaactgcgggctctgccacttcgttgtgcacgaggcatgtgcatctctgacaagcttgggtcgaggtcgagcataggcgaatgggtcaactcgtagtggcacacgccgctgacgagtaccagagaggcttagacagtctcccagtgacatgacgagcattgtcgaccccaggcagcacatacggtgtcaattcaatgtcccaacatgcttagacacactggtggagcttctacccnatgccctcagctcattggcgacttgtctctggtctcccttagctcgccagcgaactccatcgggcggatactgcacgtgtgcctcttccaaacgccgtgttggcgctcgctacagcacacgactcaaggcattagttctacccacacgtggggggtctagttgcccacttcaccatgaggcacgagttcccgtcgggcaagcccgcatacacgtgctggttcacatcagttcgtgcagagatggtcacggtcaaatgccccccttgccttgcttggcctgcttcgcaccatctgcccaacagcgcacgtgcgtggttggtggcgctaggcagttgggggaccaatgtcctcatccgttggcaagctgtttctactcgacagcttacggttctcgcgacgaggaggcactttggcggg

SEQ ID NO: 691857 - DNA, 313 bp, Homo sapiens
gagcaaagggatgtggtgtgagttgcgattggatggcattcacaccccacccctcacccacatccagatacaagtcaggaaggcagggttatttcaggccccttttcaagatgccctggctagcagattctgcaggatgaggggtaggcggtgtgtaggcagtgagggggaggttccagggctggcccacagccgtgacatttggtccaggcatgggctccgattcttccagtcgccaaaacccctccttcacagggcccagaggcttgtgaggaagccacggtggacccagccgttagaagagtggagcaat

SEQ ID NO: 691858 - DNA, 117 bp, Homo sapiens
tagaggatctcgagctcccgtatatacacgaggatatgtgggtgtagagcccataggcataactcttcagcacctaggtctgttcgatgcagggccataggtggacagtaatagcta

SEQ ID NO: 691859 - DNA, 293 bp, Homo sapiens
tgtcctgacgacaggcgactcgggcgctttgtggcactacgagaacacgcttggcgtctaactctgcagctgttccgtgggcttccggctctctgtggattgcaggtcatgtgagacatccatgagtgcagcagcagcccctgtatgccagtgagtgtgccacacgtctacgtgctccgtaccaggtgttacttgccggcgaggctaccagctcagcgatgtggatggagtcaccctgttgaagaccattgaccgcagtggcgccctgtcccaccgggtggccacatctgctc

SEQ ID NO: 691860 - DNA, 349 bp, Homo sapiens
ctcccgtgggaatgaacatcttctgtctgtgtgccatgaggagtcagcacctccatctgcttgaaaaaatctaccccgcctcaattcttcaggcaggtaatcctgatgacaggctcagctgtacatggtggtagtagcttgatagcctttgccatagcccatatccttcatcagcctaatgagcgcgttcctcaggtgcaggggcacggggggcagtgtcccctgttggttcctcatgcaggctttgacggttgtttgttcgtcgctgtacacctcaatggatctttgctgctctggcaacgtcgaccacacactggggccagaggcacctacatgttccccagggggg

SEQ ID NO: 691861 - DNA, 175 bp, Homo sapiens
taccccctggcggaccctatcggcgtaactactacaaatgattttgggagtgactcacgaagtgatgaatgcacatcgaatggatcacaagatggaatttagcaaaccctagccttgcttgtcataaattattttttctataagaattatctgtagagtggtactgatctttgct

SEQ ID NO: 691862 - DNA, 135 bp, Homo sapiens
ttgtagttggaggatcccagcggggaacaatcatctttggctatggactagcaaaagtgaacaaataggattacatgaagtgaaaaagcttatgtacagcaaaggaaacaatcaacaaagtgatggttccccgcg

SEQ ID NO: 691863 - DNA, 169 bp, Homo sapiens
gctccagtatctcatgcttgctctcctctagactagatgctgcctcaggaggttgcacgacagcagaggctgaggtgatctatgcagacctggtcgcggaaggacgatgcccagagcgcagttgggcactatatacgatgagggtgtcatccgcttgctaacctagaag

SEQ ID NO: 691864 - DNA, 198 bp, Homo sapiens
tgacttgtatagaatccctgcatgatgatctactaaaataagagagtcacacatcgtgcggatcacgaagccgggattacaaggtcgtccgtagtgtgaagaatagctctatgcgacagaccttcacgttcccagatctgtttcccgagaaagacgagagccctgaaggcagtcctgccaagcactagtgtccgccaa

SEQ ID NO: 691865 - DNA, 378 bp, Homo sapiens
  misc_feature (1)..(1): n is a, c, g, or t
  misc_feature (37)..(37): n is a, c, g, or t
  misc_feature (74)..(74): n is a, c, g, or t
  misc_feature (234)..(235): n is a, c, g, or t
nctttgcgatactgctttattgaaattaattcacttntggacgggcgtggtggctcacgcctgtaattccagcnctttgggagtccaaggcgggcggatcacttgaggtcaggaattcaagaccagtctggccaacatggtgaaaccccgtctctgggaggctgaggcacgagaatctcttgaatacagaagacgaaggtggcagggagtcgaggttgcgtcactgagctccannctaaagtcatcttgtttcagaacatctcgtttcattctgccacgttccatgtgtggatctggccagtgtaacatctcaacagtttattttactctttccaactttttattttgaaaatttcataccttcataaaagtcttaag

SEQ ID NO: 691866 - DNA, 172 bp, Homo sapiens
cctcataccaggtatatgcagagaatggcaagtgtacgagctgttccctaccctgtaatcaaccccttaccagccagcacctccttcaggttacttcatggcgatctatcccacagactcataaccgtgctgcatactatcctcctagccaaattgctcaactgagaccaag

SEQ ID NO: 691867 - DNA, 206 bp, Homo sapiens
tggctggatagccggtgggagagcaagaactaggatgggataggagctctggagcacagatttgagcacagcagggtgacatgatggtatacgactggctgttggaagcagtgccctggctactgctcgcctcggctgattgtaggtagatgccaggagcagcaccaccaggacagcagcaccaccaggacagcagcaccaccaga

SEQ ID NO: 691868 - DNA, 1254 bp, Homo sapiens
gagtattaatcatgctacggttatctggtagcgaatgtatgagcgagtagtgaggtgttatcatctagcctggtagagcactcgtacgggtattctggttccgaaattcgtgaaaacaccgtcaaggtaccgacagggtaacggtcgtctgcggttgcattgcaatgtctcgagtctactaccaaccctgatgcagtaacccgtgcatcgtgtgtcgcgtgtagcacgagggccatggtgcgtctcacgtctgcagtgcggaggcttcccactaatcctccactcagcgctaggttggtttcgagagagtcgtccagtgcgtctactacccatcacgagacctcatcgggaccatctgaagttcggggccccttgctacgctagatgtcgcctcgtgctaggagtgctgggctgtgtgggagcgctcgaatcgctaggtgacgggtctctccttgtctagctccccagtgaggatgtctagagggcatagcacggtcggaggccttggctaagtcatagtcaacgcgactgccgagtgtcccccagccgtcggcgatccataaccaagaaggactcccgtgttggtaccttggacctcgcacagcttagatttctttaacagagagacgatcagaaaaggctctggaacgggttgtgacagctactagaacccatgcgtggcgactgtgtttggttccctatcagttaagtcttgcaggttgaaggaacctcccgcaagacattccgcgacggatcgttaacctttgctcgtccacgcatacttgtatcgggcttctctagctgcttgggtcgtcttggagctatgccgaacgtccgcgggtgtcggaccctgcgcctttctttgtgtttgtgcccattagcgcttgaattgtcttgagtctgtgtggctgttgtgaacttttgattgggccaattacccggtgtacccactgtgtcctcttacctaacgcctttatttcctttgcttgtgggaaccgttggtgttccataagttcggtcctggacttggcaatcgtgcctggggaacccggtgacctttgcccggtgtggtgggcgccctccggcagcatatcccccggcgggggcagattcgcttgggagctttgcggttttgccaaccccaagaaagcactaaccccgcggcccggattggggcttgtggctggccacgtcctttcaagcacgcgggaggggcttggggcggtttccaacggctggctttgcgactggccc

SEQ ID NO: 691869 - DNA, 371 bp, Homo sapiens
aataatgtgtagccaatagcaactgtaatttgtttacctttccatgaaaaaaaaaaaaatcctggcacaaaaatgatagattagtacctgcagttgtagccaaactcttggcaggtcctcagtcaatccaaggtattctctaatagagctagactcagtatataggaaggcaacatccgagatcatctggcattgattacctacatcaaaatatcccgggaaaattctagattaatttgaaaaataaaaggtccactctggaagaccagcaaaattcaaatttctggcatcgactgaataaatcctatttctaccgcgaaataatccctacatatattttcctagtccccatgggcacacattcatggcag

SEQ ID NO: 691870 - DNA, 90 bp, Homo sapiens
gtcatacttttgacgccgttgggtttctcataagtatcctagttcatgtacatccgatgctaaataatactgtgttttgttttgtgttgc

SEQ ID NO: 691871 - DNA, 304 bp, Homo sapiens
aatggaggagcccgactcgtagatactcctgcttgataatccacatctgctgagaaggtggacagtgaggccagagatgagagccaccgatccacaccgagtacttgcgctctggggagtgcgatgatcttgatcttcatggatgctgggcagccagagacggtgatctccaatctgcatcctgatcagacaatgcccaggatacatggtaggtgccgcccgcaaagcaccgagattggcagtacaggatctttgcaggatgtccacgatcacacattcatgactggacgttgtccagggggga

SEQ ID NO: 691872 - DNA, 577 bp, Homo sapiens
  misc_feature (531)..(531): n is a, c, g, or t
tccctgagaatccaaaattccccggccacctatcacaccccatcctaaaaaaaaaaaaaaaaaaaaaaaaaaaaaaaaaaaaaaaaaaaaaaaaaaaaaaaaaaacatatttgttggggccgtgctgagccccagaaaaacgcttttaaaaacaattgctgtggtggggcgcgggcgccccagtagcgataactagacagggtgtgatacaagcgggatttccctgaggaacaaccctggggcacagcgaccatgcggcgtggggtttctccaacccaactaaaaaaacgccgcggcgggggtcaaacggaggcgctgctttgctgaaacaacaccacaagagactgggagttctgcggacgtcatgagcgggtggatctattataccacagcatgagattcccaaacggggacgatcgccggaattatatcaacaaacattagacagcctccgcgcatgtggagtgtagcgacgagtcactgacgaatctgcgagaaggacgatagaactagtagcaagacgcaacaggncgaagcaacgactgaacagagccatacgatcgatgcaggcacgtaa

SEQ ID NO: 691873 - DNA, 785 bp, Homo sapiens
ccctcgccctgcgtcggcatccatccgagtacagcatcctgagggaggagctgcagaggcctgagcggtggacaagcgaggcgtcatcatcgagatcgtgcgacgccatcctcggcctcggaggagagccccaagcgggagcaggactcacccccgatgaagcccagggccctggatgccatcactgggatggagactggctgtcctggggcgcggaccgagacgattgctgccaattggctcggacggttggccgtggcccgagccgggttccttcctcgactacccctcaactgagccccaagtctggacccgagcttgcccctggagacgtgagccctggagcgctgagactgcccatgttgccacgtgaatgcctgataggaaggactcgcatggttccaatacaagaggtcctgcggccacaaaagggccctggggctctaggtccgtggtggccccgaacgcgccacttgccatgtctctcaatatagcaacacaataggctagttgaccctgttggcattggggcgggagcgatcgaacggcagacggcggatcgagtctggtgagttttccatgtcgtgcggtggctcttctccacgtgagcacagtgtcagacgtgcgtagaggcagtcgatgggcataactggacctgggccgcaactctcaggcaaccaatcaagaataaccggaatctacaaggtcgtgtttaacaaggcagtgccgaaaagcgacgaaaggaaggcccttttcaagggcatactggagacttgagaataaca

SEQ ID NO: 691874 - DNA, 135 bp, Homo sapiens
  misc_feature (38)..(38): n is a, c, g, or t
ggcaaagttgatctagagagatcccctgcactactggnagcagctaatgcagtcgcaattcttgtaattgcattgcattcaaccgctcccattgggtggaggctgcttcaggatgttgaagttcccagaggtagg

SEQ ID NO: 691875 - DNA, 98 bp, Homo sapiens
  misc_feature (6)..(7): n is a, c, g, or t
  misc_feature (23)..(23): n is a, c, g, or t
  misc_feature (27)..(27): n is a, c, g, or t
  misc_feature (42)..(43): n is a, c, g, or t
  misc_feature (56)..(56): n is a, c, g, or t
  misc_feature (87)..(87): n is a, c, g, or t
  misc_feature (94)..(94): n is a, c, g, or t
  misc_feature (96)..(96): n is a, c, g, or t
ggaganngggaacagattgttcntaanccagaagagaagttnncccagaggaaaangatatcccagaagaaactgaagaaccaaaancttatgncncg

SEQ ID NO: 691876 - DNA, 384 bp, Homo sapiens
gaggacaaggtctctgcccattctgagcctgtgctcagcccagctgactgtgcctgccccgggcagcctccacctctgatgtttggacacggctgcccggactcgattgagaaattgattattttttagtaacccgtctgatcttttccaccttcagagatggagagagttagaattttgctgtttttcctatgtcatctgccagtcaggcctatccgtcccctgcctcataggacacgatggagagaggttgggtgggggccggcagcctccatttccagccttctgtccttccagcacagaaggtagcagcggtagtgcccagcctgcctggcccccatactccaagcaccaccaccggggccactgagggacaagccttgc

SEQ ID NO: 691877 - DNA, 1417 bp, Homo sapiens
  misc_feature (371)..(371): n is a, c, g, or t
  misc_feature (917)..(917): n is a, c, g, or t
  misc_feature (1012)..(1012): n is a, c, g, or t
  misc_feature (1023)..(1023): n is a, c, g, or t
  misc_feature (1041)..(1041): n is a, c, g, or t
  misc_feature (1055)..(1056): n is a, c, g, or t
  misc_feature (1088)..(1088): n is a, c, g, or t
  misc_feature (1199)..(1199): n is a, c, g, or t
gactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaaccgccttgggccttcctgtctctgggggcccataataccaccctgacagagattctcaanggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggtgctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaangatggaggaagtggaagccatgctgctcccagaagacctgaagcggtggagagactctctggagttcagagagataggtgagctctacctgccanaagttttccantctcgaggggactataancctgaacgacatannttctccagctgggcattgaggaagccttcacncagcaaggctgacctgtcagggatcacaggggccgaggaacctagcagtctcccaggtggtccataaggtgtgcttgatgtatttgacggagggcacagaatgcgaatctngtgccacagcgagtcaaaagtcagcctccttatctgcgatgtagtggagacaaggaccatggtgcgtttcagacaggcccttcgtgatgatcatggtgccgtaggagacacgccagaacatcttcttcatgagcaaagtcagcaatccaagcaagctagagcttggcatcaagcagggggcttccagtaaggaacttgggaatgagctggatgccggg

SEQ ID NO: 691878 - DNA, 1471 bp, Homo sapiens
  misc_feature (626)..(626): n is a, c, g, or t
ggagagagagaactagtctcgagttttgtgattatttttttattccttcgtatgccaccttttttggtgttccccaacttcctggggccccaatgtggttagactttggccacatgtggcttactggggcctcctgtggcctttcctataggggcttagcagctgtggtgtgggtcaaacacttctgtgccctgtgcgtggagaagcgtgccgaggccatgtgcccggggccacagagctatagtgtgcggcgcctcctgtggcttcagctccgtgaattaggcgaggtgccgagggacaggcgttagaagtgtgccacacgtgtggcggccctgtgggcctgtgcgggaatctcccgaggcaccacgtgtgcgggggagtgtgctcctgtcgccccaaggctctctgtgagcgccgaccactctgcgtctcccagggcgagagaaccccgaggcgcggggtgtctcctttgcgcgccacagctgtgttctccccagggacgccgcgggggtgcagggtgacatgtggtgtcgcgtgccgcatccctgtgcccacgtgtggcaccttctgtgctctccacagacggttgtgcacccaccagggctttcagaggcggggccccatanacgtggggtctctgtgcacagaactctcacagagggaccctatacgcggtcgcaagaacgaagctcatgttgtttgccgtgagcggcttactaccacctttagagcccaagtgggtctcgagggtgtcccccccccgagagacgagagtttagacaccaacagcgaggggatactaaggcgagagtttctcccgggcacccaaagtttatttcgcgggggagggtaacacaaacaccaccggagggacaactttcgcgaagggaaacaagcacacccgctagtctgtcgcagaccccgttcgccaaggggggggatactccaccaagccgaggcaccacaaaaggggtctcactcaggttcctctagctaccacaagagggacatctcctactaccaagggggtctaccgcaaggaggcaccaaggtctttgtggcaccaccagggggagacagaccccaccttctatcccgagggcacccctaccaacaggacaagtgctaatgtttggggccacacaaaggtctctcttattggttcccagaaaagaggtcttccgccaagctttgcccttttgggaaggcgatgttggggtcctcccaacgcctttgattgcccccgggtatggggcccctgtggcaaaggagttctctaccaggttaggaagggcccccccccttctcagggtaggggggacccccctcatatttgggtgcggggagcatcgtgtggtgtggtggtggtccccctctcataatcatgttggcgagcgagggtctcccatataggtgtacctattcttgtggtggtgcacaagtgcggcgtccttatcgcggcgtgcaggtg

SEQ ID NO: 691879 - DNA, 1055 bp, Homo sapiens
  misc_feature (555)..(555): n is a, c, g, or t
  misc_feature (650)..(650): n is a, c, g, or t
  misc_feature (661)..(661): n is a, c, g, or t
  misc_feature (679)..(679): n is a, c, g, or t
  misc_feature (693)..(694): n is a, c, g, or t
  misc_feature (726)..(726): n is a, c, g, or t
  misc_feature (837)..(837): n is a, c, g, or t
ctccacttaccagctataaccatgcacgggcagtcgttgtacagcaaatcgccataacctatgaacgagctcgtggtcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggtgctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaangatggaggaagtggaagccatgctgctcccagaagacctgaagcggtggagagactctctggagttcagagagataggtgagctctacctgccanaagttttccantctcgaggggactataancctgaacgacatannttctccagctgggcattgaggaagccttcacncagcaaggctgacctgtcagggatcacaggggccgaggaacctagcagtctcccaggtggtccataaggtgtgcttgatgtatttgacggagggcacagaatgcgaatctngtgccacagcgagtcaaaagtcagcctccttatctgcgatgtagtggagacaaggaccatggtgcgtttcagacaggcccttcgtgatgatcatggtgccgtaggagacacgccagaacatcttcttcatgagcaaagtcagcaatccaagcaagctagagcttggcatcaagcagggggcttccagtaaggaacttgggaatgagctggatgccggg

SEQ ID NO: 691880 - DNA, 531 bp, Homo sapiens
  misc_feature (371)..(371): n is a, c, g, or t
gactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaaccgccttgggccttcctgtctctgggggcccataataccaccctgacagagattctcaanggcctcaagttcaacctcacggagacttctgaggcagaaattcaccagagcttccagcacctcctgcgtgcccttaacaagtccagccatgagctgcggctgcgtgtgtaaagatgctatgctcgcccaagcgcagcttatcttactgggcaggttggtg

SEQ ID NO: 691881 - DNA, 1109 bp, Homo sapiens
  misc_feature (58)..(58): n is a, c, g, or t
  misc_feature (61)..(61): n is a, c, g, or t
  misc_feature (233)..(233): n is a, c, g, or t
  misc_feature (338)..(339): n is a, c, g, or t
  misc_feature (372)..(372): n is a, c, g, or t
  misc_feature (442)..(442): n is a, c, g, or t
  misc_feature (510)..(510): n is a, c, g, or t
  misc_feature (633)..(633): n is a, c, g, or t
  misc_feature (704)..(704): n is a, c, g, or t
  misc_feature (718)..(718): n is a, c, g, or t
  misc_feature (776)..(777): n is a, c, g, or t
  misc_feature (834)..(834): n is a, c, g, or t
  misc_feature (852)..(854): n is a, c, g, or t
  misc_feature (884)..(884): n is a, c, g, or t
  misc_feature (941)..(941): n is a, c, g, or t
  misc_feature (1058)..(1058): n is a, c, g, or t
  misc_feature (1086)..(1086): n is a, c, g, or t
  misc_feature (1100)..(1100): n is a, c, g, or t
gagccggcaataagtacctcaccctcattccacccctccttcactcagctctcaccgnctnctgttatctaatcaccgccacagattcctgtgaagcacctccacctatgcgtgaagaacatgcatcactgccttagtgtctaacaatgagctctagggctctgtacaggcctcgcatattgctcgggcgaccaactgcctcccagttggctcgttattcccactccatatgncgcggactgctcccaacacatccacggagggtagtcagtgtgtgcaatgggccactaaatagcacaatcctaccctggctcgaccgaagcacgagatgcaacaannaggcaatcactggaccactgatagtatccctgntcataacattgtcatttatccccctatctggcgagctacttcggccacactatcctgccccccacctatnccaccctctgccacctgccccgacccaaatcgcccaacggaatattcagcggaccactactctctccntccatcgcttggagcatcatcatatccctttgccccccttcggttagcagcatgataccttctgtgtcagtgaatcggtcgcactccaataccttgtgacctcttccccctcaccctttcccncccgcatcagtgctacaccgttcccacgatcaatcccatcgatcccctggcctcgtcttcattcggccacntctacataatgcgncctatacaccctacttcctgtctcactcttctgtccatgcaacgcccgagaaccctcnncatcgccacccgtatctacttcacttcctacttcccaccattcgccactaccatctnccatccgcgaggtctccnnntcctcctttacttatgcggtccctctcacncacactcctctacaccagcctcctcggctagcacatgttcgcgcaccgaccgcgccnccgtggctcacattcacttgactcccttccaccttctctccctcactacctctagcctctaacttcctaccagcattctctcactgactttctttagtgctatcgtgtctctattangcgactctccctatattagtgaggagantacgacaaacatcntatagtaat

SEQ ID NO: 691882 - DNA, 671 bp, Homo sapiens
  misc_feature (171)..(171): n is a, c, g, or t
  misc_feature (266)..(266): n is a, c, g, or t
  misc_feature (277)..(277): n is a, c, g, or t
  misc_feature (295)..(295): n is a, c, g, or t
  misc_feature (309)..(310): n is a, c, g, or t
  misc_feature (342)..(342): n is a, c, g, or t
  misc_feature (453)..(453): n is a, c, g, or t
accccaactgacgtacccacctgacgtagcccacctgagtctcccgtacgaggccaactagcccacctgactataccttacttccgggacgaggagctgtcctgcaccgtggtggagctgaagtacacaggcaatgccagcgcactcttcatcctccctgatcaagacaangatggaggaagtggaagccatgctgctcccagaagacctgaagcggtggagagactctctggagttcagagagataggtgagctctacctgccanaagttttccantctcgaggggactataancctgaacgacatannttctccagctgggcattgaggaagccttcacncagcaaggctgacctgtcagggatcacaggggccgaggaacctagcagtctcccaggtggtccataaggtgtgcttgatgtatttgacggagggcacagaatgcgaatctngtgccacagcgagtcaaaagtcagcctccttatctgcgatgtagtggagacaaggaccatggtgcgtttcagacaggcccttcgtgatgatcatggtgccgtaggagacacgccagaacatcttcttcatgagcaaagtcagcaatccaagcaagctagagcttggcatcaagcagggggcttccagtaaggaacttgggaatgagctggatgccggg

SEQ ID NO: 691883 - DNA, 1230 bp, Homo sapiens
  misc_feature (371)..(371): n is a, c, g, or t
  misc_feature (1033)..(1033): n is a, c, g, or t
gactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaaccgccttgggccttcctgtctctgggggcccataataccaccctgacagagattctcaanggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccacaaaagcgcctagtatgcggctaccatagtggcacattatggcgcgactgtacctgtacaaggaacttcatactagccctggcctacagaacgctctatcaatcggacctcaccgtagagaagagacttggcaagcgtaccagcggcgacacacactcaccaagaatctcgcattcaaacgggaccctatggaccttctgtcaacgaaccacactggaatgcagctcccttgacttcgcagacctctacaagtcccttcacaatcttcaaaacacgccccccagcagacgatagggcggatggagttgctccacctgttcttggaccccggcactcgcaaatggcacttaacttccagactccaacagatcccaaggggggtttcgttcacgcttcgcaccgtcccctctgcatacactcccctgctccgtggcgctccactctttgcggctatgcgccgcccactttggcatcttgcgccccgcgtctctgncgcgacagtttccaatcgtctctatggatccagtaaggctacaccccccgtgtcttcactgtcttgcccccagcgcgtagaccctctggcgactccgtgaaccccgcccttgtggttcccccatattgtctgagcccctagctatgagcgtacggcttatctgcccgctggcaaagcgttgactcaagccgtacgag

SEQ ID NO: 691884 - DNA, 376 bp, Homo sapiens
cacgaggacgttgggcacctctttcagctcgaaatgtacgcatatctcattaccactgctcctccctcaacccccaagggtgcgtatctgccgccaattccaacagggtaataccatgttgagggcactttcgttcaagatggtctgtcaagatgtgttttattcaaacacaacattgacaatctggatgctgattttgccaatacccatgatgagtgagaggtacaggtaactgcacgcccagactttccaggtgcctctcgtcatgtggatgagtcacaagactctcatcaccggaactgaggatacactgatgcatcacctccagtgtaacaccgaatctcgcagtgatcagtatggggatctgttccagaat

SEQ ID NO: 691885 - DNA, 430 bp, Homo sapiens
  misc_feature (1)..(1): n is a, c, g, or t
nctcatcttcagctggcttctaagtgtcctgaaagagagcgcggccgccacgctggttggctatcttcagaacacgtctggtagccctcgcgtttctcctgggccaattcgcgaaagaagtggctcacgccttccagagccatatcttcgcgtgtcgaaataagagcccagagaaaggtaggtgtagaaggcttgcaggtccaaattgccgagcctgttcacgcctgcttccacgtcgtgtggaataattctgacgatatctgggagttcatggttggttgcgcaagaagaagctacccacaaaagcggtgttggcaggtcccagaagcaggagatggccgagaagatggtcccgagaggtcgcaagcggagaggatatcagagcgcggtcagagtctgaaagagagtccgcgtatgtgctgcgtccact

SEQ ID NO: 691886 - DNA, 1406 bp, Homo sapiens
  misc_feature (360)..(360): n is a, c, g, or t
  misc_feature (906)..(906): n is a, c, g, or t
  misc_feature (1001)..(1001): n is a, c, g, or t
  misc_feature (1012)..(1012): n is a, c, g, or t
  misc_feature (1030)..(1030): n is a, c, g, or t
  misc_feature (1044)..(1045): n is a, c, g, or t
  misc_feature (1077)..(1077): n is a, c, g, or t
  misc_feature (1188)..(1188): n is a, c, g, or t
taaagcatacgtgagaagcgcgagcacctgttaggtctgttgagcttggtcatacttggtgccctgggagatgctggtgtcatgtactagtgtgcttgcttctcaccaatagaaagacggcaaccagtcgggaacccagagacgattctgagacaagatcgcgagatgcgagtttctcgtctgtcatttaactgcgatctatcagtcgagggtgtcgctatgcgaggctcggatatcgcaagttacggcctcgaccggccctgataagaatgtcatcttctccccactgagcatctccaaccgccttgggccttcctgtctctgggggcccataataccaccctgacagagattctcaanggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggtgctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaangatggaggaagtggaagccatgctgctcccagaagacctgaagcggtggagagactctctggagttcagagagataggtgagctctacctgccanaagttttccantctcgaggggactataancctgaacgacatannttctccagctgggcattgaggaagccttcacncagcaaggctgacctgtcagggatcacaggggccgaggaacctagcagtctcccaggtggtccataaggtgtgcttgatgtatttgacggagggcacagaatgcgaatctngtgccacagcgagtcaaaagtcagcctccttatctgcgatgtagtggagacaaggaccatggtgcgtttcagacaggcccttcgtgatgatcatggtgccgtaggagacacgccagaacatcttcttcatgagcaaagtcagcaatccaagcaagctagagcttggcatcaagcagggggcttccagtaaggaacttgggaatgagctggatgccggg

SEQ ID NO: 691887 - DNA, 236 bp, Homo sapiens
  misc_feature (2)..(2): n is a, c, g, or t
gntcacgataacacacatatacacactataaatcaataagacaaaggccagtgcaggcaaggtgactcacacctgtaatccctgcacttcgggaggctgaggcaggaagattgcttgagcccaagagtttgagaccagcctgggcaacatagcgagaccccatctctacaaaaaattcaaaaattaggcatggcagcacacgcctatagtcccagcaacctgggaggctgaggtgg

SEQ ID NO: 691888 - DNA, 162 bp, Homo sapiens
ggcacgagagactttaaagccaaaaagagggaactagaggaaattgtacagccaattatcagcaaactctatggaggtggaggccctcccccaactggtgagggaggatacatacagaaaaagatgagtttgtaggtcacactgattctactagagctataa

SEQ ID NO: 691889 - DNA, 381 bp, Homo sapiens
gagaaagaagacaaggaagaggaagatataaacatagaagagagagagaaagggcaagaaagcaagaataaaaagaaaggatagaaggaaggggggaggagagagggagagagaaagggcaggagaaaagggacgagagaggagtcacgagaaagagagaagacagaagagggaagaagcgagaagaagggtgaggagaaaaggaggcaggagaatagtcagaggaaaaaggggagagaaaaagatgagaggaggagaaaaaaggcaagctagaagatgtctgaggatgagagtataagtataaatgggggtatgggtgtatgtctgtctctctctctctctctctctctctctctctctctctctctctctctctctctc

SEQ ID NO: 691890 - DNA, 1386 bp, Homo sapiens
ctattcacttgacccggagaaccccacgaaatcatgcaaatcaatgaggttccaatctatcgtgttcactattaagaacactcgtgaaactgctccaggcccatccaagggtcatgcattatacgcaacacagccacgcacagtcatctagcacacagcatgtccactatatcaccagcaaaccagatgtgtcacccattcacgcaacgttacacatggtggcagtatggccaaggtgttgcgccagcgcccacagccaatgggcggcatggcaccaccacagcgtccgcgtggcaccccacacacacagcagatgcatgcacatcttttagcctgccaccattgcattcaaaacaccacgccagcatgcagtcacattgcctgcacaccttcacatggcgttctcagcatcgtcagacattcatcatcggatccattcgcacgccatcatacccacacgtcgcacaccacacagccaccctcacacgcatcgctgaccgcccaggaaccatcaccaagcagcctccaatgcgtctgcgcatttacaacccctatcacaattgcacgcttcctcgctctatgccccaccattctgcacgcaattgcataccctctcaccgtgctacacacagcgccacaccccagcaatctggttcactataacacgctcagccacagccagcgcagcgtttggccacccagacacagcacacacaacagcagtccattccccgaggcaacagccacaacactgcacacgcacacacgcaacacaacctatcattgcgccaccgctgcgccgacctccaacatatccagcccaatccacacccactccaccactggctcacactccacacacagcgcacacacaacccaaaacaaaaacacaccaccacaacaagaaaaaaacaacaaacaccacccacccaacacaagcaaccgccaccacacaaaacacacacgcagcacgcacgacacaaacacacgctctcacacgaccacacgccacccccatgcaccccgacacagccgactaccccccagccaccccagaaccgacctaccccgcaccaccaaggaggcgacgacaacaaacatgcaccgacaacaccacaccaaaaaatacgccggcaccccccgcacaaacaacgagaacaaacaaaccaacagtatacaccacggtaccctcacaaacaatcaccttgaggcacatccccctcatgcccatcgctgcacgaaaggcacccgccacacagaagcccccaccaacgcgcccccacaccgacccacccacagaaccaccacaccaccatacacccacacgcaccccacacacgaccgcaccctccactacaccacacccaccccccacaccaccaaccc

SEQ ID NO: 691891 - DNA, 772 bp, Homo sapiens
  misc_feature (30)..(30): n is a, c, g, or t
cgcggtgggatcatgcatgtaagtcccggnctctcaggggaggcataagaggtcggtaggtatagcttgagccctaggagattctatagctgtgcctgggccatgtttagtcgagatcccgtgtacatccatggaaagagaaggagaaatagaaagatgagaccagaagaattgcatgtgagcgtgcgcgactcgcgagcctggggatgaacagtatccaaagaaagcaccgtggtcgtggagagagagcgagaagaacacaaaaagagaaaaaaagggacaaaacagggtggctgcacgagagcgcggggttccacaagagagcgagagaaacacgcggggtccaaaggaacacacaaaagggcgcccggtggagagagctctcacgagcgcacacagaaaaaaaagagggcacgcgggggggaaacaaatgcgcgcgaaagagcgtgtgcgtgtgaacccaaaatcgtggccgaaagagcagtgggggcaaccacaaagaaagcgcgtacgcgacagggggaggaaactcatcaacccaaaacggagagagaagacaccagagcgcgaggagagtactacagacattgtgtcagattttttaggcaccacaacgccccgggtggaaagaagaagagaaactcagacgagaagcccaacatcaactgtgaggagacaatatacaacaaacaagagaagaccacacaaaacgagaaaacggacccaagaaaaaccaaaaaattaacaaggccgcgccacacacgtggggaga

SEQ ID NO: 691892 - DNA, 303 bp, Homo sapiens
  misc_feature (58)..(58): n is a, c, g, or t
cgagtacggagggacggtccgaagggagggtaaatgagataaaagagctgctggaggngaagtaggtctggccacccagcggcccaccctactctgcaggttttatctcatttaccctcccttcggcccgtccctccgtacttcctgtggcgctcatcagatgcgactggtttgaaaacgcctgtttaaaaacactccgggccaggggcaggggctcacacctgtaatcccagcactttggtaagcttgagtgtggggatcacttgagggcaggggttggagaccagtctaggcaacatgggg

SEQ ID NO: 691893 - DNA, 944 bp, Homo sapiens
  misc_feature (635)..(635): n is a, c, g, or t
gacccacgcgtccgaggacgcgtggggagccctgtttgggctcaggagatagaagacaaaatctgtctcccacgttctgccatggcatcaagggggaagagtagatggtgcttgacgacatggtgtgaaatggttgccatctcaggcagtagatggcccggtctcacttcttggttatctgtctaccctgagcccatgagctgccttttatgggtacaggattgccgtaccttgaaggaccttggcgcgcgtctgtaaggcagtctgactcatctcagaaatgtcaattcttaaacacgtgtggcaacagggacctagaatggctgacgcattaaaggtatttcttcttgtgtcctgttctattatgttcttaaagagctcagtaaccatttcagcacgtctttgccagcaaagccttctccatagatatctcacgatcatgggaaggatcatcttatgcaggtagtcattccaggagtcgtaaggtctttatctgctctcaaggccactcgtgatgtttatgattccgggactgggtgttgggctgggcacaacagttagaagttgcctgtgagatcacacgttcagactgaagagtctgatggagtgtaggagatggggggtgaactttgctnggtcttctgcactttccattcgtctacccactttccatctagtgcatcccacagcggtagtccccctggcacttctgggaaaggcaccgcgggtgcttggtgccacccggggatctttgcccttggaggggcctcctgtgcaagaaggctcaagctcccagggtcacaaaggtgcccgttcaggaccccaggtccctgtgcctttcacagaggcctcccaaaagaaaggtctacaaaggtgcgcgttacaggtgaagaatcgtcaattaagattggaaaaactcacctccccaggaaggaaagagaccc

SEQ ID NO: 691894 - DNA, 171 bp, Homo sapiens
cctgtttgctgccgctccaagatcaatgatttcggaaggactcgctgagcgcttgtttctggttgaggtggactctgtcgcctgtgtgatatgaatatgcttcggcgtcacagtctcctcttcatctttgaattcacctttgagagatctgcctcttctcgctttcttttc

SEQ ID NO: 691895 - DNA, 205 bp, Homo sapiens
gagcccgattttatttgtaaagttgacagtcgagcaaatgttcctatttttgtgggatttgcacacgtttttgtcagttggggtcatgattttagtcccccgctaattatttttacaatgattacaacatttcctccctgggggaaatttttgacccgctttagaacttaaaacctgattttagcaaaaaaagggtccgagatga

SEQ ID NO: 691896 - DNA, 395 bp, Homo sapiens
tggaatgacaggggacagatccaaaataatggccacatagtaaacagtcgagccatagcgaaagcgcagtcctaaaagaaaatcatgtatggggtcacaccatcctcacggtagtccaatagagcaagcatgccatctggatgcatgtatccaccaatcaagaacgggtagtggatgaaatacgcaaggctgtgcttgatttgtactgcagcccgggtgtgcataaaaggttatactctgtgcgggtctctgttcttcacgtttccctttgattgatatcatgtaatctatgatgtacttctagtaggcttctttcgtgaaacttgtttccagcaggtgatggttcatgacaatatcgacaccagtgattactgtggtaacggtcacattatgtc

SEQ ID NO: 691897 - DNA, 1006 bp, Homo sapiens
gaaacaaatgggatatgcagtttatccgtggatggtgatgtgtgtagtggacgaagtgagtcagtgaatagcagcgggagtgctggattgggagatcagtgcgtgatctgagatagtctggttctagggaggtgctctaatgaaagtgtgaatgtgagcctggaattgataggatgcaagaggtacaggtagctctctagggagagttgcaggcagaggagattgggtcttgactggtgtcctcaggaaggaagcccctgggatggagtgcagggagccagctggaagggcacggcgaggggccagggaggccacaggccggcatatgagcatcatgggtcattacgggggcttgagctggctcagagggaggccaggagcttttggacaatttgagtttgaagcagtgatgtggtctgaatcttgacttatattttatcacgggtttaccccactagatccacatggactcaagtcacacacggccgaaacggctcctccatgcagatcaagccttgctcggcacgttcccataaattccagactcctccccaactccgttcctgaatacctctatacggatccccgagctcccagccagatataaccgcttaacctcgtatgcgtcatgtctctagcccctgcacaatggcaagccccctcctcagcttcaatacccctcccccatgttatgcgcatcctgggaggtagaccaccagacttccaccccgaaacggacccacgtgccatggccctgacgaccctcacgacaccaccggccgcccgtccgggaagatactccctaatggcgccacactggggcgaacgccaaacaggcaccaaccactcactaggccacggcacgaacagcacaagccaggacgacaacacacgccccgaccggaacagcactctgcataaacgcacagctactaccaatccgagccacataggccaccacacacccactacacaccacacccaggccccaacagaccacaccacc

SEQ ID NO: 691898 - DNA, 774 bp, Homo sapiens
agcggacttccgtgttgccgcggtgccggagcccgaggcggctgtagcccacatctccgcgagcgaccccgcggcgccctgctccttccgctgctggatgggccctggtgtcacacctcactggcccgcttgtgtccatacccatgtcatgctgccgctgcctgaaccccgtcctgctgcgcgcctgtgtggagctggctgcccccgtcgctgcctgccgagacccttggcgcctgcccctgcaacagggagccccacatgcatggccccaacatgtgcagccgttcctgcgcaatcgacttcaactcctatgagctgggctccctgcaaggccgaggacgaggcgaaccagcccttctgtgccgtgaacatgaaggaggcgctcagcacagagcgtgggaaaacactggtgcagaagaagccgaccaatgtatcctgagtggaagtcgacgttcgatgcccacatctatgaggggcgcgtcatccagattgtgctaattgcgggccagcagaggagccagtgtctgaggtgaccgtggagtgtgtcaggtgctggccgagcgactgaaagacgaccaatggcaaggctgagttctggctggacctgcagcctcaggccaaggtgtacgatgtctggttcagtatttccatggagcgacgtgcacttgcaacacacgttctatgcgcagatgaggacgacggccaacgtcccaacagagtgacccggccggggagccactcacaccagggccaaaatccactaacatcaagaac

SEQ ID NO: 691899 - DNA, 515 bp, Homo sapiens
ggcgcggcctccgcctctcagtacgcggagcggccggctgtcacctggggctcgcggagcggccagatcgcggcggatgtcggctgcgcttccccgaggtgaaggtgggagaggtggacccgtgacgcgatgtgccccgaatgccctctcgatgctgtacctgtccctgcgcctctctgatggctggaggatgctgggatgctgcatcttgggcgccgctctgttgctgctgctgctgcctgcttgctacctgcctgccgtcactgtgtgggctgtgtcccccggactaggcccacgccggtgagcttggagctaggaggccctggtgcctctgctatgcccttcgacctggtctctaacgcctatgctggttgctggcctgcacttactaacatgctgtgagactactgatgcgagctggtagcggctgacttaggaacgctgggctgctagctgcatgaccacctggctgccttgcgtgtgaaatcccgcactgcgctgttgcccgaccactg

SEQ ID NO: 691900 - DNA, 165 bp, Homo sapiens
  misc_feature (46)..(46): n is a, c, g, or t
cctcaagtgcccttcatatcatcaatatagtcaacctggatgcttnactttatataaaaagacttattcctatgaattcttggtattagaattccaagatagaatgttaaatatgtgtgtgtagatatagaagagtgccacttttgggggtacccgagctcgaaa

SEQ ID NO: 691901 - DNA, 761 bp, Homo sapiens
cgctacaacaggtaccgggcctggctattgccggctcacgattactcgccccttatggctatttacggctacaggccccggttacagactaccatcagggttagtccacaacttccgccagagcccagcgacctgggtggcccatccagaatttactcaccagccctatactgaggccggccacccggtagcgcacccaactgattgcacaaaatagctttgtttggatatggagtggacacccattatgtacccaatttaaacttggcgcaactttctattgcccgtcccaacagtgcatcttagtttaaaatttcccccctgggaatcaactctcctgttgactatttcccgagacttctaggtgtttaggcacgcgtgtggtgtctgagaggccatagccgccatcatgggctgatattgttattacccaggtccccccagaaccaggtgagaggctctgcgttcctgctgccaggctctgcagcgctggacctgtggacctggttgtaaagagtacaattgtatcttagggaaccccgtgtccacccttttttttccaccctttaattttatattattttgcgtcatacatttcccgtaacggaagtgctttattttactgtactttttggtaccttttgggcatttaatgtattgtaaggtattttacacgtgtcctgattttgcccccacctggatattgaagctatcccagcttttgaaatataaattttaaaaccccccaaaaaaaaataaaa

SEQ ID NO: 691902 - DNA, 378 bp, Homo sapiens
caatgtcagaataaaggaagagctctttaagagtagggtccagattttatgaatctttgtatttcttatcacaaaacaagaacatgaaagtatgcatttccttcagaaaaaccttctagctcacttaatacagtgttttctcatctctctgtacttttaagacaacttaaatgtagacaatattaaaattgctgaaacattaatgaactgaatacaattgtaccttaatcacaagatctatattgcattggaagaaactctgcatccatctgggagctatacacagctttatgctttatactcacagtcctatgggtaggaccgggtttcagatccatgttatttaacatggactatttcaggtccacattaccttca

SEQ ID NO: 691903 - DNA, 972 bp, Homo sapiens
tgcactgcgcaggtagagagctgtacatgataccagggcacgcacaacaccactagaagtactaatatataccctacttacaggaattgactctataggaggatgtagaacgaatcatacctatggaagttcccgatggctatgctcataagccatcataagcccctgccactgatctgcgaaatacgtgcctgattgtcaaaccagtataggaagctctgtctcaactgctctcgcgacgtggcatctactaatcatcagaggccgaggtattaccatcgcgtgcgtagtaagtagaatatatgtatcctaggttcatagggccatagagtcaaaggagcaagccgatcccattcatctacattggatataagactgagtatgccttcacaggatcaaacagtagggtgggaatcgttgatcaacagaagactggccgtgagataatgagatttgatagagtggttgatactctggtagactggagtgaaagagacctttacttttggtgtgtagcctgattgctgatttgggcagaaatgctgaagaatttgatactaggggatattatatgaacagggacagtggtgaaataaggcgcagtccagggattttgtggaagaaatcaattatgatgagtagtcaaaggagtgttgagcgggctaagaagtatatccgtggcatcctctgacccaggaggcagccagccccagatgacaaggacacatgaggaatacggctcatggaaggggacgaacaggggcagatgatggagaagacgcgggacaacggccgctggcacccacgggtccaggccaagggagcgagggacaaggacatgggcaagccccgtgagggcgtaacggcacaacaacatctggagggggacaagagaagaccgcgccagaggaaagagagacgcaaacacgcaaaggaaacacaggaaacaaagagcgaaccaacaatatccag

SEQ ID NO: 691904 - DNA, 1030 bp, Homo sapiens
  misc_feature (288)..(288): n is a, c, g, or t
gcacagagtacggaagatgctgccattgactatgtcccgagggtcactacaccattggccaaggagatcattagacccttgtgttggaccgacttcgcaaccctggctgaccgagatgcaacctggttcttcagaggacttcttggtgttccacagctttgagtggggtgaactggttctgtggttcacctccctgctcatggaacgtctctcagttgattatggcaatgaagtcacaagctggaagttcgtctcatttacccaagtaccccaaggatttccagcagnctgctagttgagtccctacaactccatcctcatccagccacactcatccctggcagcactctgatttgtgccttcatggtagacaactgaggccatctatgacatctgtacgtagaatcctcgaataatcgaggcgtcccagagcacttatcactaagccgtttaaagcgggcttagttatggcccggattggtggttccctctcagtgtccaactgtgctttcctgggagaaattgggcagtgagagcccgtgacatgtgtgtagacgcgtgccagaattttcccgtggacacacctctgggtgacccttatcccgcgcgtatccatcttccctctggccacatactgcccctgtcattctctgctgagaaagcctaccgattgaagcagctttctgtaggcaggagatcacgcaatgcttgctttgagccagccaaccagatggtgaacatgtgaccctcgccatggtcaatacatggctttgctgcctgatgtaccggtggtgacgtggttcccaacagatgtcaatgcttgccattgacacccatcaaaaccaaagcgcagcaatccaggtctgtggattggttgccacaactggcttccacggttggcattaaactaccagcctcacactgcaggtgactggtggagcacctggccaacgtacagaagagctgtgtgcatgctcgagcaagacaacaagcattggtgaggcggcgctccctggaccacaagttgaca

SEQ ID NO: 691905 - DNA, 208 bp, Homo sapiens
  misc_feature (12)..(12): n is a, c, g, or t
  misc_feature (14)..(14): n is a, c, g, or t
  misc_feature (19)..(19): n is a, c, g, or t
  misc_feature (93)..(93): n is a, c, g, or t
  misc_feature (101)..(101): n is a, c, g, or t
  misc_feature (103)..(103): n is a, c, g, or t
  misc_feature (109)..(109): n is a, c, g, or t
  misc_feature (151)..(151): n is a, c, g, or t
  misc_feature (160)..(160): n is a, c, g, or t
  misc_feature (167)..(167): n is a, c, g, or t
  misc_feature (170)..(170): n is a, c, g, or t
  misc_feature (174)..(174): n is a, c, g, or t
  misc_feature (177)..(177): n is a, c, g, or t
  misc_feature (185)..(186): n is a, c, g, or t
  misc_feature (197)..(197): n is a, c, g, or t
cttgtgcaaaangntagantcaatcataaagtgcacacctttattcagaactttagtattaaatcagttctcaatttcattttttatgcattnttttactncntttttnttcatacgtaaaattttcggattaatttgtgaaaatgtaatnataagctgngaccggnggntctnttnttaaaagnnccatattaaancctggaaacct

SEQ ID NO: 691906 - DNA, 424 bp, Homo sapiens
  misc_feature (110)..(110): n is a, c, g, or t
  misc_feature (119)..(119): n is a, c, g, or t
  misc_feature (370)..(371): n is a, c, g, or t
caccttggaaggcccgaaccttagaaatgaagctgctgttgttgattccagagaatactggcaaagtattggtggggagtcattcatggcccagtacttaggaatgtatntgacacagngcataagttttaaagccaggcctgtcaactagcaatgcaagtgctgtctatcagtgtactacacctggtggtatatgtaccccctcacttccttttagatactgtctttactaactcttggagaacgtcatatctgtctgtaatgcattttgattctgtccgtctgatctcctcttcctactcttcccagccaggctgatttagatctgcctgcttctgcttcccaagcactgggattaaaagtggccatnncgcttggcgtcgaaacgcccccgaatttagtagtagtaggcggccgctattga

SEQ ID NO: 691907 - DNA, 484 bp, Homo sapiens
  misc_feature (470)..(470): n is a, c, g, or t
tcctacataccgttacttagagcagactgacatactgtgccagccatgcatagtttgttaagtgccttgtctatcggacagagatggaccacctctagagtcaggagtcagaataagagcataccatcatctacaaaagcacatgccattgacatgagagtacgtgctttattgaatattaaagtcactcagcctgtccttttttccattcctgacatgactatttataagcaccaatattgcttcactgatctgcatcccctgtgtaatcccatgagacgatctgtcactgccgcatggatcctgcagccgacattgcctagattcacaagggacgcgttctcgcaagtactatggtcaaaaaagtcagaaggattccaggagccgtagctctaggtttttatctagacattagtcacttcactgtgctaggaccactaagatctatattcactgatatttctctaagnatgcggctatttat

SEQ ID NO: 691908 - DNA, 404 bp, Homo sapiens
ggggctgctttgctgcgtctactgcaagaacgaagactatggtgaccaatcagactggcggcatcccagaaaatgtcgacattactctgaaggaacgcgcagatttcgtgaacggccccagagtaaccctgcggagggactgaaatcgcataacggtctcaaacttattggaaagagctaaagaaggctccagattgtcaaatgacggagaaacataacggaactgactaccggacggactatttgtagacatggacagaacatgatcaagggcgttacactgggctaacgttacaagatgagggatgagtgtgctaactgactaatgaaccttgatatacagcaaattgaaggtcttggcgaaatccgaaatttgtaggtggataaatccattcgggtacgtt

SEQ ID NO: 691909 - DNA, 370 bp, Homo sapiens
tgatatcacacaaattcaaatgaaattatcttactacatgttagattgggcccaagaaaagtcgctctcctttttttttccaaaagggtgtttttccagtgttcttgaggtcatgaaaaaatgacttttatattttcgttaggagtacaattaaaacagttctttgtgaggtggatttggctctatccatcaaagtataatagcaatccttccgtaatagtcccctggattatatctcaggggactaactatgcctatattgatacctagtgtcattcagattttgatatgatatgggcactaatgtcaggctggtatgactcctttagtggtttgatttagggggggggtttcctactggaggccttgg

SEQ ID NO: 691910 - DNA, 177 bp, Homo sapiens
atgaagggaacaggcacacagaaatacaacggacagggaatccaccagacttcatccaaacttcaggagtgtctaggccaaaagcgccttttaagagatgctggtttgttaattggtataaaggccgagatggacagagccactgctgtacatgcactcaccgcaggatgctgcgag

SEQ ID NO: 691911 - DNA, 147 bp, Homo sapiens
ctgatcgctaggacagcgctctggcagaaacaggtcagtgccagccaggctgtggggtgagagctaccacgcgtcaggcgctgaactggcgtggcttccaatggtgacctggcgcatggctgtcgcagggttaccgagctcgtaatt

SEQ ID NO: 691912 - DNA, 740 bp, Homo sapiens
  misc_feature (321)..(321): n is a, c, g, or t
  misc_feature (560)..(560): n is a, c, g, or t
  misc_feature (613)..(613): n is a, c, g, or t
ttgttacatgctagtcagggcttccagtgagcaatgaaagtcgagcagcgagtgactgaagacctgagtgagctgtgactgaatccatgcaactggtaacggacgaagtggacagccgtcaagacttggcctttacaccgtgaccgagaggcctgctgcacctggcatcaggccacgaccgtttcagtgacgtatatggcgtcgcgactgctcgatagcgcgaagcaggtcgtcaatgtaaccatggacaattatgacatggcgaaatggcttgtaaccacctcactcgtgatgaaacttgatccatgtgagcaaaccttntagttaccagttggcacgcgtattgagcatgtcacgggaacatatgcaccatgtagatatcacacaatagagctctactagtcaaagactacttgacgggcccgcaaggacgtaccttggtgcagataggtccttcgcatccctcgtttgtcgcaggacagcaacaggtgtttgaccaggacgtgctgttgagggcttgacaccactctgctcccaatgtgacatcacggaatggcttnaaaaccgcacgaagtgcagaccttacccaagccaattaccaagtatccatgantgactaggcctggagcgcatggctgtgggtatccaaaccaggacgacgatgagtctgggtgcaggcagacagggattatccctagtagtaaggtaacggtaaatacctcgtttgaccagtcaacgct

SEQ ID NO: 691913 - DNA, 342 bp, Homo sapiens
  misc_feature (8)..(8): n is a, c, g, or t
cacgcatncaccagttgtattatgctgcagatatataatatatgatatcagttttctgaggaaggtgatgaaaccaaaatcacctaccctgcaaccaactcctgaagttcacaatggattacgagtgacttctgtccggaaacctgcagtctatattaagcaatgtgaatgtttgaattttggaataaaaactcttgaggatatttattccaagaatatgaacggacaaatctaatgaagcataggtgagggttcttcaggagtttccagtcttttactccaccctgagcccgttccaggtccttaaaaagaaaatgtccggactgtgttgaggaccgtaac

SEQ ID NO: 691914 - DNA, 774 bp, Homo sapiens
gcgaggcagccacgcgggagaggccgccaggcggcacgccggggcgagggccaggtgccagatcggccaccggggcaagggtacctgggccgttgaggacccggtcagcgcggcacgtgagttggaatcgaagcctcttaaaatggcagatgacttgtgacttcgagacatggagatgcagtggcctcagccaccttcccaatgcagtgctcagcattacgtaagaatggctttgtgggtgcttcaaaagggcggccctggttagcaactcgccagaagaagtgtcataacttcagaaaggatgtggcagccgcggtggtgcaccgcataggggctccatcgtggttggttatgacatctttagtgggaagaaatatgaagatatctgcccgtcaactcataatatggatgtccccaacatcaaaaggaatgacttccagctgattgcatccaggatgggtacctatcactgctccaggacagcgtgggaggtacgagaggaccttcgtcttccctgagggagcacttggcaggcgcatttgagcagaaggtacgactgtggaggaagagatcctgatcacgggtgctgtctgcatgacaagaggaggccagcttgtcgcaatcaacggccatggcaaaataactgtgtcccaggtggctgtggtggctagcagtgatcctctgaactgcatagagggcccttccgagctggctggtttggccggtctaagtggtctctctacacattattgcggtaattgggtccaaccccta

SEQ ID NO: 691915 - DNA, 510 bp, Homo sapiens
  misc_feature (458)..(458): n is a, c, g, or t
cggggtgggccaggagggtctcaatctccgggcctcaggatccggccggcctcagagaattggtttataatctaatttccagtctacatggaaatttccctacttatctcccaaatttccttcacacatctagggcaaaaccagtttccaaactaggaccaggcattccatggggggggtatgtatctcaaatctcttaattggcaacaaaaggttttttaataagtcttttaaaatctacaatagtcttggctttaaggataaggatctccggagagccggtgccagggtctggtaacagtttctagcttcgggattggccttttccaacccggggtggcggttagcttaatcctggtaattccggtgaacggaaagttacatctaagggtatgattagattcaagttcaacttttttccgtttttaagaaagcaaaatggcataagagataaggtngggtacttcaggctaagaccagagacgagcaatatcttatctcagggattgc

SEQ ID NO: 691916 - DNA, 359 bp, Homo sapiens
gtgacgaccttacgggtctcctaactttaatggccacttagaggaacatgacaacttacacaacaagcctcaaaagaacaggcagggctgggcgcggtgtgctcacgcctgttatcacagcacttagggaggccgaggcgggcagatcatgacgtcaggagatcaagaccatcctggctaacatggtgaaatcccatctctactaaaaatacaaaaaattagctgggcgtggtggcaggtacctgtagtcccagctacttgggaggctgacaggagaatggcgtgaacccgggaggcggacctcgcccagtgagctgagatcgtggccactgaactccagcctgagcgaaagagcgaga

SEQ ID NO: 691917 - DNA, 1699 bp, Homo sapiens
cgctggctgggtcatgcctgttaatcccagctctcagtggagggctaagagtgcgggagtgatagcttgacgcctcaggcagcttcgatgatcctgacctgggtaatatagcgagatcccgttctccagagaaaggaacgcaaaagaagacgaaaggccaaaaagaaacgcaaaataggccagaaaaaagaaaagcgaggcgggcgcgagcgcgacggctggaaagcagcgtgtcttgcactagaagcctggagggggtgggccagtcgtccgcagcttgtcagccggggggccacctggggcccagacagccggtgttcgcacaaggaaagaagcggaggcaagcaagagcaagcgggggggcgggctccaaccagatcgattagaagcacgggcacgcgcgggagtgcaacccctgcaagtggggcttgcgtaggaaagaccccgccgcagggggcgcgcaagaagagagcgagcaaggtatagaggaggaggcatataacaaaacggagtgacgtgcccacgtcgatgccggccctactaatcagggtgacccccccccggtgggggggggtggcgcactcgacaatgcctggacggtgggacacaccaccgggtggggcccagaacgcgaatatggccgggaaccaaggaggactcggagaagacaaccacccagatgcgagagcgcggagaaatacaagctacccattggaagctagggacgacgaaactttgggataccatcgaggcacgagaatgacactattggggaggaccaggaaaaaggagcaatcaccccaaggggtacactaggtggagcactcaacatcgaatacgagggcggcggagcaagggcacatcacggagcaacgggcgggaagacaaccacaagcagtgactgccgtgccttgtgtggaacaagtaacggattgtggtgcacttgtgaccttaatcgacaaagccgtgctgtgctgcaccgtgcatagagtgctgctccttgccgctatggatcaagatcggaggcctacccgtgctaattgcacgaccaacaaaagcagagaaaaaaaagaaagagaacaaacaacagccccatcatgctgctgctacttctatcttctatgtcattatcacaccatgctgtacaccgacacaaggcacaagagcgatccgacaaagacaagagacgacgagagaacagagggcgagccagcagaacgaacagggaaggagaaaggagagacaaagagcgagagacgaaggcgagaccgaagagagcaacgagacgaagagcggcaagaagagagcagtgaagaggagaggaagagagaagagaaacgacaaaagagaagagaaagaagacaaaaaaagaggaggtgaggaagagagaggaaggaggcgcgggaagaagaagcgagaaggaaggggagagacgagggagcgggatggagaacgcaggagagaggcgagacaccgaaagaacaaagaacgcgcgcgagaaagcaagagacgagcagagaagcgacgagagcaagcacagcacaagcgagacgaaagggaggagagagagagacagcagcaacagcagcatgggcgcggcggagcagcgacacaaccagcgaggcgaaggaccagaaggacgaggacagaacgaaaggagcgacagaggagagaggagacagagagagacacaccagga

SEQ ID NO: 691918 - DNA, 113 bp, Homo sapiens
ctagagatccgagtatgctgcacagcatagcataggagtgtggtgttaacaaatacagctcccttcactgcctttcagattctctattttctacagttcctgagatgcacact

SEQ ID NO: 691919 - DNA, 151 bp, Homo sapiens
ttacgctcggtccatcatagaggcacggaggcgtcggagtctgtgtcttgagcttgttctgcgttcaacactgagatccaccgatgtgcagctgcggcatcccctgttggtcagctccaaagcaactgtgacgtccgtgggcctctagatt

SEQ ID NO: 691920 - DNA, 391 bp, Homo sapiens
tctgtgggctcacgccctgcctgtcctggcagccgcgagctccgtgtagacctggtggactttgagggctacacctagtttgctaagtacaaatcattcaatggtggctgacgaggcagaaaagtacaagctggtactgggagcctttgtcgggggctgtttggattccaaaacagcccccgatattggcgtttacccgcgtaaacaagataaggcttctgactcttaactcccccagccccagagaaactggcacatacatcacaaaaacgcaaagattccccaatgaccttagccccattgctccattcactcccaggtgagaattcaggcgaacgtccacaaaggtcacaggcagcgtacatacggatctgtaatactggttccgagc

SEQ ID NO: 691921 - DNA, 137 bp, Homo sapiens
ccttggctgctcaggtctcctggcttgctcaggtctcctggcttgctcaggtctccaggcttcctcaggtctcttcacctctcatgtctcttcaccgtgccagacctgagcaagcccggagacctgagcaagccatg

SEQ ID NO: 691922 - DNA, 1130 bp, Homo sapiens
gctgttacggtcgggattttagggatctcagagaagctgccttggactgctcgtagacgccgggccttctctcctcgtcatcatccgggagcagccagtgtcctgtgaggcagaagatgcccgcactccagacctgcatccatccatcccgtgtcccaggtgtcacggggccagaaggcagccttggttctgctgagtgcctgcctggtgaccctttgggggctaggagagccaccagagcacactctctcggtacctggtcctccacctagcctccctgcagctgggactgctgttaaacggggtctgcagcctggctgaggagcatgcgccacatccactccagtgtaccggggcagctacttggaggactgtgctgggcctgcctgggcatgaccccatccgaccgttggggccctgttgcatgcatgttccatctagtttctacatactcaccatcccaaagtgcggtcaggctccgccacttcacgtatgggagtgcattgcctcatccctggggcctcgtgcgaggcaactgaacaatacgtcactgggacgctcagatggggacctggccaccaagcatgagatacgtctggcagatgtcgtgaagaaaggggaattcatccacgcgtgggcccacatggacgctggggcagcttggggtccagtatattaacattccgggaataactccgtgccgagccttgattcccttgccccagaagccatccaagatgccactgcgaactttcagacacacatctcaccgatttcaactacacatttcagcacacacaactgcgcgtgtccgtacacgacgagagattgccaagcgatgaactgccccaaacggcggactgagtggactacattagctatacctgtcgactttacgccccaagttttgagcgacaccgatggcagggcggctgattggccccctatcaagcagagccgacgaatggacgacttaacggtgcgccttgtcagagccccacacgaaccgacattatccgggccttgcacctgtgggaaattcatcaacattgtcgcccccaaacgcaaggaaacgcagcgctggaacccggtgtgaccgtgtggacacttacgaaggggcacatcacggg

SEQ ID NO: 691923 - DNA, 202 bp, Homo sapiens
tataagaagacaaagagcatctgaacgatgagaggagctcagccgggggtggactgagagaagaatgacacaggacagccaaacaccaggagaagatcacaacccaacccaaaccaacaagagcaccccaaccaaccaaccgagaccacctccaccacatcagcaaaacccccacataaaagctacaacgccccacacccca

SEQ ID NO: 691924 - DNA, 1519 bp, Homo sapiens
tggtgctcggcatggctatagatttctgcgactgtgctgataggagactgctgatagcgaaagatgtcattcagagaaatgctaaaactaggcgcacccatggccccacaagcattcaagacgcgcagcatgcatgctatagtgcccaggagtggtcaggctgttaagacgagtactcagtgcctggtctagacattacagacagggacaacactatggttgggtgttccttgctcttgtaagcaccatacttggagctttcaaccgtgttggctgctgcgcccgaaccggggaggactcaatttggcctattacacggtgtactaagcgggccaggcaaggacacctttctcacacgcacacaccgttcaacacctaggcctagaagcttgcactactgggcgtagcctaatccctaggttgggacttttcctgcaagctgtgttccgtggggttccgaattgcgtgaaagacctaacttggggacgctttccaacacttcaaacaatgcccttttgaaaggtacaaaaaacagacagggccaacgccgcacccattgggaaggcaaaccccccaaactggcaaactcgcactgtgcctctgtgactagtcgcggcgctcaattcccatggcataccccgcctggtatagagggcaccaggtcccataccctcgaagttactaggccgcttcccaacggagcacacttctacccttcggacgccgcgactgcccttctgccatctcgcgcggcccttggactttggcccaccggggtctcggtgccttcccggacttgcacatgacgcggcggcacccatctgctacgttacgcttccacctcttgcggccctctcgcactctacaccggcggcgtgtacttttcccctccttccgcgcgccaactgcacactccaccccttcggtttacaccacactcgtagccctgttccgcctcccttggtctgtggggggccccccgtgcttcctcttggccttgcggcccctctgccccgacaacccttacttgcggaaagcgcatctccttaacgcgtatgcaacatggtgcgccgctttctctccgcacgcgctttttcacacgtcggagccacgacacgccctgctttgctgctctgctaacaacgactcgctctggcccccctgacctctgttgacggtttgggggcgatagcccgcttgggtgtcacgcttgagtatttactgcacatttcagcaacctgggtcccctatgccatgtgctctcgcacactggtaacccagtagggccacatcacagcgaacactatactcctcgctcgccctaaacggtgtctgtaatccgttcggcacccgtgccttgagcagcccttggcatctccataacgcttggtccatagggctctggctcggctggcgccctgtcccctgtgtgtcaactccatacaacctccttcctccccccggtattatcgactatctgatcccccctctacacctatcacacgtcgcactagcgctc

SEQ ID NO: 691925 - DNA, 379 bp, Homo sapiens
  misc_feature (76)..(76): n is a, c, g, or t
aggggggccggcttttaaaaaaggggggcccggcccctgggcttttttttgttccgaggggggggaaaaagttccngggttccctgcaggccaaagggaggggggtgaagggggcccgtcccaaatttatttttttccccaggaagccctgggcccccaaaaagggggacagttttttttaaaaattgaaattggccccccaatttccggggccggttttgcccgtccggaaggtttttaaaaaggggaaggctcgggttttccctggggaaaaaaaaaattttaaaccctttgtttttttccgtttggcccgggcccacccccggttttttgggataggggcaaaaaaacccaaggaaccccccgaacggggttttta

SEQ ID NO: 691926 - DNA, 1178 bp, Homo sapiens
ggggcactgtgctcgctggccaagtgagtaccgattacaaggacccacgttcggcagtcgcctcgtgtgaccggatcctcgctggaggacgggattctggtggccaacatgcatggccagacgactagtatcatggcgtggatagcaagcgaccactaggcactcaataagaccgactggtagaaacagagatatctgcgtcctctactagccagtgtgggttggtggaacggaactggtgttaaacacttgggttaacaattgacagtttgattcgtgtacattatttgaacacactgggtagagagggcgagtaatgagtaggatattgcttgctaatgacgaggtttgcttgatttacaaaagaacttataaggtcccaccgttctgacccgtaatcatgaggaacagtttcctagggcagtcccagggtcctgcataaatgctttgggacgtggggtggtcctgtgtggttgccacacccgagtgggccagtcacactcacaccagcgtggaacaatcgtgctgagggtgtcattcataacagagtgcccagttcattggaatctcccaacaagggggaatagctgataaccccatatgtttgagcggcccttgctcgcataatacggaatatgggggtagctccatcttgcaaacaaagggtacctcaaattagatctgtgcgtacagagggaagtttgtcgccctttccacgaaatcacgacgacagattaaggttttagggtgcggcatttctatagaacatcgacctcggtatacgatagtgcgccacaactcagaattcggtggatggaaaataccacggtggaagtcccagtctctcctgcgggcagctttttggcacacccacgattggcgaacacggggggcgggagctcaagacacgttatctggcttatatcgcatctttgacttacccaccagtggaacacgcaagtcctttctatacacaccgtattggagacacacaatatcgttcgaaacaccagtcaccggtatcgagacacctttctagtacaatctctatagttaaaaaacgggttggcacaagataagtcgcgtcccggcttcggataaccctattggggcgcctaccacggcagtgcgttggacacggttttggaacttttcggttgaacctgtactagagaagg

SEQ ID NO: 691927 - DNA, 219 bp, Homo sapiens
catgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaagccggtccctggtaccagaaaggttggggaccactggcttaaaataccaataaattgttgaacctt

SEQ ID NO: 691928 - DNA, 192 bp, Homo sapiens
tgtgcgctttcctgaagcgcactgcggaagcgccctaagcgtcacccaagcatactcacttaaagaaaaaacgagttctttcgttctgtgcgcagctaacaaggggcgccctacatctcacgtgccactccctgccccaggactagcacccaatgacctttggatccaggtggcgagcatgcaagggcaagc

SEQ ID NO: 691929 - DNA, 196 bp, Homo sapiens
ctacctcacaagactatatccactacagactacaattacagaaaacatccttaaaagcgcaagtatgacgacctctcaaagagacttatgtggcagaatatgaaaactcaatcctgatctcgagaatgcaacaaacacaagaatacctctcttcagtcgatggaatataaaagtcggtacagctcaatcgtatcat

SEQ ID NO: 691930 - DNA, 129 bp, Homo sapiens
taatctaagaaggtaccactgtaacctctcctgtgtcaaaatagttgcttaaatttcagcttgtagatagcactgattttagccctgggactcccatctgcagaccagcagactactatcacacgatgt

SEQ ID NO: 691931 - DNA, 465 bp, Homo sapiens
  misc_feature (212)..(212): n is a, c, g, or t
gaacctgtctaatgcaggtgaaaaccaccccattggcacccaggctttttgaaccgggggctgtctccccagaaggatcctcttgtgcttctggaggcaaggatggccaggccatgttatgggatccaacaaaggcaaaccctttcccccctaaatggtggggacatcatcaacgccctgtgcttcagccctaaccgctactgggtgtgtgntgccacaggcccccgcatcaaaatttgggatttaaagggaaagatccttgtagatgaactgaagcaaaaagttttcagttccagcagcaaggcagaacccccccagggcccccccctggcctggtttgttaaaggccaaactttgttttctggctacccggacaacctggggcgagtgtggcaggtgacccttggccccccctaaaagtttatggcaaagctttccaaataaaaaaaaaactggcttttttta

SEQ ID NO: 691932 - DNA, 451 bp, Homo sapiens
ggcagacactagaggatcccaattatattgaaaaacaaatttttacttctttgtatggaacaagtcatatctattcttcacaagatcagcaagcgcacttggaaaataaatgacttgtcccataccaagaattaaaaattagtattactcagtataattataaattaagtatcatggaactttagagactctcttgaatagtcagacacctcaaatattaagtccttaaatttcagttgtagggtttaatgcttttatattttcttatctccacaggtataaatggtataaagaattgtgggatgtattattgttaccagaattagatgccgtcattttaacttgtcagagtatgtgtatccccccgatatccttgattctctttctgtatggaacgtgtactgcctactggagtggcctactgtcttctgcatctgtgaaacttctttct

SEQ ID NO: 691933 - DNA, 300 bp, Homo sapiens
ctactgatggattttgaaaccaactacacgacattccctgattccaaccaccatgacaccatgaaactagtttttaatgacacagtatgtaaatgctattttgcaaaaacacacaccaaatattgtttgaagatgcagatcacgaggctcaaggagaacagtagaactatgttaaagtaaagtaatcggttaagcagttatttactactgaaaataagtgacacccacgtagttcatgttatataataatattgaaaccaaatgacagtctaataccgcaaataatttaataaaaaaaaa

SEQ ID NO: 691934 - DNA, 237 bp, Homo sapiens
actaagtgtcagacaggtatagtaggagacaagcagctaccagacacgatctcccaagtactccatcagcagtgtcattcaaggtttttcggtccatttttcaaggcaggttgtaagctcttccatcatttcacagccagctggctcatgtcaggcagtccctcccatctgcgcattggcatgcatgcatggcgtgcatccattcccaccatagctttgttcagcaggcatcccagc

SEQ ID NO: 691935 - DNA, 1245 bp, Homo sapiens
tgaaacagggttttgttcttgtgtgccataggcgtggagtgtgcaagtggtgtgcaactcttggcctcaggtgcaacctctccgcctctcccaggtttcaagcgatttttcctgtgccataaccctctcccaagttagcgtgggactacaggcattgcaccaccaccccgtggtttaattgtgtggtattttttagatagaagaacaggggttttgtcgccagtgtttggccgaggcgtggctcttgaaacctccgtgaaccctcagggtgtgaatccaatcttaccttcgaaacctctccaagaggtgcctgagagatttaccgggcgctattagacgccaactcgtttcccccagggccatgtgaacgcgcggatattcttgtttataaatacacggggagacacctttgaaggcatgtgttccctttctgtgttagacccccacgagaagttttccccctttcctataagggcaatataatgaaacatatttgcccccaacaaacaagaaaatgatttgcaacactcccatctccgttgtctctccaccacatctcacacaaaaaccctttttctctctaacaactttgggcatttttctccatattaataaccacggatggcttatgctcctccatataaatattacagtccccaaatcacaaatacccttgtaatacaaccccagcgcgccgaaatgttatacctatatatccacaccgagaatgttgaacgctgaggggactttataagaccaaaacaaatttgtgtggggaataaacaactcttcatgttgactgcagacctattcatctatcctcttctccacagcgcctacctgttggtaaaaacatgcgatgatggaacgtcggctctccgagataagatggccccgtagttggtgccttcatcagaggcccccggttgatgttactattccgcacacaggaccaatattaagaagcagcggaagcggaccacacccgtggtacacacccctctggcgcaccctgttgaggctgtctttaatacttgaacagcggctgaggatctattcaaacaataagtcgtttgtacctactgacgtggagagcacaacatttgtcgtgcgttcgtggtctcaccagcgctgcctcacctagaaacaaatcatttcaacgccacgcaaagaccgcaatcacaactagtcataataaactacatcctctatacaaatgtggaggaggtcatgacccccccgagg

SEQ ID NO: 691936 - DNA, 1118 bp, Homo sapiens
  misc_feature (781)..(781): n is a, c, g, or t
  misc_feature (1009)..(1009): n is a, c, g, or t
agcgggctccgtgggtccagtgagattgggcctgggctgctagaggacgctgctgtgagcgcccgcgcgacgagcggctgccattggtaggccatgccagagcccagaaaatcactgccgggggagagccgaagaacagaccgggtgagtactcaagtatgatgagatcagcggcttgtggatggaggcagcgagttgacccgtgcttcgtccatgcatgcaaggacaggcaggcagtgcagactcgtgttgctgtgcggatatccagtgcgagattattcgggtcgcaccaggggaggatgttaagtaccaccatgttttgaaatggagattcaatgaggccatcacaatgttagacaaagtgagagcatagttacatcgcgaagaatcagactccacttttatcgctaaggtcgcgtgttgtcttgtccatttgtagcgtggcgggtgatcttgtgtcatgtactcgacaaacggcgtggactcaggccagagagcatgcttagtcgcgttggtaacatcgctagcgttcataactgtgagacagactaaagtaccgtgaagagagagtaacctctgtcatcctataaggacttggatttccttgtactggcttattgatagtagatcattctcatgtatagtgataacatgtgaaacatcttcgctcgtatgcggaatactcttcgtgctatccgtcatatgggtaacaagacgctttaaggtgggaaacggtcgtactccttcgttgctaaccatgagatctcggggaccacccttnagcaaggatttgtgaactatagcattggtaggaagaagccataacgtttccacggtggagtatatggagggaagcaagaacggagttgggtacacaaaagaccaacgacgaaaattaatcggacaagttgctcggataggggttccgccaaattacataagttcggttccaatgttcacattttccatttttgaatttttgagctatatggggacgaaccctgggaanggcacttggagaacatgatgtaatagtacaagagaccaaagtgcatatgataacccaatctgctttgagttagatcttggacccaaattggtcacaggaaatgaaatgg

SEQ ID NO: 691937 - DNA, 545 bp, Homo sapiens
  misc_feature (2)..(2): n is a, c, g, or t
  misc_feature (66)..(66): n is a, c, g, or t
  misc_feature (72)..(72): n is a, c, g, or t
  misc_feature (107)..(107): n is a, c, g, or t
  misc_feature (118)..(118): n is a, c, g, or t
  misc_feature (149)..(149): n is a, c, g, or t
  misc_feature (172)..(172): n is a, c, g, or t
  misc_feature (174)..(174): n is a, c, g, or t
  misc_feature (185)..(185): n is a, c, g, or t
  misc_feature (206)..(206): n is a, c, g, or t
  misc_feature (293)..(293): n is a, c, g, or t
  misc_feature (351)..(351): n is a, c, g, or t
  misc_feature (373)..(373): n is a, c, g, or t
  misc_feature (398)..(398): n is a, c, g, or t
  misc_feature (433)..(433): n is a, c, g, or t
  misc_feature (440)..(440): n is a, c, g, or t
  misc_feature (454)..(454): n is a, c, g, or t
  misc_feature (483)..(483): n is a, c, g, or t
  misc_feature (536)..(536): n is a, c, g, or t
tnggggcaggccacgaccacggccccggcctgctgccgtgggagcatccacagtcgagcgggggtncttganggtttcatctacaaacacgaccaggcacccagccncagaggctccngtcaccccattcatccgcaccacacccggcncccacacgaaaccctcaaagtcntnaccaatctccncctcctaaaagtctacaccanaccaaatacccccctgggcatcccgaccccccaccctctcaacaatatctctcgcaccaaacccaccattctcacacaccccccctnggaaaatctccaaagccttcccaaaacccccaatcaacaccccccctcttcctcaaanaatcctcaactaaccccccaanaacctcaacactcccactctcaatngccccgccaccagccaccactgaatcattcttganggccctnctgacgatcatganggcatcatgcagggaccgctctgtctccnccataaactgctcggcgccgccacggagaatgaaggtgcatgttttggccttngggcagcca

SEQ ID NO: 691938 - DNA, 176 bp, Homo sapiens
tgagtatgacatggaaacgaaccatgaaatcggaaacagccataagcatctgggtttgcttagtagaaccgaccctcccaagcacccttagcaggacattcatcttttttggtagtaacacaggtctaaaaacactgtcgaagtatcagctccttagcaatctgtcaatcaaagtg

SEQ ID NO: 691939 - DNA, 859 bp, Homo sapiens
aagtctatcagaacttgtatgatttcatacatatgacagaagacttaaatatacacaacagatatgtacacttgggcatgaacagtgagttcttaggaggccacagaacaaagggccaatgtgtggctattaagaatagggtctgcactttgggaggctgaggtgggcagattgcttgagctcaggagctcggctagcctgggcaacatggcgaaacactgcctctacaaggaataaaaacaggttagctgggcatggtgacatgcaccttggtcctggctactcgcagactgaggtgggaggatcgcttgagcccaggagtccgaggctgcagtgacttgtgatcactccactgcacaccagcctgggaaacagagtgagaccctgtctcagaaaaaaaagaacagggtcccttgctcatttccatcacatctctggaaatgtccaatatgccttaatgaattcaagcacatcccaggaaatggtgaaggacagttacatagggctaatgcctccaagctttttctgacactaccacaaaaagcatggaagagaacaagttattctagttgaatcactcataacattattacgacctatatgaacatattttagtcaggccattcttactggtgatttactggtgaagaattggaaatctgtatggtcgtctctgacattaacgaattctggtgaactgttcgggtcgtacctttttcagggttaattaactttgaaagtgtgagctgggtgtgaaacactctgttaggccggaagtattggagcatgtttaaagaaatctcaaaaagcaaaaatgtgggggaaaaaaaggagatagggaaaggggatagatcaaaca

SEQ ID NO: 691940 - DNA, 251 bp, Homo sapiens
gaggatctacatgggtcgagtcaggaagggtacgttctgtgtgtgcgaagttatgtgagcaccaagcagtcggggaaatcccataggtcaggacttgagaaaccacggttccaggctgcaatccaggctgtacagtcatgccactgaacttaataagcatctacttcttcactttatttattgatctattataatgttctgagagagagactccctctgtaacccagggtggagtgcaggggaatgatttt

SEQ ID NO: 691941 - DNA, 301 bp, Homo sapiens
  misc_feature (21)..(21): n is a, c, g, or t
  misc_feature (36)..(36): n is a, c, g, or t
  misc_feature (77)..(77): n is a, c, g, or t
  misc_feature (97)..(97): n is a, c, g, or t
  misc_feature (132)..(132): n is a, c, g, or t
  misc_feature (146)..(146): n is a, c, g, or t
  misc_feature (207)..(207): n is a, c, g, or t
  misc_feature (225)..(225): n is a, c, g, or t
  misc_feature (238)..(238): n is a, c, g, or t
  misc_feature (286)..(286): n is a, c, g, or t
ttcttaccttggaggaggganatcccgcttccttanccttaacttttttgttgctcctccccactgccccttttaanttatttggttgttttcgganggaagggggaagggggtaggctgggccgggaactntccgaggtgctganctggggcgggaccggaatcctcccggtagggtcccagggactgagttggcctggggccgtntccaaggtgccaatgatncgggccgacagangggccgcactgtctgtctgtccgtctgtcccggaaagaactattaaanctggaagcgcctgca

SEQ ID NO: 691942 - DNA, 133 bp, Homo sapiens
cacactgtctgcttcagggttggagctaggagataggagagaaggtctgatctgttgactactatttcgccacctacctggatcttcctgggagcctgctcgtactgttcccggacagactttctaggtaaac

SEQ ID NO: 691943 - DNA, 206 bp, Homo sapiens
gcgccactctcggagtgtcaccggtagcctcttttggcttgcgggtcacgcagaagaggcccgagtaggtctagatcatccaggtgccgtaccgatccttgaggttgtgctgcaccgcggctgcatgcatgcaggtctgcatggccatgtcctctatttcgtcgtgcttgggtggatcctggtggatcacctggtcctccttcacg

SEQ ID NO: 691944 - DNA, 343 bp, Homo sapiens
  misc_feature (314)..(314): n is a, c, g, or t
  misc_feature (321)..(321): n is a, c, g, or t
gtgtgtgagtgtgtgtggaggaggcgaggccttagatcacttcttgagctcgtcgtacaggacagcacgaaggcgccccccatgccccgcaggacgttggaccacgcacccttgaagaaggccttgcccccctcatctctgacagatcttccgtccaactagtcgtacggtgcccagtgtacatgactgtcagctcctgttgcgcccgagactgcatcatcatgctgccgccgcaccgctgtcgaagcgggtaggacaccacgcctggccacggaccgtcacggctctgcgcgatcatccacgctcaccacgangacgaantacgaccacgacgtaattccgg

SEQ ID NO: 691945 - DNA, 101 bp, Homo sapiens
tagctcaaagaggcagagaaagagctgcacgagaagtttgaccgtctgaagaaactgcaccaggacgagaagaagaaactggaggataagaagaaatccct

SEQ ID NO: 691946 - DNA, 1249 bp, Homo sapiens
  misc_feature (1249)..(1249): n is a, c, g, or t
atttttgttttttttttggcatcccgatctggggttaatccaacccaattcttccactctacacaacaatagtacaaacacaaggtcatctaaaaggctacaaaggtgataaaactcaaaagagaaatttaataggtactggagctggtgacaatggaaacgcaaaaaagaaaaaaaataaaagcaatggtacattgtggccaagataacctggaaggaccaccaggaacggcaggcacaaccaggggctgggcgtgagaaggactcccgcaagagggggctcctcccactccattccgccaatttccagagtacacaggggagggggtgtggcggggtggtggctcggggcccggacagacaagaaccaggaagcaggaactaccaggggtgtgagaaggaactcttgggagggggttggtgacccttgggagaatcagaaagagaggccctcgagagaaggccgagggccaaacgaggggttggggcagcgtgcgacaaaaagccggggggccaaacctccctattccaaaagggaccatctggcccaggcaaacacgcaagtgggcacgggctcgggccaaccaatccccagggtcactcggggggaagggggaaactcgtggtggttccccaggtaacgcagggggacaaaccaaaccgccaaagaagccctcacgttataccccgggggtgggcctctgcccactgtgaagcgtggccctcctttagaaaccggggtaaacgcggagtgaagctttctaacccgagaaaaaccgcggggggaccttggacggggcccacacagggcgcccaaaccaaagagcacctttttggaagccgggggccccggtttgacaaaaagggttagctacctgagtcgcctagaaaattctggccagaagtcaaggggatgcgtccccaatgggggtcccttgtggggaaaaaaaggtgcacaactgggccgggggggggtaaaacaacaggggggcaaaacactacatagggccagtacacggaggaatggaacaggaaagacccctattacgagggacgcggaccaaaaatcttcagaaagaatgacatgagaagggacccacaaggggagaggaacaagagggggagcaccacgagtaaacggtgacaaaacagggaggagaaaaatacaagagcacgtatacaaacagataaaaataggaacaaatgaaaccactattctctttcttgtctttttttcttctttttttgn

SEQ ID NO: 691947 - DNA, 160 bp, Homo sapiens
aactacactacacataataatatatctttaaaaatctataactagcacgaagcccttatacaagcctccaacaggatagagacagatacgagtacacagctccagaagacaaactagattaataacgctagttctagacccaactaggacaagaagcagc

SEQ ID NO: 691948 - DNA, 202 bp, Homo sapiens
  misc_feature (19)..(19): n is a, c, g, or t
  misc_feature (95)..(95): n is a, c, g, or t
  misc_feature (182)..(182): n is a, c, g, or t
ccgggaaggatccagccanaggatgccacgccagcccagggttaccaggttgcccaaggggggggggcttgggaaaagccctacacggggcagcncctaggatggggcaaaaacttgttgcatttttgtccccagcaaagggtacatgttacctccttcaattgataataaacctttttganatgcagagggtccgggtcca

SEQ ID NO: 691949 - DNA, 235 bp, Homo sapiens
  misc_feature (110)..(110): n is a, c, g, or t
cttgtggaggaagaagggaagggaaaagatgcttcttgggaacagttaaagccgagccagccaaaatagaagctttccgagcttcactttccaagctagtgggatgtctnatgctcatatgatgcttattggcacgtgctgcacagcagtccacaccagctccagtggtacgcacgtcaatactgccacagacaggctgggtgggtttgtcgatcgaagagaggagctgcaacct

SEQ ID NO: 691950 - DNA, 509 bp, Homo sapiens
  misc_feature (187)..(187): n is a, c, g, or t
  misc_feature (504)..(504): n is a, c, g, or t
aaagatgtttgttttaacaggtcatgtactacgttgttgttttcatttctgttataagtaaaactaaaagcacagaatggtgggaaaggggctataatgtggttcattaataatgttagcagcttttttctagccctcctgagtggcagtattgacctgcctttatctgtaaattatatagttaaanctttggctttttcatatacctagtggtgcgttatcataatagcactgttacataaaataagcccctaccttcttactttgtggtttgttgaaaaaatacaatggtgctcttaaaagtgataaaatgagtgtttatgaatgggtgtaattaggaaatacttctcatttgacagctacaaataaataagtttggaggtattttcactctatatgaataaatatttttccataaaatagttgtgattatatttttgttttatataggtccccaatcatacatataaaatacatattttaaattaataaaagaatgtattnttagg

SEQ ID NO: 691951 - DNA, 1546 bp, Homo sapiens
  misc_feature (17)..(17): n is a, c, g, or t
  misc_feature (855)..(855): n is a, c, g, or t
gggtgctgctaccgtgngcgtggtttgttgcccctccgccgctcgtgggcgaggtcaccacgagtgggctgtttctacagcagatggtgttgtgtcgcgcatccaatcacgtattttttgttcgttgggtgggtggtccacaccgctcgcgcccagagcggtagatccagacaaacgttgtgggtgctaatttccccggcggggggggggacctaacatccccctgtgatcaccttatttcccggtcgctggcccagcaggaagggggcttttcttggaaaccgcccgcttttgtgtttgccacaggaggaacaactttctcttgggggagcaccgaacacaaggacggatgggtcgtgggcggccacacacacattgattgctgcgtgggtagtacgccgcggttgtccgtcttcgctgaaaccagaaggcccccaaggaattgtccttgggcttcccgtccttggtaggagaagaaggtgtcctcctctcgcccttgggggggaaaaatttccggtacagtagccttttttgaacggggagcacgtaaaaccgtttggtccccacggaaaaatttgtttggcccgttccgcgttatgatccacgcctgatacttgcccctcggagcgggaggttggcgtatatacttgctccccggaggggccccccgccgcagaggggggggatccccctccccgggcggtgtgagcccccgcgggggcccacaggtagacttttccacatctctcgagagagttggaggttttttttttggagaggatgtttcacgcccaccctcggtgcacacgcttggtgagagattttgtgggccgcttccacacgtcttactgtggncgttatcccccgtgccacgtgtttgcagcaccctcgggcgcctctgtggggagccacccttcgaggggaaaacactctccccccccgctgtgttgtgtgttcacacacggagatctgtcgccgctgggagacactccactttgttcacgcgggccaatagggcaacccctctgtcggtcacacgtttaccgcagaggctcgtgctttctcacaagagaaagggggaaccccccacacagattgtagagattagagagcgcctctatagagcacacacactgtatagtttataagagagttggaaactgtgataattggggacgccaccgcacgtgtatattcaccccacccactatagggcactcgagttaaccacaagcacacctctttccctcttcccccgcaggtgatgtttgcggaaaccccctcttttcccttcacagctctggcttaagaatgttcccaaatttatagagaaaggcttataaggcggcctaccacgagaaaaagggaaaaaggccaccacaaagttcccttctcacactttcacgtataaaaaataaattaaacacgcacgccgccaaccacaaatataaaatggaaattaaaagagaaccacacaatgaaataaaatatttgtgttgtgcagccatttaaaaaaatccaaaattacaattataaagtggagcca

SEQ ID NO: 691952 - DNA, 221 bp, Homo sapiens
agctctctctgatgggcacaagatcactacaggctggtggcttctgaacagcacgcatttatttcctagcttctgtgggtgcaggagtccaggcacaggacactcaacctagggtctcataaaggctgctattcagcggtgtttggctagggctgggttctcatcaggagacttgactcagcggatccacatccaggctcttctagagtggggacagaatt

SEQ ID NO: 691953 - DNA, 287 bp, Homo sapiens
gatccgcaacgagttgttcaccgcttcggtggccgcgcgccttcctgaacgatcgccggatccgcgtgagcaagcgcacccagatcgaggagtcgctgatcggaaccggctttcccttccgcatgatttcgcagatcgacgactacctcaagatgctgcggccagtgatggagaaggctgcgggcttgcgacgatccggcctgcgcgctcgacatggcctacaccgctgccggacgcttcgacgggttcttcgagatcgggctcaagcgtgggacgtcgcgtcgacg

SEQ ID NO: 691954 - DNA, 957 bp, Homo sapiens
tctagcatcaccagtattagaggcaccgtctgcccagtgacacagtgttaagcaggccgggtaccctaaccgtgcaccggtagcataatccacttgtaccttaaatagggacctgatatgaatggctccacttgagggttcagcatgactcttactttgaaccagtgaaatagacctgcccgtgaagaggcgggcataacacagcaagacgagaagaccctatggagctttaattggattgatatgcaaacagtacctgaacaaagccacaggtcctaaaatgaccagaatctgcattaagaaatttgcggttggggcgacctcggagcagaacccaagactccgagcagttacatgctaagacttcacgcagtcaaagcgaactactatactcaattgatccaataacttgaccaacggaacaagttaccctagggataacagcgcaatcctattctagagtccatatcaacaatagggttaacgacctcgatgtggatcaggacatcccaatggtgcatgccgctattagaaggttcgtttgtcaacgattagagtcctacgtgatctgagttcagaccggagtaatccaggtcggattctatctacttcaaattcctccctgtacgaaaagggacggcgaagaaatagacgtctacttcacggacgcgccttcccccgtaaaatgactatcattctccaactaaagtattatacccaagaaccaggccaagaaacgggtttgtacaaaagctaggagcacaaccaacacaagcaacaaaaaacggggggggggacaaggaagtgccccacgggaggcacaagacgcggcaccacctactgagacaggggccccaagaggggcgcaaaaaagaagacgacgcgcgtcaaacagtcaaagaaaaggcacacggatttggagagcctcccgtggggcatggggacacacaaaacatg

SEQ ID NO: 691955 - DNA, 338 bp, Homo sapiens
gtgtgacataggacatgaacatgatggaggccgggcagtagttggctcacgccgtgtcatcgcaacaattgagaggccgggatgggcagatcacttgaggtccggagttcgagaccagcctgaccaacatggcgaaaccccatctctactaaaaatacaaaattagccaggcatggtgcgcacgcctgtaatcccagctactgaggaggctgaggcaggagaattgcttgaacccgggaggtggaggtagcagtgagcctagatcgcactattgcactccagcctgggcaagagcgaaactccgtcttaaacaaaacaaaacaacattcttcagcacg

SEQ ID NO: 691956 - DNA, 175 bp, Homo sapiens
  misc_feature (22)..(22): n is a, c, g, or t
ggaaagaaagaaagccaagagngattaagaagaagaaaaaaggaagccaaagaaaaataagcaagagcagatgcaaaccacgcattccatccggctgggcctggccctcaacttctccgtgttctactgtgagatccagaatgcacctgagccagcctgcctcttagccaaacaa

SEQ ID NO: 691957 - DNA, 170 bp, Homo sapiens
cgggcctgttcctcttccgccgtgctcagttttcttttgcctgcagcagcactccccatggctggccctgcttgcctttcttgtgcatctttctgggtcaggggttgtgctcgctgcttcacttggcggccgtcagtgggcttctggtgggggcatcctctcagcgtcgc

SEQ ID NO: 691958 - DNA, 234 bp, Homo sapiens
acgacagggcgactccatctcaaaaaaaaaaaaaggaaaggaaaaagaaaagaaaggtttacccctaacctgggggaaccttgtttaacttagtgttaggcaaaaagagcagagaaaaccttattaaaccccacggtctccagaaaaaaaccagaaccccaggttatgcaaacaaagttctagtgtaaacggttcccctcgggattatgggacttcacgggatgactttttgtt

SEQ ID NO: 691959 - DNA, 457 bp, Homo sapiens
agaacatgcgaggcgaaataacgcagaataaagaaaacgaatcttagccaccgtcctatcacacagcggtggccattcattatgctttgtgaaatttcttccttaagagggtttttcatccataacggtgcattttccacatactgacattcctacttgcgtcacgacttcaacatccttattttaaaactcggtttcacatttttgaaaaacggtttttgtgattttcgtcgttttgattgaaataatgcaaacgttttctggaatgttctgtgttcctgtaaaactccagtgcacaattcattaactcgtgatccaaagacagctgtcaccgtgttctcttatgagggcaggagctgtggtctgtgtgtgtgtgtttcagtcttttgtcctcagtacctgcaaggacacttagaatttactgggtgcctaataaacattgtgaaataaagtaaaa

SEQ ID NO: 691960 - DNA, 252 bp, Homo sapiens
  misc_feature (9)..(9): n is a, c, g, or t
gtggcaggncacgggcgggagggggtgtcggctggaccatggcaggacagaaaagcgggagagaacatatccaagaaagacctacgaggactctgagcgcagggtgagcaggaagtacacccggttcccagtcaggactttttgcttgcccatcgctgagggagagctctcagataggaccgactggggcaggctgctagggcagcatgtggtctgcagtggggtacgggggcctgaggccgtcggtgtagg

SEQ ID NO: 691961 - DNA, 132 bp, Homo sapiens
tgtgatctagaggatgcgtgtagtggggtgagctgggattctagagatcggttgtgatatgtggaagttcatttccgtatgtggattagctgtacgagtagtgttcaatgtgtccataggatgtgtatactc

SEQ ID NO: 691962 - DNA, 896 bp, Homo sapiens
gtttttcagtcgggcgctgagtggttttcggatcatgtctggtggtccgggattataacagcgagaacatgggggggccagagggaatggaccccgatggttgttatccgagagcactggaagtgagaattgtccgataacttttgatgaatattgcatttacaggagtctctccttcgtggatctatgcttacgggtttggggaaaggctttcggtaattcagagagagctaattattccctggtatttacagggtatgaatggtgattgggtcaagctcagtcaggtactgggaatgacaggcacatttggctattttcaattcctggcaccagttggggaatgaggttccagtgagacccaagcactaggtattgggcccaacagagaacttgggtcaaaaggattccaaaagggtattctgggccttgggagactatatgtgggaggcattggtaatgtcctggcttggtgggacaaatggtccgaatggaatggaaaatggagggtgtaggaccaatattgttgttggacaccggaaaatgtttggtattgtttaacagaagatactttttccaaatggtcaaatgtggttgctgaagaaattaatgttgagcctgtggtttacgggtccaattattggaatttcagaattaaaacaaggatcaggttgggtgggttctggcccactgcactggtttgttgcttgcccaacaatctgaagtccgtgcgtcgtgcaacggaaattccttgaaagtcacaggtttactgtgaacggaaggagtgtcattgtgtgacaccacgggatcacagcggagggaacacaaaattttgtagcaggtaacgagtacatggaatgattcacatttttttttttttattttggagacagaag

SEQ ID NO: 691963 - DNA, 283 bp, Homo sapiens
cattgctgtccgttatctcatcctttgcaacgccttaacatacatatgcatccttttcttctcggaccgagggctgattcctgtaaatatctccttcctggtcaagcgaaaatgggaatcttggtagcttctctttgtcaactaaggaatattgtgcaccgtgatcattccaccgcacctaagtcattttgatgggtgaggatcagttgagctttccaccatctccacaggttttggtgctttccaaatattctctgtcactataatatccacagatttggta

SEQ ID NO: 691964 - DNA, 93 bp, Homo sapiens
gcctcctcttcgcgcggccggaagcgcaggactggctcacggccgtccaggtaggcggccagtgctcttcgcgctcctgctagccgcggtcgc

SEQ ID NO: 691965 - DNA, 397 bp, Homo sapiens
  misc_feature (191)..(191): n is a, c, g, or t
ccaggtgcccaggtgggtctcgaactccggacctcaggtgatctggcccgcctcggcctcccaaagggctggggataacggggtatgagccaccgggtccagcctagcaacatttttttttttttttaagtaataagctatatccctagggcaatttggggaaactatatagcggaaaatattatagcggnaaggtcaattcaagggggatgggggcaaccttatatctagttactctaaaaatgctaagcgggtgtcccctataaggggtcttaagagtaattggggaatcccggtaaaccactattaagcgcttaattccttgcgcccacatggggtcgcccgtggggcttaaagacgccaagacaggcaaggctctttctctttcacatctggg

SEQ ID NO: 691966 - DNA, 812 bp, Homo sapiens
  misc_feature (422)..(422): n is a, c, g, or t
gccaagaggaaacggcgtggaggctttgcagttcaggcgaagaagccaataaagaaacgaaatatgatgcggagccgccagctaagcggcacgccacaggcagaggaggtggacggaagaagagagggaccggatcccaggccccgtttgcgagggaagagtggaatcaatagaggaaccggattcgtcactcttttcttccagaggaaatagaatcttagaacaatgacatttaatgcaggacttgagaatgttgatgcctcagttctaagagcagactatcgtacaaactggagtcgtaaaggatacagctattttgtgacttaaccgagggtttgtgaaatgacagaatctgtaagtatgactgcagtctattttgaatgctaggggagataccaacgaggcagtctcttatcattgtnggcgttttgcaaagagttcgaccgtctcacaggacgcatcgtgcgtaagattcgcatatggttcgaataatcattcatcacccctctggttgaacttgaacgattggacctcggaaaacggggttgtgagaaagggattgcctcggggccctcgtttcttaggtacgttcttggaagcacttaactttatgtgaatggaactttaccgcacatttatgcttgtgttttagaacaggaacactgctctacattgtgctagcaatcgtttttaggttaacgaccaagcgggattattcagtgcccggaaaaaggccaaaaccccattaggtggggaacgcaccgtggttttgaccttttccaacacaatattgggaatacttagggactatg

SEQ ID NO: 691967 - DNA, 168 bp, Homo sapiens
tgaacgtgagccaccagtcactgttcagtcattgccaccgacagctcttcagccgcctcttccggctcctcccctgaagtctctcccgcgctgtcgtggtccagcgcacttgctgtccctccgcattctactctgcatctgctgtccaggacggtcggtctcgctagc

SEQ ID NO: 691968 - DNA, 205 bp, Homo sapiens
ttagcgaaaaacgcgcggacatcgccgatctcgccactgaactcgtgtatgacatcctgaactccttatccgccctgccgctttgcgtgcagcggtatgggcgaagggtaggtgtgcgcgccgataagcgccaccgcggagctgattctgtcgccggcgccatccggcagccaggcaacgtcgctgccttccaccgcgcggaggg

SEQ ID NO: 691969 - DNA, 173 bp, Homo sapiens
acgtatagtgtcaagtcactgcatacatgaactggtgtatacatttagtatacatagtatcctcctcgtgtataacccacatgggaaacaagagtacaggcaacagtgaggcatgttacttacaaatacacttatccgttacccagctgtaaagtccacacaacatgtctgaa

SEQ ID NO: 691970 - DNA, 160 bp, Homo sapiens
tccgaggattccaagcttacgaggtggggctgtcatctgtggtgcagtccttctggccccctggctgtcagtgtcgctccaggccttgacaagcagctcattcaagcggcccaccatgaccctgggtcgtcaccaagtccagcagcaatcatggcgttct

SEQ ID NO: 691971 - DNA, 129 bp, Homo sapiens
ggtagagcaggggggtctccctagagcgccagcagtgccctggaactccgtgagtctaagaaggccacagctgtatcccacgcgccatgactccccggagaccgagcatgaatgggcgcaaacgagagc

SEQ ID NO: 691972 - DNA, 520 bp, Homo sapiens
ggcccggggttgcgttgacccgctttggggcacaaggtatgttcgcccctttttgatgcccgaaaccatggccaaagccgccgaacccaaggctccgcagagtttcgaggccgcgatggccgagctcgaaggccttgtggcttccatggaaggcggccagctcaccctggaggcgtcgctcgccgcttacaagcgcggcgcggaactgttgaagtactgccaggccgcgctcgaggatgcgcagcagcagatcaaggtcctcgaaggcgacacgctggcagactggtccggtgcagacgataccgagtgacttcgccggctggatgcaggcccaccaggcccgcatcgaagccgcgctggaacgtgtcctgcccgcggccgatatcgccccgcagcggctgcatgaggccatgcgctacgccgtgctgggcggcggcaagcgcatccggccgttgcttgcctacgccggtggggaggcgaccggagccccggtcgacgcggtggaccgcatcgcggccgc

SEQ ID NO: 691973 - DNA, 224 bp, Homo sapiens
agaggtgggacacggtgaacatagctgctgctgtgtagagcaagttcaaaaataagccagactccccgagagtctggtcaccatagcaacggtgggagttgttctgcagaagcctcctcactgaaaggcccggtggccaccaccttcttcctcccctccctgaggaatcaagtcccaccagcaccaggaggagcctctggtgtcttcacacatgcacatgctgt

SEQ ID NO: 691974 - DNA, 777 bp, Homo sapiens
cgggatcgcgcacgtgccggaggcccatgccgaccgcaggcgccgtatccgcgctcgtctagcaggcccggttacgcggttgcacgtcggccccagccctgaggagccggacagatgtggaaacttgcgtgcccgccgcgggaccccgggcaggaaggagagaccatacagaactttttgactggcgtggcagtacagatagtgggcaaggaaaaacgtgtgccattctgattgcaagaatgagtcaggtcgaatcaggccgagagagtcagtggctagtgtataaacgtggcgtaaacttgttagcgttgtaagcgcatagccttgggtataggagaaaaaacagtagtagggaacaatattacgtacacagagagagaaggtacgaagttgtatactacaggtacaaagagcaggaagtgaaaattcccatggtagtttgaacagtttagagacagaataaagttgctatagagtcatgggatacaccgtatttggtagtacagttggacgggtagagacaaagaatggctaggaacagttgggcgatttttagcgcccgaagacgttatatggcacaaggttcagagggcgggaaatgggggttaattataacgttgtgtgtggtgaaagatggttaatggggcgaaggattaaaaattttccaagaaaagttaagaaggttactggacgccacccttgtttgggattatgacgagattgggcttcttattccataggatatattaaggaaatgggttcttccatgtttagaac

SEQ ID NO: 691975 - DNA, 190 bp, Homo sapiens
cttcggtttagtttgtttcaactttttgtaacaaactatatggatgcttgcttctggcctcgtagttcgtggcaattacgtcttgaagaatagcctttataaacagttgtttggactcctgtcgccaatattattatgaggcatctgacagtcagaagtgcctgatttagaggacttgcgattgataggg

SEQ ID NO: 691976 - DNA, 188 bp, Homo sapiens
ctgctaaaccaaccacggactgacaaccccacgggtaccttttcacgaccaaactactactaacgccaccattacgtacgtacctgacgctgacttacgacactcattgccactattactgactacaacacggctacttacctacctaacgaccacactacacgacacccacttacgtatctcaccca

SEQ ID NO: 691977 - DNA, 212 bp, Homo sapiens
cctgctgctgagtatcgtcgtgatgctgcgcgaagacaatgccgatctccgacgtgactggacacaggccgtgaactcggctggtggacgacgtgcgttgggcgcgtcacagcgagaagctggagcgaatcgaacgcgaacgtcagcgcctgcgcgacatctggatgcaccctgaatgctaggaacgtcgaacaggtcaatgctgctgttga

SEQ ID NO: 691978 - DNA, 131 bp, Homo sapiens
gctatgtgactcaccatgagtttcctctgtgcttctgcctgcccatggcattgttcaccatctttctgggtctaacactgtgcgcgagttgggggctcgatgaaagcctgcctgtacgcgggttgttgcct

SEQ ID NO: 691979 - DNA, 295 bp, Homo sapiens
tgcgatggcgggaacactatgcaaacggggcaaaatgaatgtatggcgtgtatcttccttactgggagacagagtttcactctgtcgcccaggctgccgtgcaacagcatgatctcggctcacagcaacctccagcgtcctgggttcaagcgattctccgcgcctcagcctcccgagtagtacgattacaggcacccaccatcatgcccagctaattttagtattattgtacagacagggtttcaccatgttggccaggttggcctcgacctcctgacctcaggtgatctgcctg

SEQ ID NO: 691980 - DNA, 267 bp, Homo sapiens
gatcctatatatgctgtctcataaacccagttggcaaatattcataggcctatatctagtcactctgggctggtggcagtgtttgtatttggtccacacatactttatgcccagggcacgccctggattaagagaaggttggtgccctaccagattgaaaatggccaataaatcatcaaggccaacatttggactgctaattggtacggcctgggattacataaggtggttcttgaacagcttcaggggtgagaccagcaatatcag

SEQ ID NO: 691981 - DNA, 578 bp, Homo sapiens
  misc_feature (406)..(406): n is a, c, g, or t
  misc_feature (418)..(418): n is a, c, g, or t
  misc_feature (431)..(431): n is a, c, g, or t
  misc_feature (487)..(487): n is a, c, g, or t
ctcatgcctttaatcctgaggcaggttgtatggactttgagaatattccatgctggggaaagagcataagctgacgtgttttgggaagagtgaatatattgcattaatcgcaaatgattgaataatttcactgttgaggtacagttctcaaaaacttaaattgacactatttttacattttgtctaatcacaaattatttttacttttttcatctaaattttgatttttcgtgtatttaacataataggaaccccattaataatcagtattattttgcctctttgcaaattctttctagagttaaaatttgtagtttagtgaaaattcacctatttggcacatatgtcccaggaagctttcctgctaactccgctgttgatcctgttgagttactcatttattcanctcacgctcatngagtgtgtgctanatgccaggcaaaatagggagctagctatgctgtgggctttctgttccctgcccttnggcaatcgtgtgtttgtgaatgttgcaggtggccggcacgcgacggctttaactgtcgatggaaaagtggtttcgtggggccaaggtgaac

SEQ ID NO: 691982 - DNA, 181 bp, Homo sapiens
tgtttaacttaatagtgtactactcaaccgtaatcggagaggtccgtacccttgaattgtctactccaattcttggcatctgtcaaattttaggtaaatacaacgaaagtgtcgacctcaaaaaaacctggaattgaactttatattctgttagttacgttacgaaggtatacaccggtca

SEQ ID NO: 691983 - DNA, 931 bp, Homo sapiens
  misc_feature (610)..(610): n is a, c, g, or t
  misc_feature (650)..(650): n is a, c, g, or t
  misc_feature (741)..(741): n is a, c, g, or t
  misc_feature (786)..(786): n is a, c, g, or t
  misc_feature (826)..(826): n is a, c, g, or t
  misc_feature (868)..(868): n is a, c, g, or t
  misc_feature (871)..(871): n is a, c, g, or t
  misc_feature (922)..(922): n is a, c, g, or t
ccctgcggtgggggccttcgacagtgagggccacccgctcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccagcagtggccggtgtccagctgcctactttctgcccggatctctggctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggcaagtacgtcaagagcctgccacgtggcccaaccaccgcccaggagccctgtgccagccccctgcctgtcccaaaccagcccgcctccttccagcccctggagacctcgcccgccaccagtgcctccacgccccagcccgcccgcagcccctgccctgngccccctgcccgaccggcccccagcctgggaccctgtgancatccctccagccagccctccatccgactttgtggtgaacagccccccgtgatcccccctgcccggaggcccagcccgccactccctgggnacggggcccgaaggggagcccggcccgtccctcccccccagcccnccccctcccgcgaaccgccagccccagtaacctcttgcgngtcccgcccggggtggggacgtcccgcccccctgccccgccntcnccctgcccccggcccctgccccatcaaacccggcccctgccggccgccctnccaacccca

SEQ ID NO: 691984 - DNA, 334 bp, Homo sapiens
ttagatatgattcataaagcaaatcataaggcaaaatatacaacaaaagagtggagctatcaaacgacacataaggcactgaaagagctccactgggctaaccatgaacagcctgagcaacaaaatcagtaacaattgttctggattattattcacagtaaaaaccactgctaacatttttgagtccttactggtctaaatggccaaataaacgagaagaagcataacttccatctggagatattccatatgatactttagattctcccccttccaggaggttgagattaatttccctcccctttagagtgggttgtgtgtggtgacttacttc

SEQ ID NO: 691985 - DNA, 268 bp, Homo sapiens
acgagccggcaccttactaccccacgatcactgtgtcttgataagttgccgactaggataaaagatctaacttaggaaaaaaatctatcatacgtcactttataagatggttgcaccctgtgatatgccagttataagcagaaatgctgacacatttggccaaaggtttaaaagttgggagagggacattggacatgaatctgtgacttgaagaacaagttggtaaaataagtatcactaagctgctctcttcctttgacttttaatt

SEQ ID NO: 691986 - DNA, 839 bp, Homo sapiens
gacgtattgctggcgtgatgatatgggcggtaagcaggtgtgaagggaggacgtaagatatatgcttgtagagacaaaggtgtctgtgaagatttgtgtggtccaagatcttctattgatattgaagagtactcggatactgaggtacagaagttaccaggtactaactctggaagaaatggcaagacaagtgggtgaacggcaagaatgttttcatcaggaacaaggacatcagtattaaagaagccgtttagatactttccttaaaggcaagagtgactgagggtatttttcctctttgggaaaagcggttgagatgaggatggttgtggcggaccggggaccacagtgtagtggtggtggaaatcagtgaacttgggatacaagaattttttagaagagcagaatctttcttactcagaagaaccaatcaccgaaattcctggaaccaaagtatttaagagttcttgcggggaacatttcataggtactgttgcagtatttcgatcttcccaggacaaatatgtgggcaaaattgggccattgactttggatagaggagcattgagttgtgccatcaatgccaaggtgatcgcaaaatgctatgcgggattacaaattgtgtttccctccctgcgaacaacagttcacgaatctccctggtgtgttctttctttatgatccaataacactccaggtcaccattttttgtttcccatgtctgaaattgaagtggtgcggcacaatatgcgccatacgtgtcttgacaggtgagtttgagaacgaccaacactgggaaggctgcgtttgaaaagtttctttcacacagagtgcatcta

SEQ ID NO: 691987 - DNA, 459 bp, Homo sapiens
  misc_feature (74)..(74): n is a, c, g, or t
  misc_feature (100)..(100): n is a, c, g, or t
tctagaggacctagagagacagaaggtcacacgtcacataccgattcatggtcactcctccactgtcaatgtgntttgagggatcagcacagactgtgancatacgaacaaaggccgggcctgacagagctttcataaagaaaggtcgagttggttcccagagctctggattgtttgttaaatatgatgcctttctcatgcataccgatgcactgcagcccaagtttgctgccgaatcgagagctgtaatgattgtgcttcattatgtggaacatacttgaggacttgctgataatgagtgtttcctctccagagatccagactcgcatgaattctccatacacccggttgtagtagttgcaggcactgccgatccccatccacaggaatctgccgtgggagatgaggggtccaattcccatgcagtagccaggacctggtattgaggatgtgccctca

SEQ ID NO: 691988 - DNA, 1855 bp, Homo sapiens
  misc_feature (1)..(1): n is a, c, g, or t
  misc_feature (16)..(16): n is a, c, g, or t
  misc_feature (330)..(330): n is a, c, g, or t
  misc_feature (648)..(648): n is a, c, g, or t
  misc_feature (703)..(703): n is a, c, g, or t
  misc_feature (945)..(945): n is a, c, g, or t
  misc_feature (948)..(948): n is a, c, g, or t
  misc_feature (1097)..(1097): n is a, c, g, or t
  misc_feature (1100)..(1100): n is a, c, g, or t
  misc_feature (1286)..(1286): n is a, c, g, or t
  misc_feature (1289)..(1289): n is a, c, g, or t
  misc_feature (1371)..(1371): n is a, c, g, or t
  misc_feature (1433)..(1433): n is a, c, g, or t
  misc_feature (1483)..(1483): n is a, c, g, or t
  misc_feature (1703)..(1703): n is a, c, g, or t
  misc_feature (1716)..(1716): n is a, c, g, or t
  misc_feature (1753)..(1753): n is a, c, g, or t
ncagtgcggctctcgngcttctcctctgctgcagtgcgtgttcgttcctaccacgaagagatggggggggtgtatagtgtagtggcctctcttgtcgtccctctgtgttggcccgcccgagattagggtagaatactggtggggtgtgctcccaccacacacccgacgccgggtgttgtggggccggccacgcactcgatgggtccgctcacccacgtacgctcaagcggttctcctcccgcgcgggtgtagtttagaatcagtcttgtgttgctcgcgatagatcttgctcccccctcctgtcggggcccccttctgtctggggagtgntgtaaaagatcttctttttctcctgctcgtgcgagggagcacacccataattatggcgggctgctgcttctcacaaaaaatggtctccccaaggagagacgaggaggtggtttgcgcgttctacaccaggaggagagtggttgtttctctcctgctcctgttggggagccgatacaacgcgtttgtgtcgttgtggggggtgcgcacacgcccccgcacagaaatagtgtggtgcgccccgcccccccccactactggggagaacctcacaacccttgggggcggtgtgtctaccaccttgggccttttcacataggntgtgtaggttgttattctcccccctgggggagccgccaccgttctccctacaggngccgccctactagtttttattggcgcctcccccgcgcccttataatgcccccccccttggtgatttttggggaggtttgggccacaacaccccacaccgggcgtttcacacaacatttgggcacacaaacgcaccacaagtggtttttggctctggagaactctctgatgaaaggggagaaaagaggagttttgttgattgtcgcccccccctcgttgtctcgtggggtgataaaaaataanagnctctgcgaggagagagtattggcgccgcgcgtcaacaaggagtaggttctctcggagaaagtattctctgtgtgtgataagagtctcggcccatccctctgtggtgtgagagtataataaggggtgttctctctctcgcgacacacagnccncccacacacgagtggtgttgtggtgtttgaagaagagagcctcttttctctctcagagacttcattagccgcccccctcctctttggggttgtcccgcttctgttgtgggccgctgctgttcctgcggtgaggagagtagtgagagaccacacacacaacacaagcgtttgcttcgcgcgttgtgnggngtgtgtctactactctcacagagcgcacacgtggtgagcacacacagaaagagagcgctgctgttctgctgctgagagactnctgtgcaccaaacagggtggtctctccaccacacagggtgctgctgtcccccacagcaaganaaggcgtctcacgagagagggctataaagtgagaatatattatattcccntcataatatcctcgcccacaccgcacactctctctataatccacagcttggtgtggagaagagaccgcggttctccacgagacactctgtgttgtttgccacattgggccacactttaaagtgttatagtatagtataaagagactggttataatgagtaaccacacatgcactctgtaaacccctcacagagaaggagaaaggagagaaatgtttttgntggagcccccttnggttttctttttttgcgtgtggcacacgttttaaagnttattagattttttaaatcccgtacttttttatgggacaccaccttgaccccaaatttgtccccaggattttgagaccccctttaaaaagtttaatggagga

SEQ ID NO: 691989 - DNA, 530 bp, Homo sapiens
tcaagtggtaaccgcattccatgaaaagtgggcctgtaaaatacaactctcatttaatattcatgcttttgtgcctttaagaaaatattttttgtcatttttggtgttacagaactataatgtgattcaaggtgtttataggcttgtcataaaagggtcatttctgtgtgttactttctttttatatagctatagtatatttagaacaataaatactatcgttttataggggttcgtcttatttacctatttctttacctcagaccattgactgctagacctgtgtccacattattctgagtatggttaaacagtggcctttttcgatgcgaatcaccaacctttttgggcctggtccaccctggtggcccaaaattacagaacaaaattttggtgggaaggggcaggcttctaaacctttgttcccttgggaacccgtgcaacattttaatttccctgggtttccagcaacatcttcttacgcgaaaaacccaaaattggtattacacaatctccattttttccagtgg

SEQ ID NO: 691990 - DNA, 990 bp, Homo sapiens
  misc_feature (87)..(87): n is a, c, g, or t
  misc_feature (96)..(96): n is a, c, g, or t
  misc_feature (103)..(103): n is a, c, g, or t
  misc_feature (118)..(118): n is a, c, g, or t
  misc_feature (127)..(127): n is a, c, g, or t
  misc_feature (292)..(292): n is a, c, g, or t
  misc_feature (340)..(340): n is a, c, g, or t
  misc_feature (366)..(366): n is a, c, g, or t
  misc_feature (458)..(458): n is a, c, g, or t
  misc_feature (462)..(462): n is a, c, g, or t
  misc_feature (509)..(509): n is a, c, g, or t
  misc_feature (511)..(511): n is a, c, g, or t
  misc_feature (549)..(549): n is a, c, g, or t
  misc_feature (553)..(553): n is a, c, g, or t
  misc_feature (559)..(559): n is a, c, g, or t
  misc_feature (595)..(595): n is a, c, g, or t
  misc_feature (607)..(607): n is a, c, g, or t
  misc_feature (635)..(635): n is a, c, g, or t
  misc_feature (645)..(645): n is a, c, g, or t
  misc_feature (649)..(649): n is a, c, g, or t
  misc_feature (655)..(655): n is a, c, g, or t
  misc_feature (661)..(662): n is a, c, g, or t
  misc_feature (671)..(671): n is a, c, g, or t
  misc_feature (673)..(673): n is a, c, g, or t
  misc_feature (679)..(679): n is a, c, g, or t
  misc_feature (708)..(708): n is a, c, g, or t
  misc_feature (733)..(734): n is a, c, g, or t
  misc_feature (742)..(742): n is a, c, g, or t
  misc_feature (753)..(754): n is a, c, g, or t
  misc_feature (756)..(756): n is a, c, g, or t
  misc_feature (788)..(788): n is a, c, g, or t
  misc_feature (798)..(798): n is a, c, g, or t
  misc_feature (802)..(803): n is a, c, g, or t
  misc_feature (805)..(806): n is a, c, g, or t
  misc_feature (809)..(809): n is a, c, g, or t
  misc_feature (822)..(822): n is a, c, g, or t
  misc_feature (827)..(829): n is a, c, g, or t
  misc_feature (857)..(857): n is a, c, g, or t
  misc_feature (902)..(902): n is a, c, g, or t
  misc_feature (913)..(913): n is a, c, g, or t
  misc_feature (953)..(953): n is a, c, g, or t
ccatggcggcgccccgcagccgtcacccacctcatctttgacatggacggacttcttctggatactgaacggctgtattcagtggtntttcaaganatatgtnatcgctatgacaagnatacagctnggatgtaaagtccctggttatgggtaagaaggcattagaggcggcacagattataatagacgtcttgcagctcccgatgtccaaagaggagctgtggaagaaagccaaacgaagttaaaggaagtgttccccacggctgcgctcatgccaggggcggagaaactnatcatccacctgcggaaacatgcatcccctttgcacttggcaccagcncggggtcccgccgtctgttcgactantgaatgccaacgcccgccacaaaggccgttccttcacgcatttgttgttcccaacactttgtagctcggagaagatcgaacccccgaaagtngcangcatagcgcaaagctcagtaccccgtgtacattctttcccttagctntngttgctcaaagtagagtttcttcttccccccctacctngctnattggnagaaagttgctctttgttctttttgagagaattgcntccccaaaatgngggggtgggaaggcagggcccctaggcnaagcttgggngatnagaaancgtagnnacataaggntncctganaccggaaaacttttgatgcccgaagattnttgaacaaacaaaagggccaacccnnggttggtngaatttacccnngncaggaatttaccagacccgagatagttttggntttttgcccncccnnanngantagaagaggggangggcnnncagttctttccgccccccaggcccactnctcataggttccacacttgcttgggggggaaaggggaaagggaantcagcaacttnttcaattcccaaacctggcgctgttgatttttagcctccntgagatttggagttttccatccccatgtttggtttgt

SEQ ID NO: 691991 - DNA, 346 bp, Homo sapiens
agtgtaaatacctgggacaaaaaaattaattattagaataatgatcatactagtttaagacatgtacaaaaagacaaaataaaatatcttgttgaaaatagaaatatcgtttttttttttttttttgggaaacggggtctggctctgtcacccaggctgagctacaggggcgtgatcttggctcattagggcctcaacctcccgagatcgggtggttcccccacctcagcctcccaagtagctagaataaaaggaaggcaccacattgcctgaatagttattaaaaaaactttgtagcaagggggtctcactgtgtcgcccaggttggtctcaaactcctggaatc

SEQ ID NO: 691992 - DNA, 562 bp, Homo sapiens
  misc_feature (87)..(87): n is a, c, g, or t
  misc_feature (96)..(96): n is a, c, g, or t
  misc_feature (103)..(103): n is a, c, g, or t
  misc_feature (118)..(118): n is a, c, g, or t
  misc_feature (127)..(127): n is a, c, g, or t
  misc_feature (292)..(292): n is a, c, g, or t
  misc_feature (340)..(340): n is a, c, g, or t
ccatggcggcgccccgcagccgtcacccacctcatctttgacatggacggacttcttctggatactgaacggctgtattcagtggtntttcaaganatatgtnatcgctatgacaagnatacagctnggatgtaaagtccctggttatgggtaagaaggcattagaggcggcacagattataatagacgtcttgcagctcccgatgtccaaagaggagctgtggaagaaagccaaacgaagttaaaggaagtgttccccacggctgcgctcatgccaggggcggagaaactnatcatccacctgcggaaacatgcatcccctttgcacttggcaccagcncgggggtgcgcgtcgttcgatatgagcaaagccgcacaaagagttcttcagcttgtttttccacatggtgctcggagatgaccccgcagtgcagcattggcacagcagaccccgacatctttctaggtgtgccacgagggtctctcccctcctcctattgagagtgcctcttctttgaagagctccacttgggtgaggcggccctgcacctcggatacacgt

SEQ ID NO: 691993 - DNA, 869 bp, Homo sapiens
ctcccgggcagcgagggctgtgaaagaagttgtaggcatgcataccacagaatcaaaaaatgaacactttggaggatgaaaacttccaaacatctacatagctcctcagagtctcattgatcctaagtaatactgtcgacatgatacgcaaactaatagactgtctttatcagatacagaaagacaataaacaccacagtacaatataaggcagacataacgattgtcttggtcctcgttaagaggcagtattgcaatgtcaattattaacatacagatggcagtacattactgtatcgtcgcatgatggctcgcttatgcaccatggtcaatactttaggactctgtaaagctctccgctggtgcgacaacttctcatttagcggcttggtgtccagttcattctcttgtcatagttgcccattgattggtgcggacacaccagattctctctagcaaaacctgcacttaggagaatagcgcttattaggtagcgcctgctccacatttcgctaagcctcgttctctttgggggactgtttaacttaggcatggttgtttcccgaattaaggaaattgatgtcccaggtgtccatcaaaatagtaagcacttgtttccacttggttgccttatagccacgattcgtgtcctttcccaaaatgtatgtacaagaaaggccagtctgcgcgcttgaacgcagtggtatttcccttagagtaataaggaaggcatttgggcgccttgggcgcatctcggcatcccaaaccatgcgcctatctgcaaagcgcctagttctcgataggcgtcaaggtatatgtattccacgaattctgggcttggtaagggtaccaaattggcccgttcatgg

SEQ ID NO: 691994 - DNA, 102 bp, Homo sapiens
gcttgggcttttcacccgagacgttttacattctttaaatatgtttgtaatttgagtggtctgcacactccagatttggtttggaaagggaaactttataaa

SEQ ID NO: 691995 - DNA, 423 bp, Homo sapiens
  misc_feature (71)..(71): n is a, c, g, or t
  misc_feature (198)..(198): n is a, c, g, or t
  misc_feature (224)..(224): n is a, c, g, or t
  misc_feature (327)..(327): n is a, c, g, or t
  misc_feature (393)..(393): n is a, c, g, or t
  misc_feature (398)..(398): n is a, c, g, or t
  misc_feature (400)..(400): n is a, c, g, or t
  misc_feature (418)..(418): n is a, c, g, or t
  misc_feature (420)..(420): n is a, c, g, or t
  misc_feature (423)..(423): n is a, c, g, or t
atggtttaacattttgcaagtttttgaaaatttttggtaaagtttttgtttgtttgtttttgaagacggantctttgtttgtcgccctgggtagagtgcagtggcgtgatctcggctcactgccacctctgcctcctgggttcaggtgattctcctgccgcagcctcctgagtagctgggactacatgcacgtgcagncagacctggccaacatggtaaaaccncgcgtctgctaaaagtacaaaaattagctgggcatggtggtgcgcgcctgtaatcctactcgggaggttgacacaggagaatcgcttgaaccgcatcccccanccccctctgggaggcggaggttgcagtgtgctgagatcgagccactgcagtccgcttctgccacangggtngnctctgtctcaaaaaacantntcn

SEQ ID NO: 691996 - DNA, 462 bp, Homo sapiens
tggccaacatggtgaaacccgtcttcactagaaagcacaaaaattagccgggtgtggtggcaggcatctgtaatcccagctacttgggaggctgagagcaggagaacttgcttgaacccgggggcagaggttgcagtgagccaaatattgtgccactgcatctccagcctgggcacagagtgaaactccatctcataataaataaactaaaatatacaataaaataaaaagttacaatataaaatatacagtaggccagtcatggtggctcatgcctgtaatctctagcattttgggaggctgaggtgggaggactgcttgtagcccaggagataaagaccagcctaggcaacatagtgagacccctatctctacatagaataaaaataagaaatgaaaaagattgcttaagcccaggacattgagtttgcagtgagctgtctaacccagtgtactgctcag

SEQ ID NO: 691997 - DNA, 469 bp, Homo sapiens
tcccttttggggtctttgctgatgcaagattagttcaacgtatacaaaaccaataaatatgattcatctcctaaacagaactaaaataaaccacatgaacatctcaacagatgcagaaatggctttcaataaaattcagcatcctttcatgttaaaaatcctcaacaagcaaggcattgaagaaacatacatcaaaataacaagagccatctatgacaaacccacagccaacatcatactgaatgggcaaatgctggaagcattgcccttgagaaacagaacaagacaagggtgaccactctcagcactcctattcaacatagcactggacatcctagccagaacagtcaggcaagagaaagaaataaaaggtacccaaacaggaaaagaggaagtcacactatctctatctgcaatctgtttctatacctagaaaaccccatagtttctgcctagcagctcctagatc

SEQ ID NO: 691998 - DNA, 405 bp, Homo sapiens
tttggaaaaggaagaagagagaaaatatgattttttgttaaacatggtggattcaatcaggcagggatccctattacatccataacctttgtttcaaaaaacaaaaaaaaaaagctttggccaggggcagggggtcacgtttgtaatcccagccctatgaggggttgagacagggggatcccttggggtcaggggttcgagaccagcctgcccaacatggtgaaaccccatttttattaaaaaataccaaaaaattggccaggggtggtggtgggggcctgtaatcccagctacttaggggggtaaggcaggagaatcccttgaacccgggggggggggattgcagtgagccgagtttgggcccctgcactccagcctcaggggcagaacaagattccttttcca

SEQ ID NO: 691999 - DNA, 468 bp, Homo sapiens
atctagaggatgcccccggaatagatggatctcgtggactttagatgacattattctctgaggactattgtggataacaagatgtgggtgaaagccatcctgcattcctgaccacaatatctctgtactcgtgtaggcactttcatgttcgcctcacgctgatacgcaatcgcttgtgaaccaggctggtctcttctgtcgtcaatgaatatcctttggctggcagtcactcctgtaacagatgtctgtatgtaggttgtcccattggctgttaatgcatccatgaacggagatgtacctttcccgttaacagctaagcctgtggccatggctgcagtcacagggccgggcacctgaggcactagtgggtgtatcctgggcctgctccccatcctggccctctcggcaccggggcccaataaagctccgagcggcttttccgctgccacttcgggtgccactgtgtcc

SEQ ID NO: 692000 - DNA, 381 bp, Homo sapiens
gcagagtgccagccccagggccaatagaggcctgtgtcctactaacactacttcttactcctaaggctccaacaaccacacgctatggaacactcaacccaggtcaacttgtcagagacatgtgaaccagagcagctccatcttgaatgggggctgggtaaagtgaggctgagacctgccgggctgcattcccaggaggttaggcattcttagtcccaggatgagataggaggtcgcacaagatacaggtcatgaagaccttgctgataaagcagtttgcagtaaagaagccggccaaagcccacccccaaggtggccacgagagtgacctctgattgtgctcacggctcattatatgctaattagtgcattagctgctgg

SEQ ID NO: 692001 - DNA, 119 bp, Homo sapiens
ctagcacacctgggacccagcacaaccttcatgcacaacctgtgtgaccaacactaacctggtaccagcacaacctgttgccacaaagggacatgcacatacctggtgactcagcacaa

SEQ ID NO: 692002 - DNA, 130 bp, Homo sapiens
aagcttttaccgcaacacacacaaaaaaaaacacctcacacacacaggtaacagctcacacaatgcaacacatgcaacacacacaaaacactacacacactgcaacgcactcaaagcacctcacacgcaa

SEQ ID NO: 692003 - DNA, 702 bp, Homo sapiens
gttatttggttatttcattttatattccctttcccatagctttgtacacacctcatacttaaaaccaagtgagaggcctcttttcagatctggtttatttttggaatgcctgagtgtgtttccagattggggggggagaggtggtgttttactttttgacatgctcttagcatgttttgctagtcattctggatcttatgtttagaaattctgttgaacattcaatgatgtatttgaaatgagaaagtcctttatacacatagtgtgaatgtttgtggccaattcaattgtggaatcttatggcttcggtgctactttgtgtcgaagtttaacttccattgttcagattttaggtccatctagtgaaattgtgccatggtcttcgttaaacttggaccaattttgggaaatgaagatttatctgcgtctatttcattctagatcatcctttactaataatcattagttacagattcacattattcagagttatcctaactcttatgttgggaaattcttaaactgtgcttgattttatcgattctatctatcaattctcctttacgacactttccgtaattggataagttttataacagcgtgtttgattatcttcttaattgagctttcatccggctgtattaaatgcactgttcacctttaaatactttcatttcccatgtggattaatgggacaagctc

SEQ ID NO: 692004 - DNA, 180 bp, Homo sapiens
atttattgattagagaaacagaagcccaggcagggaagatgatctgtttaacggcatacagttagtcatagactggtccgctgctataatgtttctgatctctggtaccttagccacttcacctttttttttccaaatagtcatcagtgaatgataatgctttagctgatgggagcaaga

SEQ ID NO: 692005 - DNA, 505 bp, Homo sapiens
atgacgggggatttgactgaagagacaagaaattttctgagagcatcttatatagcaaatgcgacgcctcctttgcaggaatcattgcaaagacttccacttgcttctgctctatgtgtgtcttctgcaaaactagacggaatattctagcacagcgagacccaaatctctcctgaacgacggactccagagtggctgtgggtagggatgctaatgccttatggaggttgatgacatacattcctccaccactgtcgccagactttgcaacaaactctagtggatcatctgccagcagagtgagatactgatcaagaacttgcttagagatgttatagccaacaggtagggatctgaagatctcattggaagacaatggctgggtgaagggagcactagaggaagtggtaatctcactcattcggagcatggttcgcacaatctcgctgcttgtctggtccatcctgttagcaactgcgctcacaatggcttggtcaccgaagtg

SEQ ID NO: 692006 - DNA, 119 bp, Homo sapiens
tatcgaatgagctggtaccagacgtagtgttgtgctcgaagctgggagatcttcctctgaatgagtagaatagaaaagtttcataataggattagatttagtgaagccttgatggatag

SEQ ID NO: 692007 - DNA, 419 bp, Homo sapiens
  misc_feature (17)..(17): n is a, c, g, or t
  misc_feature (24)..(24): n is a, c, g, or t
  misc_feature (60)..(60): n is a, c, g, or t
  misc_feature (112)..(112): n is a, c, g, or t
  misc_feature (238)..(238): n is a, c, g, or t
  misc_feature (241)..(241): n is a, c, g, or t
  misc_feature (254)..(254): n is a, c, g, or t
  misc_feature (261)..(261): n is a, c, g, or t
  misc_feature (272)..(272): n is a, c, g, or t
  misc_feature (274)..(274): n is a, c, g, or t
taggtacaagagataanggtaatngtgacatggattggctctaactacagcttcagtggntggggggaggaaaagtcccaacccaatggggctcaaacttctagggggtatncttctcatccctttatctttctccctcgacatttcctccctctttcttccaaggaccccaaagccaggggcaacagattcagtaaagaagggtggtcagagataaaaccccggaagtatttttaantcntacctcaaaattnaccagtnacctgagagantnaccataatctagtccatggattcatggtatgtggtctgggataattggcacacctgggaatccggcttctaagggaattcaattgatgggaggaattttccaaacaccattttattggtgtgatatagccaatataattatctct

SEQ ID NO: 692008 - DNA, 127 bp, Homo sapiens
acggtctggtcgcttttttcgccgcattaaagtacgtttttgcgaaaccgatatgttcggacatttaaacaatacagttccatttgtttactttgaagaagttcggactgagtttttgaaagcactt

SEQ ID NO: 692009 - DNA, 298 bp, Homo sapiens
tatgatacgggtttcttgggtctgatgtacagtgtgagtaaatgcttgcagctcttagctctgttgtgatcgatgaagcacttttgtattagtatgttcctttgttaaaggaggaaccgtaactgtccatagctgtacatataacccttttctcctaagagaggagtcagtcaggtggctcctgtatttttcattttggtcagaagcgaggaagtagatgctttagaattgttagatgtatagatgaagcaaatagaggtgagtgttccacagtggtagcgatgtgctaacaagaaaa

SEQ ID NO: 692010 - DNA, 258 bp, Homo sapiens
tcactctaaggatctccccgggagccttaaccctataaataaaaaataaaagttatctggacatggtggtgtgtgcctgtactcccagctacccaagaggctgcagtggaggatcccttgggcccgggaggtagaggccacagtgagctatgatcacatcactgcactccagcctgggtgacagagtaagaccctgtctctaaaacagaaacccagaacttactggtgaaatggacggcgttaaggggctccccgggg

SEQ ID NO: 692011 - DNA, 266 bp, Homo sapiens
aaacaaaatccgggggggggttttttaaaggggggtttttcccccccttttcccctttccaatgggggggtccccgggtttaggaaacggggccccccccccccaaataaagggggttttttgttcccccaaaaggggaaaatttttttttcccccctttttgggggggggggggggcaattaaaaatttttttttttttctttttttggggggccccccgggggttttttttaaaggcccccccccccccggggggtttttggga

SEQ ID NO: 692012 - DNA, 760 bp, Homo sapiens
  misc_feature (667)..(667): n is a, c, g, or t
  misc_feature (731)..(731): n is a, c, g, or t
  misc_feature (746)..(746): n is a, c, g, or t
agaacaaagctggatggagaatgactttgacgagctgagagaagaaggcttcagacgatcaaattactctgagctacgggaggacattcaaaccaaaggcaaagaagttgaaaactttgaaaaaaatttagaagaacgtataactagaataaccaatacagagaagtgcttaaaggagctgatggagctgaaaaccaaggctcgagaactacgtgaagaaagcagaagcctcaggagccgatgcgatcaactggaagaaagggtgtcagcaatggaagacgaaatgaatgaagtgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcgggntctctcgggcagaaaacctacaaggcaagaaggagaattggggggccaaatattcaacaatccntaaagaaaaaggaantttcaacccaagaa

SEQ ID NO: 692013 - DNA, 679 bp, Homo sapiens
gtgggctatcactaaagattcaaaaagaaaagagtgatagagtcaacttgaaattttagacatatccctctggctataatatattgaagagggccaaatctggaggcagaagggttaggtgccattcgtacaatgcagacataagatgaaaaagacttaaactagaataatggcagcagaactcaagatagaggaataaattgaggacacagttatgagagatgaacaacagaaattgaagtaagatttagagagaggggggatgcaataaaattatgtcttggatcacctatgcagggaagacagaattgagaatcaatctgcatggggaaaaaaatgtgtttgcttttaaattgagttttggatgccttcagagttttatattacaggagaccaataggcaggtgttattggcagattttaagcttgtgaaagaaatctggcctacagctatagatgtggaattgtttggcatatagacagcggtagcaacccttgacaggggatgagattgtctccaagggagaatgcttaccgtaagagcagaaaatcacccaggaagacacctaagtaaaaccatcacgtaagcaacaagaagatattgagaacaaccaaaaggaaactgagaaggagaagatagagaaattggagaaaaccagaaagtacttgtcttcaaacc

SEQ ID NO: 692014 - DNA, 475 bp, Homo sapiens
ctcattctgttgatccatcatcagttgatgggcatctgggtggtttgcactttttggctgttgtcaggaatgctgctgtgaacgttgaggtgcaggtttttgtgtatgtattaattgcaggatcagggcaatggagtttttcacacatgaaatttgaggaaaggagggatgctcctgatttcattttcatagaaattgaaaatcacattgcagtaacgacagactaattgttgtaattatttttggatgtggattttgtataaatccccacatagatctggccacccccttcaggcctgatgtttgtttgattgaaactgtgttagctaaggcaaaaaaacttggtaattctggggagtccagggtcataaaaacaaaaaaatctaaatgaacttatgagacgatatcaaatttggagcttacttagtaataatctgactctataaggaaaaatacaaattttctttaggtctga

SEQ ID NO: 692015 - DNA, 231 bp, Homo sapiens
  misc_feature (45)..(45): n is a, c, g, or t
aaaaaaaaaaaaaaggggcccccccttttttggggttttttcccngttcccatttgcaaagagacccccccccccacccccaaattttttctttttttaaaaatttttaaagggagggggaaaaaggggcctttttttttttttttttaaaaaaaaccccccccgttttttttttttttttttatggttttttttaaaccgggggggttctttttttttttttgggcccca

SEQ ID NO: 692016 - DNA, 1097 bp, Homo sapiens
cggcccgccgctgttggagtgccggccgggtgatgggtgtgccaagaagttgtggggggggggaaattactttgtgcgtggagaaagggtgttgtctcggaaatagtgttgcgccgccgtcggtgttcgattcccccttcccccccgtgaaattcgttgggggaatgaccttttagtgtccttagtgttgggagccgttatgtgaacacgacaccgacggttggtggggaacagacgcgtgttgccgtccactaggtgtaaagaggtcgttatacaaacagatactatcaagtgaaaacattttataggaaaacaccccactggtgtaaaatgaagaggccccccacgttgccacgccccttggaaaaaacctttataaggtggccccgcccttaattagtaactcccattttttataggagacgcttttaatttggtcgcctactgtggaccgccactcggtgaaattgccagagatgtccccccctttgggcctcgtggtgagaggtggcgaagaatatattaagagctcgtgtgatttctcttgtgtgggcgccgctctataggagaatatgtctgcgccacctctgttgccatatgataatataccttctaccctcttcactctaaatgtaactcttctctggcacaaaatgtgtttctcgcctctaggcacctccacacttgcactcttctctttgcctctttttctcttcctcgtgtcactctattcgctcttataatttctcgagaggagccactatggagggcttagaaataatatttatctcttcttataaaaattcaccacaaaaatttggtaataggccacaacccactttctcttaaagattgtatggcccacaattttataaatgtttatttttccatatccaatttataatctcttgtccaccatcccaccttataagaagtttggttatatttccaagtgaaaattttctttcccagaagtaggtgtttttttccgtgggttggggggtaacactttactaccaaattagtaaagtatggtgcagaatttcaagccaatgaggagtgcccgccgtgtgataatttaaacatattttaaccca

SEQ ID NO: 692017 - DNA, 141 bp, Homo sapiens
aagtggcaggatcactggtatgaagtggactgctgcgggctgtcaggagcagatctgaagctgcactcaggtagagcctcagggaaagcgctcagaccagctccagccagcgcccaaagccccccggggctccagcagcca

SEQ ID NO: 692018 - DNA, 253 bp, Homo sapiens
accaagccgacccgccattctcctgcctcagcctccctagtggctgggacacaggcgcccaccaccacgcctggctaattttttgtatctttagtagagagggcgtttcaccatgttagccagcatggtttggatttcttgacctcgtgatccgcccgcgtcgggctcccaaagtgctgggattacaggcgtgagccaccatgcccggcctgatctaaggatttgatggcaaacatggcacgcgacatcgcca

SEQ ID NO: 692019 - DNA, 478 bp, Homo sapiens
  misc_feature (225)..(225): n is a, c, g, or t
  misc_feature (271)..(271): n is a, c, g, or t
  misc_feature (408)..(408): n is a, c, g, or t
catgagatttcgttttaaaagcctatcgggttattttagaagaaaagtcttagccaaattaatatcttttctattatgctttactttattgtggaaaacatatagttaaaataagggattccatttgttctaactgcttgtgagaacagtaacagttcttaagatatttgtagctaccaaatgaggttattgagctcagaaatatactacctttgagcaggcaanttctctgaaattaatggaaccatgaagttccaggattcttttcaanctttaatttatccttttaccattctccaacactcttatctcccaaggagacaagtagccccattaaattattgataaacaaacttaggagattcatgttacagtttttcatggatcgctactatgaaccactcaaanttcagctcactcagtaagtatcatcgaatatagtctaaatacgatatttacgtcgtgtataggatgttcg

SEQ ID NO: 692020 - DNA, 1198 bp, Homo sapiens
gactaactacctgacatccataccccatcacaatcatggcaagccaacgccacttatccagtgaaccacatatcacgaaaaaaactactacctctctatactaatctccctacaaatctccttaattataacatacacagccacagaactcatcatatttatatcttacatacgaaaccacacatatatccccaacattgagctatcatcacccgactgacagcaacacagaacagaacgcctgaacagcaggacacatacttcctatactacaccctagtaggctcccttcccctactcatcgacactaatttacactacacaaacaccctaggctcactaaccattctactacatcactctcactgcccaagaactatcaacctcctgagccaacaactataatatgactagcattacacaatagcttactatagtaaagatacctctttacggactccaccttatgactccctaaagcccatgtcgcatcccccatcgctgagtcaatagtacttgcctgaagtcctcttaacactaggcggctaaggactaataagcactcaaactcatactcaaacccctgactataccacatagacaaccacttccttgtacatagacctatgaggcatcatataacaagaaccatctgactacgacgaacgcgaacatacacaccgcatcatcgcatcccaacaaacagccgataagccatcgagacaccagccataacacataccaaccccggaagcacaacagggcacacaacgaaacacacgcaggaaactcccatacatattgcggaaaccaaaaaaacgacaccagaggagaaatccagatcgaggctcaaggatgcccaaatagtatggagagaacaacagaacctgaaacagctgatcgactaaccgttggaaccctgtgaaccgatagataaataacaaagaggaaataactcgactcatacattcaagggcaagtaacatccaaagagcacttagccggcaccgctccgtcctgagcaagacaccgcgccaagtgacagcaaatcaatcatagagaaactgtcaagagaaagagctaagaagcagagatctacaacataaacgagatcaaatgaaaaagagctggagcagatacggtgaagcgaagacaaatgtcgagataacgagacacagtagtaaggtgatgaaacgat

SEQ ID NO: 692021 - DNA, 245 bp, Homo sapiens
  misc_feature (222)..(222): n is a, c, g, or t
gggaggattgcaacctcgtgccattcccccacggggtttccatacgctgactgtctcgtgtctgggccacccaagcagctgggattacaggcatgtgccatcacgcccggctaatttttttgtatttcctgttttacgataaacgaagaaaaccacttggcggcgctttgtggccaagtgatttgtggccaagcgggctggctcattcgaaactcactggcnctcaagagtgtagttcaccaatt

SEQ ID NO: 692022 - DNA, 449 bp, Homo sapiens
tgagggagcgatacaccaagatcgtcgagattcccttcaactccaccaacaagtaccagctgtccatccacaagaaccccaacacggctgagccccggcacctgctggtgatgaaaggtgctccagaaaggatcctggaccgctgcagctccatcctcatccacggcaaggagcagcccctagacgaggagctgaaggacgcctttcagaacgcctacctggagctgggtggcctcggggaacgcgtgctgggtttctgccaccttttcctgccggacgagcagttccccgaaggcttccagtttgacaccgacgatgtgaatttccctctcgataatctctgcttcgttgggctcatctccatgattgacccaccgcgagcggccgtcccggatgccgtgggcaaatgtcgaagcgctggcattaaggtcatcatggtcaccggcgat

SEQ ID NO: 692023 - DNA, 311 bp, Homo sapiens
  misc_feature (219)..(219): n is a, c, g, or t
  misc_feature (255)..(255): n is a, c, g, or t
acgacgcgtcgacacgacacgctcgtcaccacctgatcatccggctaacgaagcggtgtccacggcgacggtcgtggacaccgcttcaccctgcccacttgacaatcgggcctacatatcagggcgaggacctgcccaccccgtccccgcgtgtcgagcagcggcccgagcgtccggccggtgttgcccagggcgaggtcggccggggctcggaagtanaggtgccggccgccggacggtgtggcgacggtccangtatcgggaatgccgccccgggcggcggggagcgcggctatgacctcggccccgtc

SEQ ID NO: 692024 - DNA, 335 bp, Homo sapiens
gaagtgcaaaacttcccaaagctttgactaagctaatgtgcactataaatcttaaagaaggcagcaaagtctatggaagcatccggatttatttaaccatacaatcatttcctctgggagcatttcataggacgtggagtagaaactctaatattatatcatgtatccaataatataatgtataactctccaaattatgctctagtgtagattataagtttggtcatattctacttctctaaaaatagttcaggtacaaagtctacgataattctctatttaccacaacaacggaccaaagtacccaccattcccaagaaacactagattaaaaa

SEQ ID NO: 692025 - DNA, 255 bp, Homo sapiens
cgaaggaatcgttagattgtggataagtttgcatagtgcaggtagaagtttagcctggaaaggtaggaggattcgttctagagtagcaagaggaaggctcacgcttggtacgagtgcaaggaggtaatttgaggaaaaggctcgttctgcaggcaatgcagggaattatggcctggcggtagaagagggtttctggttaatattgatgacgttagaccttaggtacgggaatacgcaacttagtggacatgggaa

SEQ ID NO: 692026 - DNA, 179 bp, Homo sapiens
ggtggcctttctcagtttttgaatagaacatctatttcaaattcatttttaagtatattttgtgaatataggattacaggttgacacttttttctttgaggaccttcagaatgcactcattatctctactccatcattctgttgacaagtgatttcagtgctattgttctctttgagag

SEQ ID NO: 692027 - DNA, 1466 bp, Homo sapiens
  misc_feature (243)..(243): n is a, c, g, or t
  misc_feature (482)..(482): n is a, c, g, or t
ggctccctgaaagacgctccctgcatggacttactcgccgaggacatgtcactgctgctgatgctaggggacccttgggacacccaagtccctggcttctgaagatttagtggagaaggtgttctccccaattgagtagtatatcacgttcctggtgacagaggcacgccatgtcgtcagcgtgtggatctgatctagcccgtcgtgtgactgagtggatccctgtcggtccacagggaagtnttcactcattgtacgcggcggagtccactggatctctggctcgatggctgcgtggatcgttcatgccttttgcagcgtacgctgtgtgagcttacgaaatgtgcagtacagagtgacccgttgctgcgatgaactgcaccgaacaggccattggcacgactggccaggagctattactgcttttcgtccacaggtctggtggactcacacaaacctatcccactgaaacctcccacggnctgcccttcgggatccctggagttgtcttagccaaacacatcacgtgtgttccggtgcctgacctgcgggagtgacagacgtacatgcggacagagagatcacacacaccttagatgcttgtcagttgacactgcaaccagtcgttgtttcggccgccctctccgacatctgagtcctttcacttcgttcaaacgggaccttggtgcaccctagttgacgcgaaccatgcggtacttgtggatagaccatggcgtccgaaatgtgcatgtttcaattcaaccgtccgtggtcaactgcttgaagactgccacacttgtaacgaacaagacctaccaggagcattgcctggggcagggccggtaggagtatgatcctttgagggccctaagggccttgccacgcaagaggctttctacttgggctcataccttgcggcggaacgtttgtacccagtcgttgggccccggcacgcgagttgctgcaaggtaagaacgtgcttgccaggaatcacattcctggaaaggaaagcccgtattacccaattcctgtccatgtgcctgagtgtgcggagggggccccggtcagtgacaccacagggaaggggatcatcatgctgaaagccgggcggcctcacaggctattcccgcaatttcaacttgctgggcaagcacgctgtggaggagccccctttggctgtcggcactcgcggggtggaccgcccccttcgggcagggcagtgatacggccctgcagaggccccttttcagcccacctgtagtcggctcgcgttgtttgtccgggacggggcccctgagcggggttccttccccaagggttgtgtcccacggttagggagacttggcgtgcgccttttggtgccggagttaccccctgtcttctcgcgggtggaccgggggctttactgccgcgcgctaggtagtgggatccccgcgacgcaggtctgtgagtgctggcagctttga

SEQ ID NO: 692028 - DNA, 782 bp, Homo sapiens
gcctgaaaactttgcgatgggattttccctgcaactagatgaatcagctgcatgtttcacggacttgctgtgctgcttgtgtatgttcgtatataggtttaataagtctattgcggaacgacctactcctgtgtgaatctttgcgaagtactgctaccggtgaagaaatattcaactgtatcaacagttttatgcagaaacatgacacattgaatgggcaacacacatgtgttgcatgttcggtagtgcatgcttctagggcagtggcatgggcacaattgccgaagctgtcaccttactacaaatatgtggctcccgacagcaccagtagtcactgcctattatacagacatgcactggccagttaacataatgcctacatctctaacacaatgtgctagaccaggcagtacaaatcatcaaattatatcaaagctcgagcacatcaatccagactactcacacacattaactgtgaggacacctgggtgctccagtatcacagcaccttcttctacatacagacagtgaagtggcttactcgaggttaaaggtcctgggtcagactattggaactatcacgtgaactttgggattcccatggattctggtacccgactatctgactagtaaccaaattcatcttgggcctgctaacgacttgccgtatctggcggaatatttgtactaccattactgcagtacattggtccaatgccaggacacctgttgaccgttgtccggcattcgactacagtgtggcacatggtaacacactggac

SEQ ID NO: 692029 - DNA, 112 bp, Homo sapiens
actctctctctgtggggcggaaggcagcccctcaaagctggtgtttggcacagggacattgccagtgccatacaggggctgctatctggggctgttattttggagtcagtgc

SEQ ID NO: 692030 - DNA, 895 bp, Homo sapiens
taaaacagtaacacgcttaattcacttaattttcctggtataaaaaccctatgtggtagccacagttggagcctgagtccgttgcagggaaactcgggggtgggtctggacgagggggtcagtgaactccgtgatagggagactgggtgaatacggtctccttccagaggtcgggggtcaggtagcggtaggtctatagaaagggcatcaaagggggcctgggcgaagtcgcccaggtgggcagtgcagccccgggctgaggtgtagcagtcatcgataccagccatcatgagcagcttcttaggcacaggtgcggagacgatgccagtgccccggggtgcaggatgaggcgtaccagcacagagccgaggggcctggtcacctggcagggacagtggtgggggctggcgatctggtcccccagtagcctctggcgcacggtggacgatggagagctggtgcaggatgtgggccccacggatgggggtggccacctcctggggcatttaacacccagaccgaggggccctgtgtagtccccgatagcaaaaatggccttgatacctggtgcgctggccgggcaggggtctggtgtcgggactggataatcttcaaaacctcatccttgagaagaggcccccaggaagaatcgaggggatctctggatcccttaatgggccggagaaagaagatagatctcctcaaggaactttgaactcatgtccttgaccaagcgcgccattggtggcgggcttcaactcttaatcctcgggcttggccgggaagtcgggccgggccgggcctgcaaggcgggaaccgggtccgaaggcactgcgaactccggggacacggggtccccaccagggccaaggccgggcccggggcgggtccgatg

SEQ ID NO: 692031 - DNA, 216 bp, Homo sapiens
tgagcagctggagagtcaggtttggtttggggagggcacgcctcaggacaggaagcggtgtatagtatcagcgcacaagagctggactcgggtgagggcttggattcagctacccttccctacaagccgccccaggatcgtttcccctctgctgtgtctgtcctccttggagaggggaggcctgtggataggctggcaaggtcaaggcaggctcag

SEQ ID NO: 692032 - DNA, 127 bp, Homo sapiens
caaagggtactatcttaacagactagtgtctgctctacttcagagtagacttatgaataagctgatgaccaacttgagtagcactcacccccactttgtgacggtccatactgacccatctatgggg

SEQ ID NO: 692033 - DNA, 430 bp, Homo sapiens
  misc_feature (16)..(16): n is a, c, g, or t
tcagctcggtaccagntgctactccacaaacagctaattttgtatcttagagagacaggattcgccatgttgcccaggatggtttcaatctcttgacctcgtgatctgcccacctggcctcccaaagtgctgggattacaagtgtgagccactgcgcctgacccctagttccttaagttctaaagtcaggttattgttctgagatcttctttttgaacgtaggcatttatagctataagtttccctctaagcactgctcttactgcaccctgcaagttttgctatgttgtattttcgtttgcatttatctcaaagtatttcctaatttcccttttgatgtcttagactcattaattgttaagaatatgttgtttaatttttacgtatctgtgaattttccagcttttcttctgtttgtggaggtagcact

SEQ ID NO: 692034 - DNA, 296 bp, Homo sapiens
gtggtgcacagctggtgggagagtgatgcacagggtgaagggacgagactgagttccagtactgcggcaacggcgacagttgggaggacattccataagatatcttgttgatcaaaccatcgtgcacactttctttgcccatcagcaggactagcgtcttgtcagccttggtgacagtaacattgaagtgtagggtgcccaccgatgctcttgggacgaaggatccatgctaaataccccatcgctgcagcactgagtcccggatcaccgaagcatttctggcccccaagtgtaag

SEQ ID NO: 692035 - DNA, 247 bp, Homo sapiens
ggaatttgaggctgtggtaagctgattgcaccattgcactccagcctggcagataagggaagactctacctcaaaagaaagaaagaaaaaaaaaaaaaaaaaagtagccgggcttggtagcaattgcctgtttacctatagctactgggagaggctgagggcaacgggagggatccctttagcccaggagttccaaggggtgtggtgaacatattgagtgggtgccagggaatctccagatgggggc

SEQ ID NO: 692036 - DNA, 103 bp, Homo sapiens
cttgacctctcatgggaggtagtgcttttcttatacgtaacatggtgaaggtgggagtggtagtgagttttaaggtgtgggtggatacgagcgtggtataagt

SEQ ID NO: 692037 - DNA, 195 bp, Homo sapiens
gaaatctttttaactaccttgctatttatctgctaacagtttgaagttttaggagtgggtacatatagacatatatacctagccagaggacagtgtttctgccagtctatctatttgatttggactaccagcagagttgccacctgaggtgtatactacttggggattcgtgcacgttaacgattactaggacta

SEQ ID NO: 692038 - DNA, 283 bp, Homo sapiens
actgatgaggtgagctggaggaacaatagtcaggatgccctggacattgatgatgctctgttttgtgctcacaaaacagccatgtaacacatgagcggggagttgaagccatccagtcgcaagtcgagcagacagcagttgatggaattcttagtagaaattcagtaagggtgcccaaattttattttttttttcaccgtatactctaccaatatatggtatttaggaaaacttctttgatcgggggcacaaagaaaagcacacacatttttataatcatctg

SEQ ID NO: 692039 - DNA, 395 bp, Homo sapiens
cagaaaccgccactgctacacatcttatggaatgactcacgagttctccttcactgattaatccttttcctcatcccttcctccccctcccatctgccctaagaacaaagagcttgtaaaccagtaaatttggcagagctcaagagctctgggccgtgagcaagcctccgatattctggtcccctgaacccgccttttaaatgcttattctgtctctttctaactcctatgtctccaccagactcagggtacccactgggtggttgtggggctggtttccctaacattccccaccaaataaagcagctccaaccttctaggatggttgcttcagctcaggaagtcttaggaggaaattcttgatgcctttcctcacatttggttttgttcgggca

SEQ ID NO: 692040 - DNA, 900 bp, Homo sapiens
  misc_feature (444)..(444): n is a, c, g, or t
gcaaagcctgagttctgtgctaactctctccccggacagtatgagcttcagcattcgctcgcaccttctccaccaagctaccggatccctgaggtctctgtctcacatgccgacccagactaccggtattccctgcccgcggcagtcgagtcgcgtggccagtcggtctaatgcaaggccgcgtgggtggctctggttcctcgggatctcccgtgtgcccagttcctcgcagcttcacacggacgcggttcatgcgggtcactgggtgcctggagcatcgctggtgattacgcccggggtggtctcggcgattgcaattgggcatcgctagtcctgcaacgcacgcaagtgagaccgtgcaggcgccctggagcggagcggatctgtgccgttcttacgctgtgcacagagtgagaggatgggcctggacgatgcgtagagaanccgcgcagggttgtgacgtacgcaaatatgccgggatgcagctctgggaggaacaggaaggggatgcccacgtgttcaaggacgtacctgggtagccctgtgaactgtcatagagatcaatgcagaaggatcgcttgagagggccttcgggaatcctttcaacagaattactggtgagaccgatgacccgcatcgttgctgcacgcaattggacggatgcccgatgcttgcgatgctcggatgcacgttgtggaaagtcaacgttatgaagaacagcagctgtgcgatgtcagccagtcttgtggcagagacagacatccgatgggctcttgcaaggttttattggatgaccaccaataattccaataatggggagtggtgaccagaatcgaggttctccagggggaagtgcattatgaaaaagaaccccaagagggagtcaaggctaaaccgagt

SEQ ID NO: 692041 - DNA, 372 bp, Homo sapiens
gagtatgagtgcctgcttagttcaactaaaaaagctcctataaatgctcctgatgaagaaaactggaatgcctttgatctttgatcaggagatgatacagctgtgacaaatgggaattgacttctctgtctgtccatcatctctgggcaaacatgagaaaatcactttgtttcaggtggttatggcagttgcgacagtgaaccatgagaagggagacttgtttaaagaaactgggggagtgggtactctctatatacttccctaactaaagatgaagaaaattttttcatcaccttgatgaggctgattttactgcgtggctggcacattaagcttgagggccagctgcctgttctttcaaatatcttattg

SEQ ID NO: 692042 - DNA, 320 bp, Homo sapiens
ttcacacttggccacggttatcatgtccatccgcagcaatgctgcagagacaaggagcatgtgattgaggccctgcgtctagtgcccaggtacaagtttcctggtcgccagaagatccacatctcacagaagtggggcttcaccaagttcaatgctgatgaatttgaagacatggtggctgaaaaggcggtcatcccaaatggctgtggggtcaagtacatcccccgtcgtggccctctggacaagttgcgggacctgcactcataaggggttccaatgtgctgacccccctcttaatactcaccaataaattctacttc

SEQ ID NO: 692043 - DNA, 1049 bp, Homo sapiens
gtactgtgggccgcacatgtgatgccacgcagtcatttcgagacgacgtgtgatgacattagaaacatctataacaggatgcatagggatcagagttcgactttgaggaaatgaagggcagaaagactgatactactgatgagggaaaaataccactcttccctgtgatttctgtaatgcggacccctgtcagatttgggcagcgatacgcagtattatatgacatctcaatcatagtgtcatggcctggtttaaggtcatgtgcaaagtagtagtagaatgcaaagaggacctgggccagggaattgctccccattgacctggtgtctaaataatgttaccttggtttgcactgggagtgtgctattcagtccgtgtggcagcttacctacagttacatgtgtcataattttgtataacctgaaggaatggccttgagacccaaactccaagttgggctgttgagatattcgctcttggagtattacccgaagcaacaagatggactggcaaggatagaccatctcagagagacatcctgaaaatcccggggatagatcgagccgagagtctgattaactgcaaagagaaacgtggtgcaccatttgcagtgattgaatcatgtctcacctgataccatctggagagtaccaggtggataactatacatggtcttcttccacggatggggggtacatcaatccgtgaaagttttgcccgctagtacttggatagtgcgggactacctgcaacctgtgcatggaggagggccccaaggagaccgagggccgagttgggacaagcggaggatcaaatgctagcgccaaccccaaacatgagacggtattagggagaagccgggtagcggagttggacctacatcagttactaatagaaacggggcgaacacgacgatgagcggtacagaacaggacgcagagctcgaagcagaaatcagggggcacgcagaaccatatgacgtaggacaccaactcacccacgagccgaagcggcgaagaaaacatgggcgacgagaaacacaggctgag

SEQ ID NO: 692044 - DNA, 878 bp, Homo sapiens
  misc_feature (23)..(23): n is a, c, g, or t
  misc_feature (131)..(131): n is a, c, g, or t
  misc_feature (207)..(207): n is a, c, g, or t
  misc_feature (209)..(209): n is a, c, g, or t
  misc_feature (267)..(267): n is a, c, g, or t
  misc_feature (274)..(274): n is a, c, g, or t
  misc_feature (283)..(283): n is a, c, g, or t
  misc_feature (295)..(295): n is a, c, g, or t
  misc_feature (297)..(297): n is a, c, g, or t
  misc_feature (342)..(343): n is a, c, g, or t
  misc_feature (360)..(360): n is a, c, g, or t
  misc_feature (375)..(375): n is a, c, g, or t
  misc_feature (464)..(464): n is a, c, g, or t
  misc_feature (473)..(473): n is a, c, g, or t
  misc_feature (498)..(498): n is a, c, g, or t
  misc_feature (530)..(530): n is a, c, g, or t
  misc_feature (618)..(618): n is a, c, g, or t
  misc_feature (647)..(647): n is a, c, g, or t
  misc_feature (650)..(650): n is a, c, g, or t
  misc_feature (665)..(665): n is a, c, g, or t
  misc_feature (700)..(702): n is a, c, g, or t
  misc_feature (719)..(719): n is a, c, g, or t
  misc_feature (734)..(734): n is a, c, g, or t
  misc_feature (736)..(736): n is a, c, g, or t
  misc_feature (738)..(738): n is a, c, g, or t
  misc_feature (745)..(745): n is a, c, g, or t
  misc_feature (751)..(751): n is a, c, g, or t
  misc_feature (769)..(769): n is a, c, g, or t
  misc_feature (771)..(771): n is a, c, g, or t
  misc_feature (786)..(786): n is a, c, g, or t
  misc_feature (790)..(790): n is a, c, g, or t
  misc_feature (800)..(800): n is a, c, g, or t
  misc_feature (838)..(838): n is a, c, g, or t
tagttacaaatatggtatttaanaattttctactttatttcagtacaattttcaacgatacagtcgtactatttctcgaagatatttgaagacttgaaaacgataatagtgttctgatatgactactctgnaaatcagtaagagatttaagtaaaatgcttacattctctatttgaaaacaaaaatcaggtaaaaaaaatggtgggngnaagtactgctctgttgtaatcttactctcatatttattattcgcttttcttcgcttgngtctgtncttcttttnttcattattttncntggtctcttcttcatcttcaacaatcccatccccttggtatttgnnatgagttcatttaggtntgctacctgattttntgaagttaaagcgccctctgcgcacgttgaaaagtaccacgacctcttcctcttttggcccaataatccacaccatcatctctgttgtnatgataggntcctcgtggtcggctaactcctgcnaagcctgagtattctttcatttcatggtgagntttaaattcttcttctctttccttcttactctccttttcttctcgagaactgggagaagaaggtgatgctgaagaggatgaagatcgngaatgatcttgctctcttttatgtctacngtnatctttgtaagattngtattccttgtaatcttttggagtattttcctgcnnncttgatccactggattncctggagcccttggnancnccccganctttanttttttcttttctacggngnttaatgttatgccgnagtnagcagagtanacttaatttttatctccttttgatttcttctttaaaantctctcttccctgctaaacgggtatgcttctcagggtatt

SEQ ID NO: 692045 - DNA, 529 bp, Homo sapiens
  misc_feature (40)..(40): n is a, c, g, or t
gagacagagtttcattctgtcaccgaggctgtagtgcggnggcctcatcctactgagcagctgtggcagtagaatcagccgaacccactaggcattgttgaagattgaccaaatcacactaccgaacaaacagaggtgaaacagttcaattctcataccgcacggggttaaggatcaaaacacccccaaagacaacgaaagtattcttagctggccacgtcccttccccccctaaacccaaaccacgaagagctctatgtactcaaaccacccggaagggagaaagccactgtccaggccgaaaccggttaaccccaactctccttaatacacaagcacgttgcccgcccgtgctctcggggccctcttaagccaacatctaaagacggggatgcacgatactgcacgtcaccacggttggcgccccctgtaaaaaccctcaacccgactcaaagtcgccgatcaattcaccacagaactaacactctccctcaaatgagacccccaccccccctcacaaggaagctcg

SEQ ID NO: 692046 - DNA, 201 bp, Homo sapiens
catgcccctcagctttggtgtgaccccatatggttatgaatcccggtttgagatccactttgatgacaaatttgatgtgtcttttgggagagagggagagacaatgagtctaggctgtcgtgttgtcatcactcctgaaattaaacatttccagccagagatccagtggtacagaaacggagtacctctttctccatcaaa

SEQ ID NO: 692047 - DNA, 93 bp, Homo sapiens
acggccgtgtattactgtgcgattggtaattactatgatagtagtggttacggaattgactactggggccagggaaccctggtcaccgtctcc

SEQ ID NO: 692048 - DNA, 298 bp, Homo sapiens
  misc_feature (130)..(130): n is a, c, g, or t
  misc_feature (138)..(138): n is a, c, g, or t
  misc_feature (177)..(177): n is a, c, g, or t
  misc_feature (186)..(186): n is a, c, g, or t
  misc_feature (196)..(196): n is a, c, g, or t
  misc_feature (242)..(242): n is a, c, g, or t
  misc_feature (248)..(248): n is a, c, g, or t
  misc_feature (295)..(295): n is a, c, g, or t
agcagatgcaccttaacttcatggatgaaaaggatcggatcatcacagccttctacaacgaagcccgggcacgtagcggacaaacagaggcatccttcagcaggagcgacaacggctagggcagcggcancgccaccnatccgagccaacccaaggccccgagatcgtgccccgggncgccggccntgaagggtcnacctggatggggcctgcagtgcgttcccgctttgcttccttccctngacggnccggttccccgaaacgcgcggcaataaaagtgatttcggcagaaaanaaa

SEQ ID NO: 692049 - DNA, 976 bp, Homo sapiens
ttccgaagaaatgtcgccagtgccaaggccccccccttggaaggaggaggaaccccttggttcaaaatgccccaattcaacgatgtgaattgcaccacaaaatggaaaattttaagaaggggaagttgtgtttccaattgggaataaactgaaaccttcctgttgatgtagaaattccttttcctctgaaaagtttttctgcccccggctcacgttgcgaaataatttgcctgcgtttttgtaagtaaaaaaaccacacccacgctgttttcctttgggtaataaagactctgttggaagtttaccaatcgtgtcttttgctttttaaatttaatggtggaaatatccaccttagttataagtataacctctatatgttaataaacgcgcacacaagagatcttggttaaaatttttttgggaaaattacactagctcttgtcacaaagcactcccttaaacttgctaaaagaatgctatagtgtatagtatcgacccccttctcggaatttgggagaaggcccacatttaaatctttcttacaccggtgaattatatttaagaatattttaatagactctgatggaacttcccggcttatacaccccacgttcttgatggtatattgaaccacgagctgaaaaatattttaccacttacacacgggctaaaaggaggttcttcgtgtgttaaataactaccctcccttgtaacatcacctatatccccaaatcagttatttccaattgttaggagattttaccttttaaaatctcaaaaatggatattctcaatgttttctgtaattaaatgtattttcaatgagataggctgtttcttttttttgttgttaattgttgttgttgttatatccatacttttatctctaatgaaatgtagttgggttcttcctgtaatgcgctattatgtcttgggcttaataaaaatatttgtgaaattaaaaaaggaaaaaaaa

SEQ ID NO: 692050 - DNA, 894 bp, Homo sapiens
  misc_feature (7)..(7): n is a, c, g, or t
  misc_feature (61)..(61): n is a, c, g, or t
  misc_feature (63)..(63): n is a, c, g, or t
  misc_feature (80)..(80): n is a, c, g, or t
  misc_feature (103)..(103): n is a, c, g, or t
  misc_feature (111)..(112): n is a, c, g, or t
  misc_feature (115)..(115): n is a, c, g, or t
  misc_feature (129)..(129): n is a, c, g, or t
  misc_feature (145)..(145): n is a, c, g, or t
  misc_feature (171)..(171): n is a, c, g, or t
  misc_feature (196)..(196): n is a, c, g, or t
  misc_feature (292)..(292): n is a, c, g, or t
  misc_feature (420)..(420): n is a, c, g, or t
  misc_feature (438)..(438): n is a, c, g, or t
  misc_feature (478)..(478): n is a, c, g, or t
  misc_feature (484)..(484): n is a, c, g, or t
  misc_feature (729)..(729): n is a, c, g, or t
  misc_feature (754)..(754): n is a, c, g, or t
  misc_feature (813)..(813): n is a, c, g, or t
  misc_feature (844)..(844): n is a, c, g, or t
  misc_feature (854)..(854): n is a, c, g, or t
  misc_feature (880)..(881): n is a, c, g, or t
  misc_feature (890)..(890): n is a, c, g, or t
acgaggngctgcagaagtcgcgcatccgcatcaacagcctctctgcccagctcagccagcncnagaagcagctggcagcnaaggaggcgaagcttcgagaccnggagaacnnacnggcccgggagcggnacaccagccggcggcngctggcggaaaaggagcgggagatgncctatttttttttaaggatgcagcngcagctggacgagtaccaggagcttctggacatcaagctggcctggacatggagatccacgcctaccgcaagctcttggagggcgaggagggaggntacgcctgtcccccagccctacctcgcagcgcagccgtggccgtgcttcctctcactcatcccagacacagggtgggggcagcgtcaccaaaaagcgcaaactggagtccactgagagccgcagcagnatctcacagaacgcacgnactagcgggcgcgtggccgtggaggaggtggacgaggagngcaggnttgtccgctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaacnccactggggaagaagtggccatgcncaagctggtgcgctcagtgactgtggttgaggacgacgaggatgaggatggagatgacntgctccatcaccaccacgtgagtggtagccnccgctgagcngagcctgcactgggccacccagccanncctgggggnacct

SEQ ID NO: 692051 - DNA, 112 bp, Homo sapiens
tccccggtgttgagtagtgcatgaaagtgttgtgaagagcgaagacttttctgctcccagcttatatatgatctggcgtgacctaccccgttgccggaggtggcccatagtc

SEQ ID NO: 692052 - DNA, 543 bp, Homo sapiens
gataggcaaaaggtttttattgtatagagaggagttatctttgttcggagacaaaacccaggcctgggggggttggatttttctgcatcaccaggctctagggacaacaggggcacagtgaatattgagacccaaatggtgcctttttttgatttggatgtgatatttgacacaggcagggcaggaccaatgcttgcttcgaagtgtaggggatgatcactacagttcaggatattaatactttttgaagccgcgggcccatgacttgattatatgtatggggaaattgcatgggacagagcttctaggcccagactttaccatgaagccagtcctggaaagctagtggcgagggacaaacttgaccttttgtgcccaacaatgggcttgtgttggtacatgacaggaatatatcttgagtgctcccggcctaatgtggaggcatgatttactcatcaagacattttcagaccacagggtgatgctgataagtgagcccaacaactgggatgctctctattaacgaatgcatgttccgagctt

SEQ ID NO: 692053 - DNA, 931 bp, Homo sapiens
  misc_feature (7)..(7): n is a, c, g, or t
  misc_feature (61)..(61): n is a, c, g, or t
  misc_feature (63)..(63): n is a, c, g, or t
  misc_feature (80)..(80): n is a, c, g, or t
  misc_feature (103)..(103): n is a, c, g, or t
  misc_feature (111)..(112): n is a, c, g, or t
  misc_feature (115)..(115): n is a, c, g, or t
  misc_feature (129)..(129): n is a, c, g, or t
  misc_feature (145)..(145): n is a, c, g, or t
  misc_feature (171)..(171): n is a, c, g, or t
  misc_feature (196)..(196): n is a, c, g, or t
  misc_feature (292)..(292): n is a, c, g, or t
  misc_feature (766)..(766): n is a, c, g, or t
  misc_feature (791)..(791): n is a, c, g, or t
  misc_feature (850)..(850): n is a, c, g, or t
  misc_feature (881)..(881): n is a, c, g, or t
  misc_feature (891)..(891): n is a, c, g, or t
  misc_feature (917)..(918): n is a, c, g, or t
  misc_feature (927)..(927): n is a, c, g, or t
acgaggngctgcagaagtcgcgcatccgcatcaacagcctctctgcccagctcagccagcncnagaagcagctggcagcnaaggaggcgaagcttcgagaccnggagaacnnacnggcccgggagcggnacaccagccggcggcngctggcggaaaaggagcgggagatgncctatttttttttaaggatgcagcngcagctggacgagtaccaggagcttctggacatcaagctggcctggacatggagatccacgcctaccgcaagctcttggagggcgaggagggaggntacgcctgtcccccagccctacctcgcagcgcagccgtggccgtgcttcctctcactcatcccagacacagggtgggggcagcgtcaccaaaaagcgcaaactggagtccactgagagccgcagcaggcttcctcaccagtcaccgcatcgtcactagcgaggtcgcgatgtgcccgctgagtacgcgaagtgatgagattgtatggcacgcgcgtcaaggatattgctaccgagtctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaacnccactggggaagaagtggccatgcncaagctggtgcgctcagtgactgtggttgaggacgacgaggatgaggatggagatgacntgctccatcaccaccacgtgagtggtagccnccgctgagcngagcctgcactgggccacccagccanncctgggggnacct

SEQ ID NO: 692054 - DNA, 311 bp, Homo sapiens
  misc_feature (5)..(5): n is a, c, g, or t
ctgantatgctgtctcagcctcgcgagtagtcgtgatacaggcgccgccacatgtccggctaattatttgtatttttagtagagacggggtttcatcattgtggcctggctggtctcgaactcctgacctcgtgatccacccaccttggcctcccaatcttatttgctttacaagtcctgcttcagggttaccttccctgaccactgctgcctccctcccagcatttgccagggactgtcattgccttagtttattttttctgttttgtttttttttggtcgttttggttttttttggagacagcatatca

SEQ ID NO: 692055 - DNA, 207 bp, Homo sapiens
tctgaaaaagaaaaaaaattttaaaaggctgggcgcagggcctcatgcctataatcccagcactttgtttgggaggcaaggtggcaaatcacctgaggtcaggagttcgagaccagcctgaccaacatagtgaaaccctgtctttactaaaaatacaaaagaattaggtggatttggtggcacacttgtaatcccagtttgggaggc

SEQ ID NO: 692056 - DNA, 237 bp, Homo sapiens
ttccatcttaaaaaaaaaaagaattggccagaaaatagtttcaggttctaaattcagtagactaaccagcttcagaggtagttataggtttaggtttttttttttattttgaacctgtctttatttgtgaatacagttgaaattttcataagcatggtttgttattttaatttacatatacatcattcatttctcataaacaatttttttttcttttttgagacggagttttgctgt

SEQ ID NO: 692057 - DNA, 162 bp, Homo sapiens
ctggctgcgcgtgagcccataggatatatgtacactactgtggttgcctagaagactaattcatgaacgaataacagcaggatgagaaaaagagtcacgtgtgacctgctggaacaactacggttacaatcaccaacccctctagggctgagtcttagcaac

SEQ ID NO: 692058 - DNA, 613 bp, Homo sapiens
tggaatcccagcatttttatggagcgccccacatcggggaggggcggcaggggttcccaccggaacccaaagtagggttggtgcacttgctgagctcccagaatgcaaattagtaaaagctaaattcaaaagtaaaaggggctaatctccaaagagtacgataaaaacttatttggtatcaaatctggtgattaaaaaaaaaaaaaaaaaaaaaaaaaaaaaaaaaaaaaaaaaaaaaaaaaaaaaaaaaagagggggcggcgcgcgacactaaaaaaatcatctccccaccggggccgcccaaaaagctaacgcacgcgcagcacccgacgtttttcgtgagaacaaaaagaggggcgcccacaataaaggggagagcgcagtattattaaacgacgagcgagacagcggcgcccgctatatacacaaacagcagcagcaaggcgggaacaacacactgactaaccagacgaggacaccacattggtgggaagaagaacaccctaaacaaatgagggggggggaaacacaaatgtgggcgaaacaacaccctacaaaagagaaaataaaaccctagagaggacaaaaaaaaaacaatgcaaagggactaaaa

SEQ ID NO: 692059 - DNA, 344 bp, Homo sapiens
aacctgtaggctgaaggtcacagagagagacagtcatgagagaaagaaagagagagagagagataagtagtaaaggaaaaaacagtgtaccctattcctttaaaagccaggtaaatttaaaacctataattgataattgaaggtcttctccgtgacactgtaacactccaataccaccttgtccagtgtaaacaagggcatagcccaaaagcactgaggccactgacaactcgtagccttcctatcaaaaatccttaacccagtaacccgcagatggccctaatacattcaatctgtagcgacaactgttttgctaacacaagaaagtatgaggctattctgtt

SEQ ID NO: 692060 - DNA, 241 bp, Homo sapiens
caggcacattactgacaaagacatcctacgtctaccagagcgtgcactagcgatcctaaaataagctaaatctccgggcatgtgccccttggggcggaaggggcaggattgtgcagctgctttcgcattcctctgcctaaatttcattgagttgaattgtttccttcccaataggtgaccttaattactctcaaaatctttccaaaatagatatatttttaaattccttacaaatccttac

SEQ ID NO: 692061 - DNA, 527 bp, Homo sapiens
ggtactaccaggagttagaagaaatgcgtatctacgcagagtctcaaacgatttctactatcctgtcatatgtcccagaagtccttctgcttctcatactctattccgagaccctccagtatgtagtagaacgcaacagaaatccaatctagagctgctccggatgtccctgctgcccatcgaatcgtggctggagcccgtgcgcttcctcaggcagtatattcgccaacaagactgatgtatgacacctcgtgacagcgatgactatcacctcctaaaggaactagaggaagggatccaaacgcttatgaggaggctggaatacagaaggctggtgacttgggcaagatcctcaagcagacctacaggcgaagtttgacacaaactcgcaacaaccattacgcacttgtcaagaactacgggctgctctactgcttcaggaaggacatggaccaggtcgagacattcctgcgcatggtgcagtgccgttctgtgtagggcagcctgtggaattgataaacaccggg

SEQ ID NO: 692062 - DNA, 780 bp, Homo sapiens
  misc_feature (189)..(189): n is a, c, g, or t
  misc_feature (210)..(210): n is a, c, g, or t
  misc_feature (212)..(212): n is a, c, g, or t
  misc_feature (262)..(262): n is a, c, g, or t
  misc_feature (268)..(276): n is a, c, g, or t
  misc_feature (278)..(278): n is a, c, g, or t
  misc_feature (287)..(293): n is a, c, g, or t
  misc_feature (295)..(297): n is a, c, g, or t
  misc_feature (299)..(300): n is a, c, g, or t
  misc_feature (319)..(319): n is a, c, g, or t
  misc_feature (323)..(323): n is a, c, g, or t
  misc_feature (341)..(341): n is a, c, g, or t
  misc_feature (343)..(345): n is a, c, g, or t
  misc_feature (348)..(348): n is a, c, g, or t
  misc_feature (354)..(355): n is a, c, g, or t
  misc_feature (363)..(365): n is a, c, g, or t
  misc_feature (371)..(372): n is a, c, g, or t
  misc_feature (375)..(375): n is a, c, g, or t
  misc_feature (388)..(388): n is a, c, g, or t
  misc_feature (391)..(391): n is a, c, g, or t
  misc_feature (396)..(396): n is a, c, g, or t
  misc_feature (400)..(401): n is a, c, g, or t
  misc_feature (403)..(403): n is a, c, g, or t
  misc_feature (407)..(407): n is a, c, g, or t
  misc_feature (410)..(410): n is a, c, g, or t
  misc_feature (421)..(421): n is a, c, g, or t
  misc_feature (427)..(431): n is a, c, g, or t
  misc_feature (441)..(441): n is a, c, g, or t
  misc_feature (446)..(446): n is a, c, g, or t
  misc_feature (450)..(450): n is a, c, g, or t
  misc_feature (462)..(464): n is a, c, g, or t
  misc_feature (467)..(467): n is a, c, g, or t
  misc_feature (470)..(470): n is a, c, g, or t
  misc_feature (496)..(496): n is a, c, g, or t
  misc_feature (523)..(523): n is a, c, g, or t
  misc_feature (527)..(527): n is a, c, g, or t
  misc_feature (530)..(530): n is a, c, g, or t
  misc_feature (532)..(533): n is a, c, g, or t
  misc_feature (546)..(546): n is a, c, g, or t
  misc_feature (552)..(552): n is a, c, g, or t
  misc_feature (569)..(569): n is a, c, g, or t
  misc_feature (571)..(571): n is a, c, g, or t
  misc_feature (584)..(606): n is a, c, g, or t
  misc_feature (609)..(610): n is a, c, g, or t
  misc_feature (612)..(612): n is a, c, g, or t
  misc_feature (616)..(616): n is a, c, g, or t
  misc_feature (619)..(620): n is a, c, g, or t
  misc_feature (622)..(624): n is a, c, g, or t
  misc_feature (627)..(627): n is a, c, g, or t
  misc_feature (630)..(630): n is a, c, g, or t
  misc_feature (640)..(640): n is a, c, g, or t
  misc_feature (643)..(643): n is a, c, g, or t
  misc_feature (657)..(657): n is a, c, g, or t
  misc_feature (659)..(659): n is a, c, g, or t
  misc_feature (662)..(662): n is a, c, g, or t
  misc_feature (667)..(667): n is a, c, g, or t
  misc_feature (671)..(671): n is a, c, g, or t
  misc_feature (676)..(676): n is a, c, g, or t
  misc_feature (678)..(678): n is a, c, g, or t
  misc_feature (684)..(684): n is a, c, g, or t
  misc_feature (697)..(697): n is a, c, g, or t
  misc_feature (705)..(707): n is a, c, g, or t
  misc_feature (710)..(710): n is a, c, g, or t
  misc_feature (720)..(720): n is a, c, g, or t
  misc_feature (764)..(764): n is a, c, g, or t
agtcaggggtcggaataaattttagtatattttgtgggcaattcccagaaattaatggctatgagttcttttttgatcaactcaaactatgtcgaccccaagttccctccatgcgaggaatattcacagagcgattacctacccagcgaccactcgcccgggtactacgccggcggccagaggcgaganagcagcttccagccggagcgngncttcgggcggcgcgcggcgtgcaccgtgcagcgctacgcggcctgccggnaccctnnnnnnnnncntcctcctcnnnnnnntnnncnnccccctccacccccccttntttnccctctttctccttctcntnnnttntccttnnccctcctnnnttaacnnttncatctctactatnctntcatnatcnncncccnacnacctccctacncccaannnnncactacactncaacncatntcattcctcgtnnnaanagnccgtcgtctacccctggatgcgcaangttcacgtggggggggggggggggggntacnccngnnttttacccaagcnctctcnaaccgcctacacgcgcnanaaaaaaaaaaaannnnnnnnnnnnnnnnnnnnnnnccnntncctnacnntnnnccngangttttttatngcnacgcgttctttctntncgngcgcngatnttatntngttccnaaccggccatgangtggaaannnacncaagttgccnacaccagatcgctcggtggtgcgcagctcagccgaggcccctgncggccaatgaggcccc

SEQ ID NO: 692063 - DNA, 690 bp, Homo sapiens
  misc_feature (185)..(185): n is a, c, g, or t
gcccagccttcaggtgcctctcatgtccggagagtcctgtctgcctgtgtgaagatgcccacagatgcgtacctggtctgttatgacatgcacaacctctctgccatgtgtgctgcgtcatatcggcgcatctaccgtggacagccagtagaggagtgtccactcagtggggcctgctattcccntgagttcaaaggtcacatctgcagggtctccgcagtgacagcgattggctaagatgtgattggtttaaggatccgtcctctgcagtttcgctaaggccccctttgtgtgcatgggtcagtcgccatatgttccccccagagattgtgtctatatcctccttctagcagcgccttccccctgcagctactcttcgggtctggctctctgtaccctaaggcctagtatctttttctcttctatgggacatccgtaggtctacgcttgacttttttgaggtcttctcggcttgactacagttgtgctcatgattgtccttgcctttccggcttaattattttaaggggcgagtgccggctctgggtgggtggagtggctcatacctgtcctccccgctctttgggaggctacagtgggcagatcatctaaggccaggagttcaagacctgcctggccaacatggcaacacaccgtctataataaaaatataaaaattaaaaaaaaaaa

SEQ ID NO: 692064 - DNA, 1152 bp, Homo sapiens
  misc_feature (380)..(380): n is a, c, g, or t
  misc_feature (1152)..(1152): n is a, c, g, or t
gaatggcgagtgatggctgcggtggactcgctgatcagcggaatgggagcgttcatgagccgctgtgtccctcacagttccggagcccgtgtccgtgctctgtgccgatagggaacagtgcctacttttcctatttccgctgatatacctgatgtcccgccagtcggggtaccagcgtgcgtgctccgccctacggtggtccttactggtcgattcactggtgagatgtgacgtccgtgcgacgtgtcggtggtgcctggctaacatgaccaaagcctctctgggcgtgacttgacacccgcaggcacgccttacgaggacagggagtaattggggcgaccaagtagttgacttacacttgggcggatttacactcgctnccaaaatgaatagggccttttttcccttcgttccttgaatccgttcccctgtttgcccgttttgcacgggggtaatgaataccaacggcacgtggaacgcaatggaatgccgacggttaatggaacggaacaacgttaacccagtttcgccagaagggcgtatggcttatcctcggggcctagagggaaccgcccaaatttttgcctcttttggcgggagaaagggccaaaggcccgagaagagaatactgtttttttccaaaaacccaagggcatttctcccctctgggcccggtttccggtgttggcccagagccaatagccacagggagaaagtaaatcaaacagacgctcggaaaggcggtttctccccacaaaactagggaaatgggggccaccaaggcttggttccccgtttttggggaacaagcggttggcctttggctttcccaaggtcaaatatccggtgcggccttaggaatacgaagggttctcttctggggattccaagagccaggattcgcccttagaaccttgttctacacacggcaagattccaaagagagaaccttggaagcgccggacagttgtttcccctttggggaaaaggaggccgtttggtgataagagccttgtgccaaagagatcagggccttagggaagttctctttccccaacggaacttggacaccttttcgaagttttggggaaaattacgcttttttaagattcacttaatttccctttttaaggttttccgggaccgaaaagn

SEQ ID NO: 692065 - DNA, 106 bp, Homo sapiens
gtaacgacagatgaatcctagggctcagagcactgcagcagtacgtggagtgtggcgagtcagctaaatactttgacgctgtatgggaatatgctcgtgtgtctac

SEQ ID NO: 692066 - DNA, 105 bp, Homo sapiens
caatttcaccaacagatttctttcttacagttgatctgagcaacctcagcatgtatccggtaacgtaaaataaaatttaaaaaaataaaataaaataaaaagtaa

SEQ ID NO: 692067 - DNA, 459 bp, Homo sapiens
  misc_feature (114)..(114): n is a, c, g, or t
tggaacctctgtttcatcctcctggaaccttgctgtcctgatttgtgatagttcaccccctgagatccccttagccccagggtggccagaacttccctgattgacctggtccgntgctccttgggttacctgacctcttgctgtttttgctcgccctcccttttgtgccccactcattggggttccgccctttcccctttttcctttttttttttttcttcccccagaaactaaaaatgtgaatgaggatttttattaaaggggggccgtggaaaaatgatccgccttttttatgggagcgtccgggttggtgtgcttaggtgttaaaaaggggccctgtgtcccttgtgctttgctcttgtcccccgtgttttcccctttgcatattaacccttaactgtgcatagtgctgggatggaggggagtgttgggcctgtggtcccccctggcttataagga

SEQ ID NO: 692068 - DNA, 902 bp, Homo sapiens
atactgccatgtttaggtcttgtttatgcaaccatttctaggacagactgtttcatcagacttcctggtattctggctctaatcatctttctatcccactctccacaatgttccctgagacaaagaggcaggagctgcggtgtaggtatactcattggggctagactccccacaatctgttgatgcatgcattgtgtccagatgtggttttctgtgatggtcttgatatgctgtaatgggaggattcttgatgagggtttggtgataaggttgctacaattatctgaggttataaggatactgattagagtgaagtaaggaattgtgctgatctagcaggatggtactagtagattcttttctaaggcccatgacctcactagctcatgaatatgaggtttccagtaccaggatgattttcctcctagtcagtgggctttaagtccaattagacagcagtctgttacctctgacgtgtgagtctcacccattaaccattatgcttatcttgtaatgttagtaagggctgtggttcatagatgttaccactaggtatgactatttaagtgcttccatccttttgtggttgcataatatttccttagcatcgagataactagcaggaaaggaaaaataacgcaaatgttttaggggtaccccaggtacttatttggaccccatatatggcattggttatgtctacaatcttcaatttcccttatctctgttcctcaaaacaggtcccattcaggatacacgtatttggatatatttcattctccatgaacatagaaggcgtttccttagtgagaccaaaagtcttgatacaaacaacagtgttgatgaaattcctaatataattctgtaccaataggaaagtgcgatatacccagaaaagagaa

SEQ ID NO: 692069 - DNA, 751 bp, Homo sapiens
  misc_feature (395)..(395): n is a, c, g, or t
  misc_feature (541)..(541): n is a, c, g, or t
  misc_feature (550)..(550): n is a, c, g, or t
  misc_feature (581)..(581): n is a, c, g, or t
  misc_feature (615)..(615): n is a, c, g, or t
  misc_feature (625)..(625): n is a, c, g, or t
  misc_feature (634)..(634): n is a, c, g, or t
  misc_feature (654)..(654): n is a, c, g, or t
  misc_feature (672)..(672): n is a, c, g, or t
  misc_feature (682)..(682): n is a, c, g, or t
  misc_feature (702)..(702): n is a, c, g, or t
  misc_feature (719)..(719): n is a, c, g, or t
  misc_feature (739)..(739): n is a, c, g, or t
cttcctgtccttctttctgtcctatgtttattgaatgcttattacttggtcttaaagtttttcagattaattggaaaatgatacatatgataaaataattaaaggatgatataatcagtgctccgcaagaaggaataagaaaagtattcagaagccacagtaaattatgacatacattggcttgctcctgtgttgctatgaatagggagtaagtttgcggccctattgccatataccttgaaggcagtttctgtgttgtctgttgagtgatcctgtactacccaactgcttacactacttgtggggttctgatgtatccctacatcattgcttttattcgtgccttttctcttcttgtgaagtcatttgtacaggagttcccccttatctatcangaatacattccaagacccactagtagatggctgaaactgcagatcctagtggaccctatatgtactatggttttttcttaaagtttatcatatactatgtgataaaggttaatttataaaattaagtaaagtaagagttttaaccnaaataattnggaggggaaccaattataaccaatataatgnggataaaaaataatgtgaaatggatctctctctnttttcaaaanaccctattnatggtaccacggggctgagncctccaaaaggaaaaccntgggccctgngaaactactggataccattntttttctttttacccgnccggaactttaatggttgcnttaaaaaacacg

SEQ ID NO: 692070 - DNA, 105 bp, Homo sapiens
agcaaccacccctgaggatcagcgcctgctggcccatgtcaccctggagctccagcactatcaccagctacttgagaaggttcggatccgggatgccttgcgcag

SEQ ID NO: 692071 - DNA, 103 bp, Homo sapiens
tcacggtgatggaagctgcacattttttcgagggagcgagaagctgctggaggttggttctcccggcagcagccgacgcaaacaaggtctggggatcttcgca

SEQ ID NO: 692072 - DNA, 946 bp, Homo sapiens
  misc_feature (219)..(219): n is a, c, g, or t
  misc_feature (386)..(386): n is a, c, g, or t
caagcaagaggaagtggtcgctgatggcatcttcaaagctgggatctgaatgagctcatcttactcgggagctggcgtgaggatggctacgtctgggagttgaggtgcgagttgataccaagcactagagacagaattcattatcttagaccaccagaacactagaaagtgtttcttgtgttgaagaagggcccggaaggaattgacgtggcaacgtgnaactggctgtagattcagcaagtaggatattgagcttttgcgcaggagagtgacagtgatagagtgtttagtgttgagaaagggtggtgcattagaggatactggtggtgaccattgtgcacagcgggaaaggtgctctgttggttaaaaaacttcctaggagtggncttgctggtgcgtgaggagcctgcctatgggtgtgactgcaggtgtcactcgagtggatgcagatggaggcccaatgatggctggcggagcgattgtgcgtggattcctggtgacacatcactccggacgggatcacataaggtgggccataaagagtttcccatgggataactattagctggagagttggtcctgaactgaattcactataaacgtctgcgcatgagcgcacatgtgtttaagaacctgaactaactgttctggagcgactcgacgtaggtcgtcggccctagtgtttgttggggcgtccagaaatcagggcctagttggccttgtgggaccatgccataggggttggatacggaatccacttgtctctgggcacgtgcgtgaaacacgccaaatcttgagctaagagaaattctgggctctctaaacgaagaaggcgctccctgcgcgtgtaaacaaccgttgaaagcaattcttgtgggatatgcctacggagcagtaggacaaataacttgtgcaccgataccaaacccaccaattccttcgataa

SEQ ID NO: 692073 - DNA, 475 bp, Homo sapiens
  misc_feature (79)..(79): n is a, c, g, or t
  misc_feature (103)..(103): n is a, c, g, or t
  misc_feature (114)..(114): n is a, c, g, or t
  misc_feature (117)..(117): n is a, c, g, or t
  misc_feature (225)..(225): n is a, c, g, or t
  misc_feature (249)..(249): n is a, c, g, or t
cctaggagattcggactctcagaatagacccagaggcgtggccacacagagaaaaagacatgtggggacacagtgaaanaggagcggtgggtgagccacaganagaggactcanaanaaaccaactctgctgacaccttcatcttgaacttctagcctctagaactgtgaaaaaacaaatttctgttgttaagacacccggtctgtggtattttgttaagacagnccctagcaaactgggggggggggntgtacactaaataaagtccaattcaattttaattttatagaaactgaaacaaataatttaaagatttacttagtaaattacttcagattgggatcaaatgtgtacatgaattatgaaaatgtaagaaatggatatttaaataagtataccagaacataaaaattccggtgcctgggtttttttttttttttgaaagccacttatcccaacaataaaactgatgctc

SEQ ID NO: 692074 - DNA, 339 bp, Homo sapiens
gccacacttttaaaccatcagatctcatgagaactcactatcacgagaacaggataaggaaaaccacatgttctcactcataagtgggagttgaataatgggcatggacacagggaggggaacaacacacactggggccagttggggggtttgggggcaaggggaagggagagcattaggacaaatagctgatccatgtggggctttaaacctagataataggatgataggtgcagcaaaccaccatggcacacatatacctatgtaacaaacctacacgttctgcacttgtatcccggaaattgataacataatgggcagatacactgattgcttggt

SEQ ID NO: 692075 - DNA, 174 bp, Homo sapiens
gcgcgcggcgacctagaggaccgggagtagtcaatgcaaaaacataaagtaggtaattactcttgatcttgacattacttccgttacgaaagtacttacaccatttttcaaactaagctactatattttaacggcttccaaattcttctaactcttccaaaagccttctggctt

SEQ ID NO: 692076 - DNA, 134 bp, Homo sapiens
tgggccccaacggcggggtcacggtcctcagcgagaagggcccggccacccgggggaccgtcgacggcggagactgtggacgcgagccgggcccttcccatggatcaccccagatgcgacgggcgttgcggccg

SEQ ID NO: 692077 - DNA, 356 bp, Homo sapiens
ccatgtgacttgggctgtgaaatttgaatttcagataaacaattaataatttttttagtataagtttgtcccggccatgcacagtggctcacacctgcaatcacagccctgtaggaggctgaaatgggcggattttttgagctcaggagttttagaccagcctgggcaacccaaggaaacctccttttttcaaaaaatacaaaaattagctgggtgtggtgacacatgcctggagtcccagtccctggggaggctgcggtgggaggattgcttgagcccccaaggtttaaacttcagtgagccggggccgcatccccgccctccatcctgggtgacaaaataagaccctctttcca

SEQ ID NO: 692078 - DNA, 473 bp, Homo sapiens
ttcaaagtgtacttataaattatattacatcaattttatttactggtctaaggaggcagagggtggaagggtatacaatgtggaggaaacacattcataacggggtgaagagtgctggcgggagacacgggtctttaacatggaaaatgtttaaagtatttaggcaaagttaccgaaaacagatcaaacaagccagtttattttggtagaaaattccactttcatagggttaggcgatgtgctcgtgtctgtgaaggggttgcttccggtcatctccttcctaacggaagggaagggatgctaagttaggggcccctgtcaccaaggatggctggcgtccctttgaatgtctgtccctgggtccacacagctgcctggaacccacgactcccgagagcccgtctgctgcaggtgatgctggaagggaagcgcccccacttgacagatgagtgcacggagggtccgacagggga

SEQ ID NO: 692079 - DNA, 1387 bp, Homo sapiens
  misc_feature (140)..(140): n is a, c, g, or t
  misc_feature (1142)..(1142): n is a, c, g, or t
  misc_feature (1310)..(1310): n is a, c, g, or t
ggaaaaatgaattgcttggtattcattacttcatgtatatcaagcacagcagtaaaacaaaaacccatgtatttaactttttttaggactttttgcttttgtgacttttcttcttttccttggactacctgtggcctaancattgccatgtggtgcctgctacaaaatactttacaccagggaacaattaacctgtgacgactgcagtggcctagccttgtgtttacagtgtcttactgacaactttctcagtgacaccaatgtccacagcacatatatagtgtggttacaagacaccacgcgtgtgtatattatacacattctcacgtgtataaagtgtggcacatctaacacacgtttctctacgtgcaccctgtgtgcaccctttttctacacactttacacgtgttctgccttccttatagacaacgggcttgttatcatctacattgtgtcgttaaacgctgttctagaatgctcttgttgtggaggactcctcccgtagcagcacatcttttctcttttctgttcaccagcagtgtacaacaattcgttgcagtcaccccatttttttattcttctcgtagaacacacattcttttaatatgttttccacctgttataattttctccacccgcctctacctactgatagtgggccacagggtccccttatccatggtggcgggggactacatccgtgtttattcaacccctcagaccggttgttctctattacacagaccctgacgcgttatacaacagaatctgcttgttaagcttccgaaagtctaaagaagccgaccaaaaaaaactatcttcagcgatttaagcttgaataacaatgagtgattttgaaagaaacaactaagaccgtagtgtatacttacatcccacgacatgtcgtagcttaccccccgcagaacggtggaaagaacgttgcacgccgccggccagattacaggttgccatgttatctacatcaatttaccgcccgcccgacactaagccggccggctgattggatcaaccaaccagtaagcgaattcaagacatgttgcggcgaactgattctttctttcccacccctatccaattgctttagttacttagcatcgtgtccatagcccgttcgggcggcngtaacgaactcgaacaacatgcatacgtcggcctgtagtgaggacgacacacaacctttcgtcggccaacactgcttatatctacagctgcagtacacgcacactgcacggctcatctaacgaacacggaaaggctttcgtacacattaacagcgctacgtctgagcngagtcatcggtcagtcttcttcccgcgcccgcaatcaatgctttgcttgtcgagtccacactcactacacatcctct

SEQ ID NO: 692080 - DNA, 119 bp, Homo sapiens
tcgtctgcaggcctgtgatggcgaccactgctcccggggctgtgcttccccaagtagtcctgatagcagcggctgcgccggatgcgcccggactcagttataattttgcaaagcctggt

SEQ ID NO: 692081 - DNA, 736 bp, Homo sapiens
  misc_feature (360)..(360): n is a, c, g, or t
  misc_feature (661)..(661): n is a, c, g, or t
gagacaccaggggcatggtgggatggtgaagaccaggagcagagtagagcctcacagaacacgcgcggctctctgctcatgaccccacccggggctctgcacccagtgtagcagccccaggtcatcccaacccctctcagagcctcaagaggggtagctcgcctgccggaagagagggatgcactatacctggcaacacctacacgtggcgtactccatcacctgccaccgcctgtgacatgtgtgtgagctggaagcatacactctgagagtctaactctggaacatctgtgcacaggcacaagagaggactctatgtgttttgtgtaatatatatacatacatatatatatattccgnctgtaagagacatgtcttatacagatgctgaggagtaccccctgttagataatctcacagaggagactatatattaaagcacacaattggtgccaagactgagagagaaatgtgcatttcccccttattatcctgacggatatcttttttggggcaggggaccttacctgtgagacgtctgatgactctccctcctgtgtcaaggggcacacactctgatgaatgtgtccctcggcagataccgcttatagtgtttgaccagacgtcctacagatgccgggtgagcctctagatcttctgnatctacgacgaccgacacctgcgaccctagagccgacctgttatctaccactccggcggtcggtgtccagcctct

SEQ ID NO: 692082 - DNA, 229 bp, Homo sapiens
gatgactgcgacacctatggatactagttgggctcattactgctgagccacaatgggaactcctggaagtaatcttatttctgatttgaggagctcttctcaaaggtgtgctctctctctcatctctctcttgctcctctcaaacacacacacacacacacacacactttgtcagtaacagagatcttataaacaagagcctgaggttcgcagacatcctgcaggatcc

SEQ ID NO: 692083 - DNA, 131 bp, Homo sapiens
gttgtttatgcaggtcgtctagagctcccctctcacaaaccccctcgatggagtccttgtcgcagctggagtccttgtccttagctggtgatcacacagcctgtgcctgtacctgtcaccccactggatgg

SEQ ID NO: 692084 - DNA, 616 bp, Homo sapiens
  misc_feature (521)..(521): n is a, c, g, or t
gcctgcagtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcncaaaaaaaaagaattctcgaaaatcgctgagaccggcgcggttattcactttggtgggcctaaaggagccgttgcacggtggcggggactccgct

SEQ ID NO: 692085 - DNA, 458 bp, Homo sapiens
attcattcattcattacaacttacactttcagtctacaggtgaattcccccaagcttcagaaatgcccctgaccatttcttacattgttctcacagcagcatggcttcacacttccgccttccagtttattcccagatcccctaactggtctgcagtggtaggatgagaaaatcattctttctcactctaaagacgtacgagtcttcttgctctgattccatccaccaacagacagaggagcctgaagcccatcaaaaaattacatgtggaaactcaggggtttaaatctactgttcgagagatagtgcttcaacagaatttattttaatatggcagagtcctgaccgatgttttctgctttaagtaaaaaattagctataagtcaagaatggtaaaggctttgtctcctatcccaaaaagaaacagaaagaccattagttgatgcttttggtcaaaa

SEQ ID NO: 692086 - DNA, 798 bp, Homo sapiens
ggaatggggtgagctggagccaggacctgcattaatgaatcggcactgggtcggccgactgggccagtcctgcctctagcatgtccatcaggatgacccagaagtctacaaggttgtcacctctggacccccgggccttacagacagcacgcatcctacacagagtgggcccggttacccgcattcagctcagctcgagcttactacccgagttgggacagcagcaactaatcgcggtggcctaggagcggcaggcatatacgtgcggagccaagacaggacactgggacggcagatcaaccgagcagggtaacggatcagacgcagacgccatgcagtgaggcacccacatatgatcctgagcagtgtggaacaccgaagacagtcacaaggaccagataggcagcaccacaggagaggaacggagcaaggagtcaaagaacccatcagatcacaccaagtatatgcgcgtccgttcgactacgaccagaggtacggattcccgtgcgagccaggcaagacacacagactgctaggaggacccaaagatggacgccgtagcctgacaagcaagacagacagaccaggcatacgaaaggcaaaccatagggagcaaacgatgatatcgcagaagcgataccagatcaaagcagagcgtgtagagaaggacaagagttggaaagacatacatgtggacacgaaggaagcagaggttgaaaagacgtgagacagacggccagccattgggcagacaatgacagaggagcctgggtaggaagggaactatgaaagaagagg

SEQ ID NO: 692087 - DNA, 1498 bp, Homo sapiens
  misc_feature (1403)..(1403): n is a, c, g, or t
ctctccgtgtccgctctcgtccttcgtttttctctttctcggcttttcttctctccgtccctctccttgggcttctttcctcccctttcctccttcgtctcgttgctcttgctttctctcttgcttttccatccctcggttttgtcttcctctctttgtcgcctctcggtcttcgtgccttgtgctcctgctgttcgttcgcttctcctctcttgtcttcctctttggctcccgtcttcgcttttgtgcgtttttcgtcctcctcttttctatgtttttattcttggtttttttcttgtttctgtattgttattttttgtttgtttttttttttttgtgtgtgctctagttgtgtttcttcactttttcttgtttgttatatgtataaacacaagagacacaaaagaagagagaggaggtgatatctctatgttatctggtcctcgtcctgttcgtctctcctcggttttgttacgttctcgattctcgctctcgatgtctcgtttgcctctttttgtctcttcgtgtctctggctgttctgactacgtcttgtctctcagctctcttccgtttctcctacctcgctctcttgactttcgctcttttttcttgtttggttgttcgttgtattgttcttttgttctccgcccgagtggagtgacggcgatgaggtggggtggttttagtaattgtagagtgtctattagaatggaggagtggtttggatgtgttggagtaatggtattgtattgtatagttttatattttgtgttgtagtatttttgtttgttttttggagatgattatgagtttataaagagggatgctgaggggaggatttgtgaggtggggataaggatagttgagagagtgagtagagagagtagagagtagtagagagagagagaaccctggcgcccgaccaggatgggccaatgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcncaaaaaaaaagaattctcgaaaatcgctgagaccggcgcggttattcactttggtgggcctaaaggagccgttgcacggtggcggggactccgct

SEQ ID NO: 692088 - DNA, 144 bp, Homo sapiens
gaggagtccctgattgcagtacatcgaagtacgacggtcgagagcgcagaagaacatgtctgtacacctgtccccctgcttcagtgaacgtccagatcggtgacatcgtcacagtgggcgagtgccggcctctgagcaagacag

SEQ ID NO: 692089 - DNA, 1277 bp, Homo sapiens
  misc_feature (611)..(611): n is a, c, g, or t
tggggcatatgaaaatttattactacagtgttttcaccattaatatttatgatctcttgggctcttccctttcttggcctttgggtattaggggccaaaaagaagaaacattgggctactttggacaaccttataaagcgggacctccaggaattattcaccaacagcattgacctttggcggaccaaatctccagacaaccagaaactttcattcattttctcctcaaataaagttctcaagacaacccgctcatgtgtgggttaccaaggggcgtggtgattttctcttgtggccatttcttggatctcaggtgtggacccctttaacacacttctccatagagttgggcagaaattgtgggcggtggtgtgtggccttctcaactctccttatctttttctccagacagcgaattctcctttttgtggcgtgtggagaaaagccacctctcacaagagaggggtgttgtgggcctttataggggcgcgtgtgtggccccaaagatgtgaaagcctttctcttatatatacgcgtgggtgtaaaatctccatgtggcccaacttttcgtgggtgctccctgcggtgcggggtgaactatagcggagagncttctccctattaaggcgagtttagcagaaaaagtctcccccaacaaaaacactttgttgcgccacatttcccgtgtgtgcgggggcgtgttgtggtatttgtttctccacagagctgtgttgtcacttttataatttttatacaccgtgtggtgcgttcagacaattatgtgggggagacgcatacgcggggtggaactgccggcaggggtcgcgcgacgctcaacacattatcaagggcgcggctaaggcgcttcacgcccacactcttcaacagaggcggcttcaaaagggcgacgcgggctcgcaacccgggcggcgcgcaccacaatgcaaaggggggggggggggaacatcacacaccgagagggccccctaaatgggggtctgcgtggcggaaaaacattcccttcgccggaaataaaggtggcggccccccaatctttgtggccgccaaaaaaaaaacgccccgggggaaaaagacaggggggtgggccaagggcccgtcccccttagggggcaccgaaagccagaagcgggcggagggaacctcgaggaacatcaacacgggggggtcgtcgaaaggacccactggtgatcaaccaccctcgggcttaccacaggggtgccgaagaaatcacagatacacaggggggctacgatgag

SEQ ID NO: 692090 - DNA, 829 bp, Homo sapiens
  misc_feature (734)..(734): n is a, c, g, or t
ggcaccatcagggcagtctttggttcccggcacagctgggccggtttctgggtaatagaattttttgttcggccaacagcacatttctgggaaggtccgcacatcttctctcgtctctggcgcctaagatagcctgcttggatttgcctgggcggccctagggccctttttgcggcagcaccgtcaccggtccccgtcgctttcggccctggcgggcgaatacgagcgtcccttcggcggcccctggggcccgacacggatgggcaaatgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcncaaaaaaaaagaattctcgaaaatcgctgagaccggcgcggttattcactttggtgggcctaaaggagccgttgcacggtggcggggactccgct

SEQ ID NO: 692091 - DNA, 572 bp, Homo sapiens
gtaatagatctgtggttgagtaccccaagagatatggtcgtcttattactaggatgtgtgtcacgttttgctgtacaagtggacagtccccgtcccaactcacgccatggctcgtcgcatggccgccgaaacgtgaacacatctcgcatggcatctcactcggctctgcatgttgcacactggagccagagtaaagctcatctgatctgttctagcttgggtcaaacaaagttctttaggcaagttccgtagattctctgggcttaacgtgcaagggacacacgaattccttattcgtgtgccgcatgaagatgcgggcagatctcctgtgtacagaacgattcttaggactgaaggcaggggtctgaggcctctgcgacctggctcgcccctttccatccagtaggctgctgtttcccaagacgggactaagcgtgttcttatggtgaaatgcttgggacaggagtgcttacagattattgcattatttcagacggttggaacactttgcatactatacataatgaggtatcttggtaggtctcatgtctaaacatgtaattcatcatgtt

SEQ ID NO: 692092 - DNA, 112 bp, Homo sapiens
taagaccctaatgcaaagtaaccattctcccaggaacctggctttcagaatgtgaagaacaagcaaaggcagacaagaaagggatgtggagtgaggggaacggttcacatac

SEQ ID NO: 692093 - DNA, 845 bp, Homo sapiens
ggcaccatcagggcagtctttggttcccggcacagctgggccggtttctgggtaatagaattttttgttcggccaacagcacatttctgggaaggtccgcacatcttctctcgtctctggcgcctaagatagcctgcttggatttgcctgggcggccctagggccctttttgcggcagcaccgtcaccggtccccgtcgctttcggccctggcgggcgaatacgagcgtcccttcggcggcccctggggcccgacacggatgggcaaatgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcatacagatatgacctggtgtatacacgactgtagttaccctaatttccatatgccaagaatcttcctgtcagagtctcgggggtccgttcatcgggggcggtcaaggaggttgttccatgtggccgttggctgaggggatctactggcccggcttgag

SEQ ID NO: 692094 - DNA, 332 bp, Homo sapiens
gcctgcagtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgtcgggctagtcgggggacctggtgggcgctttgctctgtcttcaagccccgtcggctagtgggg

SEQ ID NO: 692095 - DNA, 282 bp, Homo sapiens
  misc_feature (187)..(187): n is a, c, g, or t
tggggcatatgaaaatttattactacagtgttttcaccattaatatttatgatctctcctggagtccgctttaaggttgtcaaagtagccaatgtttctcttttggccctatacaaaggcaagaaggaaagaccaagatcataaatattaatggtgaaaacactgtagtaataaattttcatatgcncaaaaaaaaagaattctcgaaaatcgctgagaccggcgcggttattcactttggtgggcctaaaggagccgttgcacggtggcggggactccgct

SEQ ID NO: 692096 - DNA, 829 bp, Homo sapiens
attcgcggccgcgtcgacgatagcgcaaactgcccgggaagggaaaccagcactgtacagacctgaacaacgaagatggcatattttgttcagggaatggtgaattaagtgtggcaggaatgctttgtagacacagtaatttgcttgtatggaattttgcctgagagacctcattgcagtttctgattttttgatgtcttcatccatcactgtccttgtcaaatagtttggaacaggtataatgatcacaataaccccaagcataatattttgttaattctcacagaatcacatgtaggtgccacagttatccccattttatgaatggagtgatgaaaaccttaggaataatgaatgatttgcgcaggctcacctggatattaagactgagtcaaatgttgggtctggtctgactttaatgtttgctttgttcatgagcaccacatattgcctctcctatgcagttaagcaggtaggtgacagaaaagcccatgtttgtctctactcacacacttccgactgaatgtatgtatggagtttctacaccagattcttcagtgctctggatgttaactgggtatcccatgactttattctgacactacctggagttagcacagaccccacaagttaggggctcagtcccacgaggctatcctcacttcagatgacaatggcaagtcctaagttgtcaccatacttttgaccaacctgttaccaatcgggggttcccgtaactgtcttcttgggtttaataatttgctagaacagtttacggaactcagaaaaacagtttattttcttttttccgtgagagagggaagggggg

SEQ ID NO: 692097 - DNA, 676 bp, Homo sapiens
gcaggggtgcctgagtgggtaggctcagatgggggttcactggtttgggtccttcgagtatggggctgagactgaaaagttgcagaagcagctggcttcggagaaggaaatccagatgcagctccaggaagaggtgagtctcgctgccggcttctgcccccaccctggagagccactggcccagagtggggaccccaggcccttggagctacctgactctggagaggactagcaggaactgagtcttgtgcgtttccaccccctccatgcctggcacagcccagcaggtgacagttccatcaaggtctgagtggtgtggagtgcaggtacctgccctgtggtcccccacatgacactcggagtccagaacctgggcctctggccctcagcctgagagcagataggcaaggagtgctggactggggtgtgcctgggtcccagcagagcgtgtgggtgggttcccagctgcaggacctgcgggagaagtacatgcacttgtgggcggcattgctgattgagatgcaggaggaggttgaagaccctcctgcaacaagccccggtgtccactgggtctgccaccattaccatacagtgtgcctctggttgaggaccctcccctggttgccactttctacgtctgtgcctgtgtctcaccttggtggctgactgggatccc

SEQ ID NO: 692098 - DNA, 193 bp, Homo sapiens
tcatagactctcttcattatccccgttgaggaacctctctagatcttttttaacacatcaccatcccccgcaagtagaatagttagtatcactgatacactgtatgcctgtttatacactacatgtacatctgtgctttatacataagtaagattaaaatcacctcttgcaggtgctaacactcccactgaag

SEQ ID NO: 692099 - DNA, 244 bp, Homo sapiens
  misc_feature (149)..(149): n is a, c, g, or t
tggggcatatgaaaatttattactacagtgttttcaccattaatatttatgatctctttctcttttggccctatacaaaggcaagaaggaaagaccaagatcataaatattaatggtgaaaacactgtagtaataaattttcatatgcncaaaaaaaaagaattctcgaaaatcgctgagaccggcgcggttattcactttggtgggcctaaaggagccgttgcacggtggcggggactccgct

SEQ ID NO: 692100 - DNA, 719 bp, Homo sapiens
  misc_feature (671)..(671): n is a, c, g, or t
attcgcggccgcgtcgacgatagcgcaaactgcccgggaagggaaaccagcactgtacagacctgaacaacgaagatggcatattttgttcagggaatggtgaattaagtgtggcaggaatgctttgtagacacagtaatttgcttgtatggaattttgcctgagagacctcattgcagtttctgattttttgatgttatcatgcatcactgcccttgtcagatagtatcatgatcacaataacatcaagcataatatttcattgattctcacaaaaacaggtgggtgccacagttatccccattatatgcacaaaatgatgaagacttggggttaatgagcgatttgcccaagctcacctgaatattaagactgagtcaaatgttagtctggtctgactttaatgcttgctgtgttaatgagcaccatgcattgcctctcctatgcagttaagcaggtagacaggtgagagaagagcccatgtgatatcgggggaaattcaccccaatatttcatgtaggttcttttctattttccctgagtgtcggccggtctgagaaataaaaggaaagagtacaaaagagagaaattttaaaactgggtgtccaggggagacatcacatgtcagcaggttccgtgatgccccccaagccgcaaaaccacaatttatngtgattttcaaaaggagagggagtgtacgaatagggtgtgggtcacag

SEQ ID NO: 692101 - DNA, 471 bp, Homo sapiens
  misc_feature (18)..(19): n is a, c, g, or t
  misc_feature (423)..(423): n is a, c, g, or t
gagtatctcctccccgtnngcccaaaaaaacaggtgggtgccacagttatccccattatatgcacaaaatgatgaagacttggggttaatgagcgatttgcccaagctcacctgaatattaagactgagtcaaatgttagtctggtctgactttaatgcttgctgtgttaatgagcaccatgcattgcctctcctatgcagttaagcaggtagacaggtgagagaagagcccatgtgatatcgggggaaattcaccccaatatttcatgtaggttcttttctattttccctgagtgtcggccggtctgagaaataaaaggaaagagtacaaaagagagaaattttaaaactgggtgtccaggggagacatcacatgtcagcaggttccgtgatgccccccaagccgcaaaaccacaatttatngtgattttcaaaaggagagggagtgtacgaatagggtgtgggtcacag

SEQ ID NO: 692102 - DNA, 341 bp, Homo sapiens
tatttttttacaagatacggatgtgcttgggtcgtgggagtggaaatcctgtgagatggattgttatgatcattatacaactacagatgtgataaattcatttgagtaataaaaagattttttaaaaagtagccatattgaaaaagaaaaaaaaaaaaatccttaacaggagctgactgaatctagtgttgggtcagtccacaatgagcttcataaaaaaaaaaaaagtcattggtcaaatacttctggaaaggtgcccaagtgtccaggtgctgaggcaaggggaaagggagcaagggattatctgggaggtggtatctggtacaaataattccgggtcc

SEQ ID NO: 692103 - DNA, 591 bp, Homo sapiens
  misc_feature (514)..(514): n is a, c, g, or t
cagcacctaaaatgttgataatattaacatgtatctaagaggaaaaaagagttaatatattctggcacccactttcctagtaatgttttccatgattttccagttctgaggcacttattaaagtgctttttttttttctggaattaattaggtatgggtaaaatatatttttaaattaagtaagctttataaacacaattagaattacaattaattaacagaggtataatggtctcactttcagaagtgatcatttatttttatttagcacaggtcataagaaaaatttttagaaaactaatcaatttcatattataaagggattatttctccacctttaattatgggcctatcattggtaagcgtaattgggtcatattatggaactaaggtaattattccattcaaagtcttctctagatttaaacattgtttgcaaaagcttaggattatatcatgtgtaccgtattatagataacatcctaaaccttccagttagatatataatggactnggggtaatctcttgggtaatcggtttggacagatttcttaaattatgttagcataatcagggaagatttaccttgaa

SEQ ID NO: 692104 - DNA, 305 bp, Homo sapiens
ctgcgcacggctcccactcccgactgacatcaacacctaagcccaacgagcagaacccactgatgctagaggaagatggaggggtcataaccgcaccttcccagggagacttgcctgggcctctagcctgaacaggcccctagatgccatgctgtagactaggggtcttaacaggtcaggcataggtgtcatccagcaggctgaaccctgtagctggcctgaactttagttacttgccccctccacgatcactgaggcctgacagagcctgaaaccctgacaccccacctaatgaagctagtcga

SEQ ID NO: 692105 - DNA, 110 bp, Homo sapiens
  misc_feature (103)..(103): n is a, c, g, or t
agataagagcagagtcaggaaagggggaaaatcaactgcggataggtgaagattcgagggaagctcgctgagcttctggggagaactgggagaggaggctgcnaacgagg

SEQ ID NO: 692106 - DNA, 182 bp, Homo sapiens
atggctggccagtgagcatatatttaaactttttttttttccccctgagagacagggtcattacctcctgggctcgggtgatcatcccacctcagcctcccaaatagctgggattacaggcgcataccactatgcctggctaattttttttatttttagtagagatgaggtttcgccatctc

SEQ ID NO: 692107 - DNA, 103 bp, Homo sapiens
tggagatgtggagaacacatacacgagaaatcactcatagtcccaccttccacaggcaacactgctactgttagcacctttcttcttcttctccacatctcct

SEQ ID NO: 692108 - DNA, 207 bp, Homo sapiens
aacctttttttttttaaagggaggtttcctcccaggggatttatttgagggagccagtgggggagggttttgagactcagaagggttttttttaacaaaaccctggggggtttatcccttggacttgccccctgtaaaaggggtttcccttttgaacggtttccggcccaaaattttttttaaagggaataaaagggcccccagcca

SEQ ID NO: 692109 - DNA, 269 bp, Homo sapiens
  misc_feature (102)..(102): n is a, c, g, or t
  misc_feature (126)..(126): n is a, c, g, or t
  misc_feature (143)..(143): n is a, c, g, or t
  misc_feature (148)..(148): n is a, c, g, or t
  misc_feature (162)..(162): n is a, c, g, or t
  misc_feature (196)..(196): n is a, c, g, or t
  misc_feature (203)..(203): n is a, c, g, or t
  misc_feature (205)..(205): n is a, c, g, or t
  misc_feature (210)..(210): n is a, c, g, or t
  misc_feature (215)..(215): n is a, c, g, or t
  misc_feature (218)..(218): n is a, c, g, or t
  misc_feature (226)..(227): n is a, c, g, or t
  misc_feature (230)..(231): n is a, c, g, or t
  misc_feature (237)..(237): n is a, c, g, or t
  misc_feature (241)..(241): n is a, c, g, or t
gagaatgagggtatcaagtggtgaaagatggatcaagggggataagagtgagttgaatgaataaagaaatcagagaagtccagttagagtaaaagagagaanataacagatcacaggatgtatctnagagtcaaacagaaaantgaanggagagaagtaagncataatctacagcaagagagagacatcagagganttcaganangatgncagtntancccacgtnnganngggcantctnagtggggtagagcaagggagtcacggta

SEQ ID NO: 692110 - DNA, 309 bp, Homo sapiens
  misc_feature (303)..(303): n is a, c, g, or t
ctggcgcactatatatagtaccgccaggaaagatgaaaaattataacctagcataatatagcaaggactaacccctataccttctgcattatgaattaatctagaaataactttgcaaggatagccaaagctaataccccctaaaccagaccagctacctaagaactgcttagagagcacacccgtctattttgcacaatagtgggaagatctataggtagaggcgacgaacctaccgagcctggccatagcttttttctctctttaatatcatagttcaactttaaatttgccatttgcctnaatgaa

SEQ ID NO: 692111 - DNA, 181 bp, Homo sapiens
gataacccccccacggcggggtggaggacccccatgcaatatatggctctacaaacctcagcatgttaagcgaagcctggtggagcttcacaaagggtccatagaagattagacaaaggcaaagaagcagcaacaccttttcgaaccctagggctcactatatttattcaaaggagtcggg

SEQ ID NO: 692112 - DNA, 203 bp, Homo sapiens
gtctgagcaagcggggataccggttctccaactctgaaaatggttctctcatggtaccatcttccttttttttttttcccggaaacagagtttggctcggtggcccgggtgggagtgcaggggggcaagaggtgggcccagggcaacctctgcttccagggtaacaagcatttttcgggtttcagcctccggagtagctggga

SEQ ID NO: 692113 - DNA, 941 bp, Homo sapiens
ataacatctattttggccgggcgcggtggctcacgcctataatcccagcacttgggaggccgaggagggtggatcacaaggtcaggagttcaagaccagcctggccaacatggtgaaacctcgtctttactgaaaatacaaaaattagctgggcatgctggcgggtctcctgtaataccagctactcgggtgggctgaggcagaagtcacttgtagacccggggaggtggaggtggcgcatgagccgattatcatgcccatagtgcttccagcgttggggtgaccagagcatgactgtatctacaaaaaaaataaaaattaaacaattaaaaaaatcgtgattttctactaccacttaccgtcattaggacaccatgtctgaaacaaaggccatcgctatagagtcagctgtcgagcattggtgtcacaggagaggattcatggcgttcggtttggaggaatgtggttaatacggacactaaacatagtctcgtattttcagtgcaacgtgtcacacatcatacagttctgggcgagaaaggaaagccaatctagagtaaacaccttaggccgggcgcagtggtcacactgtagtccaaacactgggaggcgaggcaggtggatcatctaggtcaggagttcaagaccagcttaacaaatggtgaaaaccccatcggtgccagagattacaaaattagcgggctgatgatgggggcacctgtaatgccagccctcagaagggcggcggagaattcttgaaccggaggcggagtgcgggacgcagaacggacctattatccactgggcacccatggatctgttccagaaaaacgagacacagatgcttccaacgacagagacactctgcggcacgggagaaccaaatccaggggcacgggcacgaaaggtccagaagcttgcaaaaacagcggacccaacag

SEQ ID NO: 692114 - DNA, 1045 bp, Homo sapiens
ggtgcggggctggaagtgggcgtgctgcgggacgcgctgcgggagtcgctgcggcggtgcgggacctggcctgagctggagtggcgccggggatcggggctcgtgtgcgtgtccccgatgcccggcggagcgggcttctggggtgtctgcgtgcaggcgccgtgggtgaacgggctgggtgatgtgggcgcctagccgtggcgtgtggccgggtgcctctagccatgtacgcgtgggctgcacggacctgagctgtggccaacgagcagaggacctgaagggagaccctgaccaacttgcacggagccgctcaaggccatcggagcagttccaggacagagaatgggtgtgctgctgccatctcttcaggtcaggccctccccttcgttggaccctgcacggggacgccgcggctggaggtaccaagcagtcggtaatcgagtgaggctgcgggacaagctgctggagacgaggtgtacagccattcgccttcggagggggaagggctgacggacaaggggtacagaggagagctgggaaagaccgttctggaggaacgagccttttctctggtgaaggattgccgatccccatggcaggcccgttggttgattgtgcgtacatgatagcgagccatgcaccaaagggttcccggaagaaaaaagagcgtgaagagcctggatcaattgggcgtgaaaaagggaagactgtagtcgtaggcgcattgcagcccggatggaatgtgttgagaggcgggacagacattcatggcagagagacaaaccagggggccatctatcagggggacgaagggttaaccgccgacgttcccatggaaaagcgaagtgacaaattccatgagaaagaaagtggaagacgtcgggcacgatcttacaagagatacaagaagcatcgtacttggatcgcatgcacagaggttaacacaagggcccgatcgcgaccaaggaacaagggcgcccagtggtggaaggttggagtgagcaagtaatgagggggggattggatggggaacaaaaaggtataa

SEQ ID NO: 692115 - DNA, 332 bp, Homo sapiens
tttaaggaaaaaaaaaaaaaaaaagcccgggccccgggatggggttttccagggggctgggggtttgggccgggcatcccccccaaccttgcctttatccccctggggccagaacaaaccaaagcctttgttgtttggtggcgaggcccctttttgaatggggtttttttcccggtttttagccctttccccccctgtaatggggggccttggccttgtttatttttttttcgggtcacttttgaggggttttttttaaatccattttagattgtttcggggggggggcccccccaaaaaaaaaaaaaaaaattaaaacccctggttttgca

SEQ ID NO: 692116 - DNA, 155 bp, Homo sapiens
agactatttctatcataaccaattcagtattggattctgtactctttcctcagtttggtttatctacttatgtacggcaactcccacactatctcatgaccacagctttatcatttgttttgatatatgattggtgtagttcatggtttttgcat

SEQ ID NO: 692117 - DNA, 809 bp, Homo sapiens
aaaagaatagtcatgaggctggatcttgatgtttattcaggacgagggcatagaggcgaagtgtgtactaggttgcatggagtcgaagacaagcgatgtttccttcccgccaggcaagtgcccttagaaaccgggccaccgcccccttcctggactgcattcccatcccctctcccggggcggaggtgaggacctccttggttcctatggttctgtcagatgagccccatatccattggccatgaagctcgatgaggaagaacatcgagaaggacaatgcgggccaggtgacccatggtccccgaggagcctgaggacatgtggacacacattacaaccatcgtgcaaggtgggcagacagcctgcgcgcctccaaccatccgcaaggtacagacagagtcctccacgggcagcgtgggcagcaaccgggtccgcaacataccctcactcatctgagatggaggccatcgacctatcgaaatctcaagcctgccagctgcaaggagttaaggggaccaacatccaagagaaatgagtatgtcaagatggggggctataccacaccatcgagctggagaccaaaccgcaagtacaaccatgggccaagaaagcaggggatagtgtggaactgggaggcgcatcgaagcagagcctggtgaccaagctggagcgctgatgtggcgagctgatggacatgcagagaaggcatcgcccaatactgccaaggcacaacccaaattgaccccatcgaggcaggtggggaacaccctcgccacgacggaagactcgatacggcatggacgtccaac

SEQ ID NO: 692118 - DNA, 247 bp, Homo sapiens
ggaaatacataacttgtcaggtttcacaggtttacagctggagaggaattttgctgtagggtgaatcatacctcgttcttacccatacctaatttagatgatatttagatgaaactttgaacattaggcattagagttgatgatggaatcagttaagaattttggggctgttgggatgtaatgatgcatttgcatgttatagggcatgaatttgaggagccagtgcagaatcttttgctgattgatt

SEQ ID NO: 692119 - DNA, 130 bp, Homo sapiens
cagcggaccatgacaataaggatatttgcattaatccctcgtctgacctcgcttctacaatcgccaacagaatcaaacgttgttccactaggtctaggttgtagctcgcattgattaaggcattgtcttt

SEQ ID NO: 692120 - DNA, 186 bp, Homo sapiens
tggtgctgtaaggaatactgccggccctgactacatcaccgacaagtccactggcttgagagtggaacagcagccctttgacggggcccgagcctctagaaccaatgacaagccaggaggcccacactatatactgcgctggacgttcgccgcaggtcatcatggagaacagcacctctaaagtga

SEQ ID NO: 692121 - DNA, 450 bp, Homo sapiens
  misc_feature (174)..(174): n is a, c, g, or t
  misc_feature (192)..(193): n is a, c, g, or t
  misc_feature (202)..(202): n is a, c, g, or t
  misc_feature (214)..(215): n is a, c, g, or t
  misc_feature (288)..(288): n is a, c, g, or t
  misc_feature (357)..(357): n is a, c, g, or t
  misc_feature (369)..(369): n is a, c, g, or t
  misc_feature (421)..(421): n is a, c, g, or t
tgaacaaatagttacattcttcattgtctgccgcagtgctgtccagaagagcttcccacgataatgggcatgttccatatcagcaccgtccaattcagtagcccctggctccatggggttttctctctttgtttttttctgtttgttttttttttaagacagagttctcactcnttttgccaaggctggagnntgcagtggntgtgatcttagnnctcacagcaaccctctgcccttcctgggtttaagcgattttcttctcgcctcacgcctccctgagtagctggngaactacaggcccatgccaccacccacgcgctggctaagtgtttaatataatatattttttgctttggnttttgttttggnttttgaagatgggagttcttgtttctgccacctccaaccctggggccaaccnaaaagcccaaccttcccatatccaaaaaa

SEQ ID NO: 692122 - DNA, 523 bp, Homo sapiens
  misc_feature (4)..(4): n is a, c, g, or t
  misc_feature (25)..(25): n is a, c, g, or t
  misc_feature (118)..(118): n is a, c, g, or t
  misc_feature (122)..(122): n is a, c, g, or t
  misc_feature (249)..(249): n is a, c, g, or t
  misc_feature (262)..(262): n is a, c, g, or t
gccncggagggaggcctcaaatacncgaagattaggattgctattgtgggctagcaattataacactatttcggtcactattatttggggccttttagtactaaaatttaaccgtgtnctantagaactgatttaccccagtaatgcgcttgatgatttcagcatcgtggcttggctatttttacaaaacagcattgattgaagcagtcttggttttactaggtagggtagcatttgctattggtaagngataatacattanttcacaatacttgttatagtaccccagttgttgttagtggggactatgatactgtaataatatttttaaaatttacatcaagagaggcagtcattcacgatggttttgtgccagctctttttagggttttggatcacattagagatatttagaacatattaccctgtgattacgtaggaaacctaatatgctgagtatctggcacttgaattcctgcttttattgctggaggtccacatctgtggttgacctctgttattg

SEQ ID NO: 692123 - DNA, 848 bp, Homo sapiens
agcggggtaaggggtgattcagccgaggggcgcggacagacagacctcgggtcagtgcccggtgaaccccgagaggagagcccagcccctgagtggaggcaggcttgtgcggagattcggaagccgtcagcagctcaggcagacgttccagtgatcccacgcaccattgcagaagaccaggcctgtggtaagccatgttcccaccagtccagaggggaaggtgctgggaatgcagatggctgagtaggtcagattgaggacattggcagcgcaagctctggtaaaagagtgacactctggatacatggtgagaaacgggcctgcaaccgtagcatgtggaactcaggtttgatattgcacggaacacgaaagtccgtataatttgggaggttctgggtgcctgcctgcagatggggatgctacatgaatgcttctcaggatgggctcagggatggggggtgtggacatttccgtgttactgagccagcttataggaacagcgaacgtatgccctttccctgcagcacatacacctctgaagccatgcgaggggctatgtgagagccaggacgtgtgtagaacagcacgctggggccccctttatgcgccaagaggggcatgctaaggtgcgtgttgggagcggacaagtgtgaggaaggcttacaggtcgctcaaggagccacgtgtagggagggcaggtaaatgatgccagaattggtaactggtcccgctggtgctcacagggggctgtggtccaagtggtggcgcacttattgaataattgtgccccagggcgatcagggcccagtggccagggaacctataaatactgcagcaagggaggatgc

SEQ ID NO: 692124 - DNA, 155 bp, Homo sapiens
tccccgcgcaagcaacatagtctcgttcttggactcctggcccctctcccttggactctgatgaagaattgctgactgtagctctggaagttcagctctcagaaccgctatcatattccagttctaggagaataaaatcccgttgattactatca

SEQ ID NO: 692125 - DNA, 215 bp, Homo sapiens
ggatctccttggagatttggtgaaatcagctcaattgtgtcacccagcctgcagtcccaagtcctcgtgactgcggatggaccaggaatgcggcttcacatacagacatctagttaggccaggcacggtggctcacactataatcccaacactctgggaggccaaggcataaggcttgcttgagcccggaaattgaagaccagcctggacaatac

SEQ ID NO: 692126 - DNA, 490 bp, Homo sapiens
gttgataaaggtcctcgcgagaccccgtgtgttgagagcgtctcacacaatccacccttgggtcgctttgctgtttgtgatattagacacacagttgcggtgggtgtcatcaaagcagtggacaagaaggctgctggagctggcaaggtctcccagtttgcccagaaaggtcagaagggtaaatgaatattatccctaaaacccgccccccccctttttaacacagggggaagaacggtgtcagaactgtttgtttcaattggccatttaaggttaggaggtaaaggctgggtaattataaccaaggcttggtaaaccctccaaaagaaaggaaaaaggtttgggggcccccttgggttttctttttggggggtggcagttttaagtaataagttttaaaaaccggactttttaaagggaaccacctggcccaaaaattggtcccagaattttgagacccattaaaaaagttaaatgagaaaaaaaaaaa

SEQ ID NO: 692127 - DNA, 167 bp, Homo sapiens
ggagagtgtatgggtgaccagagggagagctgataggtaaaagggagacgctcctggcttgggaagcaggagtcctaggttctggtctctcagatctactgggcagcgcgatcagaggatttatctcacactgtcctaagtgttgtcagccacacgataactgctta

SEQ ID NO: 692128 - DNA, 218 bp, Homo sapiens
agctaattcttgtatttttagtggagacaggactttgccatgttgggcaggctggtctcgaactcccgacctcaagcgatccgcccaccatggccttccaaagtgctgtgattacaggcgtgagccaccgtgcttggcattatagctaacgtatttgttaattatgttttctttttttttccttttttttttttggggaggggggcacgcatcctggt

SEQ ID NO: 692129 - DNA, 680 bp, Homo sapiens
aggcttccattcgtggtggctaaccgttgggtctgtggtcgggggacggaaaaagaggataccacgctcggcgtgaacgtaatgtgataggtggagccgcatcggcatgagggtgtcttcattggtctgaggaaaggaagatgtgcactggtgtcaccgagacgtagacctggtcctgtggggaattcagtttatggagagatgagagtagtcgtcgatgtatcggaaggagattgacaatgagttgatgtaccgaggccgtggaacgcccgttccggtccaagcgtagtagtgaagcataatcctgtggtggtgtggagccagatctcagcagttcaaaacgcggagggactagaggttgctcgtacgctctgggtggcgtgcctctgggctaccgagcggtgtactcccatgtgctcttgacactcgttggctcctgtgtagtggctcgtatgctcttactgtggatgtcggtaggttcttgcgcgcacccttgctctcggccgttgatgctccattaataccttggtgcacatatgcaaaaagaggactcgatacaatcgattgcgcgtgatggaatcctgcaaggggagattgcgtccgaaacaagtcgccattgaccaatagatgaaccccgggcaattgcattcgaatcggctagaatgggatgcgagtgtgac

SEQ ID NO: 692130 - DNA, 300 bp, Homo sapiens
caggtgctcggtgtgtcatgtgtctggtgggggatgggtggactgtatgatttccaagtgactctaccagatcagtggattctgatgtcatcgggtggaggtggtgtactatacctaaaggatgactgctccagaaacagaaccagcacagaatgtatttacttctcttctgaaagttcaggctatgtagacccctcccctcctttgcaaaggtctgggatagaggagtcagatgcagatctctactgtcaaatgagctccctgatatctcctgtcttccctactgatccaaaacctaaa

SEQ ID NO: 692131 - DNA, 145 bp, Homo sapiens
  misc_feature (18)..(18): n is a, c, g, or t
  misc_feature (29)..(30): n is a, c, g, or t
ggttcacttataataatntaaataaccgnntaaatttttctgggacaaggccagcattgggatttttttaaaacacgtaaatttcttatggatggcaactaaagggggttggtagcatttttatcatacaggggtaccgagctcg

SEQ ID NO: 692132 - DNA, 439 bp, Homo sapiens
gtgacgtcatatgctatcatctattcaacaaagaagacgttgtctgtgtgcagcaaatccaaaacagacttgggtgaaatatatggtgcgtctcctcagtcaaaaaagtcaagaacatagtaaaaactgtggctattactggaatggaataggacatagcccaagaacagaaagaaccttgcagaggttggaggtttcaatatgcacatcatggagggttaagtgcttatctaatattgtgcctcactggacttgtccaattaatgaagttgattcatattgcatcatagttagcttagtataagcatcacattagagtaaaactgtatttcatgtaatatatagctagataagtaaactgtgtatagctatttaatactaattttccataaagctatttaggtttaagtgcaaaagcataataaatttagggttgaag

SEQ ID NO: 692133 - DNA, 440 bp, Homo sapiens
ctcccattcaaggacacatcttttgctgagggtgggggagttgttcatgtgacaatttcttgtacacagggatgctatcccttcccaccgatgtctggggcaggtgaccatgtgacacacagacatacagccatcctcagacaaaagtaaataaataatatacctgggctggattctctctctctctctctctctctctcacacacacacacacacacacacagaggcttgagctggaagcggagacggcatctgattaaaatacagcacacatggataataaataaaaattcataactgcacaggtgacagcagcagcccaggccacgctcacttgctcacacttcttccactcataagcacctctgatcttttcctatgggcagaaatgggatgaggggacaatggacttgggggatgaggaggaaatttaattctag

SEQ ID NO: 692134 - DNA, 360 bp, Homo sapiens
ggcttatgcggcaggagaatgttttcatgttacttatactaacataagttcttctatagggtgatagattggtccaattgggtgtgcggagttcagttatatgtcagggatattttaggtagatgggtgttgagcttgaacgctttcttaattggtggctgcctttaggcctactatgggtgttaaatttttacactactctactacaagtgttttttgcctaagtgtccaacagagctgttccatctttggactaacagattaaatttacaagcgggatctagacgcggaactgtaaatgatgccgggtaaccgagcatcggaattcgctaatcattggtcctaacttgtttccctgtg

SEQ ID NO: 692135 - DNA, 368 bp, Homo sapiens
  misc_feature (209)..(209): n is a, c, g, or t
  misc_feature (214)..(214): n is a, c, g, or t
  misc_feature (288)..(288): n is a, c, g, or t
  misc_feature (348)..(348): n is a, c, g, or t
tgtttaaacaatatgaaatctgggcaccttgaaaaaagaacaagataacagcaacgttcagggaataagagagataaccttaaactctgactgccagtgagccaggtggaacagagtcatatttctcttctttcaaaagcaaatgggagaaatatcattgaattctttttctcagcatgggaacatccctgaggaaagagaatgcgcantaggnggtaggcctctggaactgggacccccgaggtgttagccgttcttcttatgggtcgaggcttgcagagatggaantaaactcccagtctccccgttagtgcttcccagggcttattaggggaaggagggaaattncccgccttaattaaattttt

SEQ ID NO: 692136 - DNA, 820 bp, Homo sapiens
  misc_feature (693)..(693): n is a, c, g, or t
ggccgccccgtgaaggcaaggcgtttgctcccgccttcttgggtcagccgacgcgggtcggttcagacaacccgggcccagccaagggcccccggggggataagacccgtttgtgcagcgtttcccaccgcggtggccccccataaaaaggccgcggcggggttaggagcccccccttccccgccgaggcggtatggccccccctgagggcgccgccccagatcagtgctttgtcttataagcagtccctccgccgctgtgcaacacacgcgggaacagccattcgtaggtgctttctacagttacagtaatttttttaaatctcgcgccaataaaagtatttcatcggccatcataaaacatagccaaccaattctttaattagctgtcacctctcctgcaaaccaaagtaatgttctcatcatcgcacgctcgctcactcccgcactgggttgaaccacaccaccacgtcttataaacagctgctcttcacgctcattattattcacccccataaagactatctaaccccctgcacctaggccccctaatttcctcatccgcagatggcgtttgggtgcactcacctaaggctggcgccccgcaactgggttttggcgcacccccccacgatgatcgcccccactcattgtatgagtaaagaaaacaacccacaggtggtctacacccacnatgagtagatcttgtctttgtgtatgaatctcgcgatatgacgccgacgcccagcggtggttcacacggcgaatacatgtccttgctgattctatagcaaggcgcaaccccccgcccacataacaca

SEQ ID NO: 692137 - DNA, 815 bp, Homo sapiens
  misc_feature (634)..(634): n is a, c, g, or t
  misc_feature (641)..(641): n is a, c, g, or t
gagcgcgccagcgccggtagccggacgccctaggcttccgagagatcttcggtggggcgtaccgggtgttttcacgccagagacgctgaatgccgtgtgggttctccgtctgcagacccttctggacgctggtcacgacttccatatatgtaaccacaacagtagtcagacagcggccatggacctttctccagccgatggacgcatgctggcaaggactggcgggctggacgccaaaccggcaaattttcatgtatgcaaatgccgttgggccaacgggaaaggtggagtgttttccccaacgtttcttgcccatgttgcccgggtcaactaaatttcttgagcagctcgcgggagcttcttcgtggctcccgaggacaattctcgctccggtcgttttcctctgccttctgcgggcgcggaggggcggtttttcctatcaaaattaagcgagcacctgtggcagggttccgtggttacaaaggacggaacaaggccatccccgtcgtcgaagtggcagacaatgtaacccagtcttgtgtaacgtagtgaagacacgagagttcttccagaagtgatccagttcttcttgagcctcagtgaagaaatgcctcctggaatactatgagacccnggttttngaatccgtgtcggtgtataagccagcatgcaaaaatcgggtgtgggacagggctggttgtatttcaacaggtttatcttaaatactcagtagtggattttcacccgaggtattagtgtcactggcctttgcgctgaaagataacgaacaggtctagcccagtggtgaccctggg

SEQ ID NO: 692138 - DNA, 176 bp, Homo sapiens
caagggagagagaataagacaaacaggactttgtataaaataattaagtatagactaaagagatattaagaatctcaattttgctctaagattgtctcagctaattataacaatccttgcagtctttcgtggaaatactgttgccgtattacaccttggtcctttcaagaggtagt

SEQ ID NO: 692139 - DNA, 170 bp, Homo sapiens
gaagacattatcaaaaaaaataataataataagacggagaaatcccactgaaggacatgaatctcctaaaagtacccagcaaaacgaacagttcaaagacccaaaccaaggcactttctcttgaaattttagaccatcaggaacaacaatagtaaaagcttccagagaga

SEQ ID NO: 692140 - DNA, 211 bp, Homo sapiens
gttgcagtgagctgagatcctgccactgtgcccaagaatgggcgacagaccgagatcccatctcaaaaaaaaaaaaaaaaaaaaaaaatttctaaacccaatttgttgtgtgcctacaattcaaaccaaagtaaaaattgccctgttcctaccttctctgggtgtgtaagggagtacacttgcctttcaaacaagggggggatctccttct

SEQ ID NO: 692141 - DNA, 209 bp, Homo sapiens
  misc_feature (2)..(2): n is a, c, g, or t
  misc_feature (4)..(4): n is a, c, g, or t
  misc_feature (9)..(9): n is a, c, g, or t
  misc_feature (13)..(13): n is a, c, g, or t
  misc_feature (64)..(64): n is a, c, g, or t
  misc_feature (92)..(92): n is a, c, g, or t
  misc_feature (128)..(128): n is a, c, g, or t
  misc_feature (131)..(131): n is a, c, g, or t
  misc_feature (140)..(140): n is a, c, g, or t
  misc_feature (175)..(175): n is a, c, g, or t
  misc_feature (189)..(189): n is a, c, g, or t
  misc_feature (200)..(200): n is a, c, g, or t
cntnaagtntccnttggatagctgtctgagtgaccacggaacaaagtcttaacaaaactcaggnggaccaatgttatgtcaacagaacgcanttttaatctggtactcacataatcagaccatatagncgnggcactttngaaccacaagctttgctcacaaaaagagctttctnggttgtaggcccanactagactttnagcatgcat

SEQ ID NO: 692142 - DNA, 246 bp, Homo sapiens
cagatggtgcgcagcatcctgtgatcctgttcctcaacaagcaagatctgctcgctgagtaaagtccttgctggggaaatcgaagattgaggactactttccagaatttgctcgctacactactcctgaggatgctagtcccgagcccggagaggacccacgcgtgacccggaccaagtacttcattcgagatgagttcctgaggatcagcactgcccgtgaggattggtgttcctacagctaccc

SEQ ID NO: 692143 - DNA, 260 bp, Homo sapiens
atccatccagcagtgagctgagattgcaccagttgcactccagcatgggcaacaagagggaaactctgtctcacaaaaaaaacaaaaaaattaagatttaccaaaagtggattagggtcaatacttttaaacttcaatgggtttgtttttatattaccaccaaatacctaaaaattttaaaaaacacctttgaattattttcataaatcctttcatgggtgcattccctatattatatgacatgtgccccttaacaagac

SEQ ID NO: 692144 - DNA, 204 bp, Homo sapiens
tgtccgagtagcttcgttctcggattacacaagacatttttaaataatcacatcatatcaagtatcttctcagaccacaatagaataaaacaaatccataacaagaggaacttagaaactatacaaatacatggaaattaaacaacatgcacctgagtgaccactggatcaatgaaaaaaagaagagataaatttcttgaaaca

SEQ ID NO: 692145 - DNA, 292 bp, Homo sapiens
ccaacggggactggaagtgaaaccctataagacactctctattaatgataaaattgccagaaatttcctaccctgcagcaactgtctgaaaagaaatgccaagtaagggaaaagaataataactgggccaaggtgaagcacattagtacagattccatgtgggctaaacagtaagatgcaaaaaggatgtcataagggagcaactctcggacgctgtgtagagaagcatacaaagtacttagtttttgaaaaaaaatcagaaagatgataaatggagcaaaaaggaaaacac

SEQ ID NO: 692146 - DNA, 902 bp, Homo sapiens
  misc_feature (457)..(457): n is a, c, g, or t
tgcaatagctcacacctgtaatcccagcactttgagaggacagtgcagatggatcacttgaggtcaggagttcaagactagcctggcgaacatggtgaaaccccgtctccactaaaaatacaaaaaatcagccgggcatggtggtgggtgcctgtagtcccagctactcaggaggctgaggcaggagaatggtgtgaacccaggaggcggagcttgcagtgagccgagatcgcgccactgtactctagcctgggtgacagagcaagactgtctcaaaaaaaaaaaaaagggaaaatttattttgcggttttagcctcaagctgattcaggagctattttttccaagaacccatcctcttctaaagggaacaagaacaacatttgatgacaaattctagttttaccttggattcagaatgaatccctaagctctgataggtttggcatgggatctttncagggctacaatcgcgggggcatgctctaataatacgggtctctggaaacaaattaactcagcctaatcctcactcatacttaattcttccctcatgggaatggtatggcgcaaatttacttgaccttatgaattgggcaagttggtaagggctaattttccccctttagaatggaggggctccgtagaagccacagggagtttggcctcggggtcacgcagggaactcagtttccccccaggggcccatttggtgtggaaggcaagtaagcaaccttagggcagtcttcaaggcacacttcttgtggcccccgcggctataagggctcttgaaacgaaaaaaccccaaattttcccattggggaggcaccctggggggggggcaacactccaattctctcgaagtggccactttacacaggtatagcccccaagaaaagagata

SEQ ID NO: 692147 - DNA, 1087 bp, Homo sapiens
  misc_feature (373)..(373): n is a, c, g, or t
ggtagtgtggcgcggctgtgtctcgcttggggggtttttctcctctttgtgcgaggtgtggaccgcgtggtaatgttgtgtgcgctcaagcgggtctcccgggtggttggacgtccagtctctggtggtgctcccatgttgtgggtcccttgtcgccgtgggctcctcgcggttttggggccccaccccgggcgagttaaggcgcccctgcgggggctcttcctggggtgaatggtttttggcggaatcgaggccatcgcgggatttgggccaaatggtcacccagcacgcgtaccattgttggaggggattcggagagatatggcgggcaaccactgccccgaagtcacccaacgacctgcgggagccagcngccagtttcggcacaatctcgtgacatcgaggagcacacgcgcacacagcactggatcatggatgaaccaggatcaacagctggagatggtttctgtgagcatcccaggttctgaagcacatgtccggccgcgttggagaagagctggacgaccagggcatcatgctggatgccttcgccccagagatggaccacacccagtcccgcatggacggggtcctccaggaaattggcccaagtatccccccactgacgagtgagcccccgaccacatggtgtgccactcgccgtgctagtgggggtgcttctcctcgttttcactcttactattctctctttgagccccagccctccctggcacggctggtcccttaagcctggggaagccacccacagcacctttggaggctggcctcgccccctaggaggaagagggtccctcctgggtagctggaaaataagagggtcccccctggggagctgtccccactggctctcccctagagccacgtgggacccttcaggaccctgggctggaaccaccacccacctggtcctgttctcaagtgcaccttagggggtggtggaggcacgggaacaccctgagacaccaccctgtctccactttccacgttccacggagcccccaagccactttgcccctgtgccttatacacgtgcccacctggaaataaaatgtcagccttttttata

SEQ ID NO: 692148 - DNA, 408 bp, Homo sapiens
gccataccaggccaactctagagtttcattctggaaggtgagaaaagatgagcactaagcggaagtgaggccaccagcctgccagctgcagaggctctggttacagaactgagcggcacatgccatctcggagctatcaaaggaactgatttctggaggtcaccttcgaaggtgctgggatggtggcagaggggaaagggagagaaaatggaaggcgttactaccattcctttcaagtagcacaagatgtgggcactttacaaaaataaggccttaagaatatcttcggccgggcgccgtggctcacacctgtaatcctagcactttgggaggccgaggcgagcagatcacttgaggtcaggagttcgaaaccagcctggccaatgtggtgaaaccctatctctacta

SEQ ID NO: 692149 - DNA, 143 bp, Homo sapiens
tacctcgggcccgtttctccccgattgtcactgtttcgagtatgaggctgctggtctcgtttcaccatgcatttcatgtgctgtctccttgtggcctgcctgtcttgagacggaaccttccctgtgctggctcctgttgttat

SEQ ID NO: 692150 - DNA, 781 bp, Homo sapiens
  misc_feature (450)..(450): n is a, c, g, or t
  misc_feature (705)..(705): n is a, c, g, or t
gagactgacgtgtgagctgcatcgcgggaggcgcatggggggatggcgctggcgcgggcctggaacagatgtcctggttctactaccagtacctgctgtcacgggctctacatgctggagccctgggagcggacggtgtcaattccatgctggttccattgtggggatggcactatacacaggatacgtcttcatgccccagcacaatcatggcgatattgcactactttggaaatcgtacaatgaccaagatgcgaccaggatcagaggttccttggggaaagacccaccctacgaagttggaatgagaccatcagatgtgataagaaactcttctagatgtcaaataaccaacttataaagactaaaattcatgagtagaaccaggaaaatcatcctgatcattgtgtggtgtcttaattttcaattttcaaagaggctcttgtatangcagttttgtctattttaacattgtacgtcatttggtacttggatatcagtattttcttaaccttgtgtgactgtttcaatattacccccgggaaagcttttcttaatgtaactttgagtacattttaattgggcttctatttttaaaactcaaaatcattagtggggcttaagtgtcttgctatggtatgggatatacatttgctggattttttctactcttgaccaagtttggaaggacatatagattcgggnagggatgggaggggagcatttctgggactcttcaaagttttgagtgactggggcagtaggtataaatctaggttga

SEQ ID NO: 692151 - DNA, 390 bp, Homo sapiens
aaactgcgatttttctgaacacaataaactattttgaagatcttgggtggaaaaaaaaaaaaaaggaaaaaaaaaaaaaaaacaaaaaagaacaccccccggaaaaaaaaaaaaaaaaaaaaaaaaaaaaaccttgccgcccgcctgggccaagccgactttagactcgagcaagctaatgcttgcgcccccaattcaagcccactgggccaattcgcccaaaagggagccgaataacaattaactggccgccgtttaacaacgccgggacgggaaaaaccctggcgtaaccaaactaaatcgccttgcagcaaacccccttttcgcacagtttggggggggccgcgggtataaaaaaaaaacatctttcccactcgccccccccccccg

SEQ ID NO: 692152 - DNA, 443 bp, Homo sapiens
ctttcaattcatacctctatagtgggcttcccttttcgtcttcgttatcgacatcaggtggctcggcaggcttctgttcctaggagctatcccagcagtacaaacgcacgcagactcccttgtagactgatcactggccgtcatcaaagagtgtctgcatggaaccacagggctggaagacccttgaaggcaggaatccaaggaaatgtatgatgaatattggcattgccatcaaaagcagaacaggcatggaaaacttgggtgagtgggcgagacaaactcctcaccacagcagagttccatccatgcctggataatgagggagggatattgtgtccactgcagtggggaaccatgaaggacacatcaagggtgtggttggactgtggtgctccttggaggaatgaataaaaataaatagagatcctatagcgtgtctgtac

SEQ ID NO: 692153 - DNA, 542 bp, Homo sapiens
  misc_feature (195)..(195): n is a, c, g, or t
  misc_feature (205)..(205): n is a, c, g, or t
  misc_feature (247)..(247): n is a, c, g, or t
  misc_feature (430)..(430): n is a, c, g, or t
  misc_feature (436)..(436): n is a, c, g, or t
  misc_feature (450)..(450): n is a, c, g, or t
cagaaccctgcgcaccctggcttagtggcagatgtggctacctgcagctgagctgccagttcctctgagtcctcaaagaccaggccattttcttcatgtttcaccagctcatgtaaactgcagagagaaccaagggagcctgagagctgcctggagaagacaccagacccctggggtgcccacctgggctccccncccaccccangctcaagccaggctgggggttggaacagggggtgtggtttcngggagctggttcttagatttggcatctgaagggtataaaggggggtgcacatcaaaatggccaaaccgatttgaggagggagccttaaggggggtttgtaccttctgtgctggatgctcttcaaggactgaagaattatttttgcatgtttttcttaattccatggccatggaacaagtaaangcaacnccctggggactggntcagcacataaaagatgacttttctaggacaccagatttgatcccgacattcccctgagctcagctcacacgaggggctcgcacccctgaat

SEQ ID NO: 692154 - DNA, 527 bp, Homo sapiens
  misc_feature (9)..(9): n is a, c, g, or t
cctcccggntgggatataataaaaagagaagatgtttctgaaaaagcataggacaccattataaagtagatctcatatgacccaccagtttaatattatctgcgggtatatgtgtggaaatgagagaaaaaacattcacacagaaacaaatatcccattattgcgaaatctttaatacaccataaaaggaaaatggggaacgccaaagggcccgggtcggaaattccgggggacacaataataaaaagatcgcgagacagaaaaaacactttttttttttttttttttttctctctctctctctctccttccttctccttccttccttccttttttcccggtttcggttttttccttccttggttggttttttttttttttggttctggccttttggttttttccttggttggtttttttttttttttttttcttttttttcgttttttggttcttggcctcctctctcttctctgtctctctctctctctctctctctctctctctctcccttctgtcgtcttctc

SEQ ID NO: 692155 - DNA, 272 bp, Homo sapiens
gcgggacaatcactatggggctgtaaggccgtatgatagcctaaactagtccagaagtctagagatagaaatgaagattgacacagaggtccagatgcattccgtaatgagaatagtaaaaggatacaacaactgctgcttaggatatcaccggaaggcgatagtagacccagcaagaaggaatagcagacaatacgcgtgaaagaaatatacgtataagtggcactcttaaaatggtgacatctacaatcatcagaagatcgcaacagcat

SEQ ID NO: 692156 - DNA, 453 bp, Homo sapiens
  misc_feature (55)..(55): n is a, c, g, or t
  misc_feature (252)..(252): n is a, c, g, or t
  misc_feature (400)..(400): n is a, c, g, or t
  misc_feature (426)..(426): n is a, c, g, or t
gtgggaggtgcctaaaaccacaacgctaatgttatgttaatggcattatagtganctgggtcaaattaaggacatttaggttgatttgttgcacctgtgcctaagttgagaccgtccctgctgagcaacatcctggcataagggcaagttcttaaccacatttcttcctgttagctgcagaggcggggtaggtgctgtcctgcagttgttcctgtgaacattgttcctttctgtcccttctccctagacccnccatctctatctgcctatccagcccctaactcctctctcagtgctttccctccagtacataccccatatttttaattttcaagtgtgcaattttcacattaataaattcgttaagaaagaatgccagggaatgattcagatagtcatnaacacactgcagctgagtccagactncggctactttcttccctcttctggttt

SEQ ID NO: 692157 - DNA, 323 bp, Homo sapiens
cccgaattaacctgactcatatagatccaccagacagcccagcctcccaaagtgctgggattacagagcatgagatcaccgtgcccagccagactagatatattatatatctaactatccttcaatttgggtttgtctgatattttctcatgattaaattcaggttatatatttatggcaagaacaccatagcacaatcatgttgtgctcatctcagtgccttatatcacgaaggtacactgatgtcaaacagtcttctttaacatcttgactgtaaaccactgatcacactcgttgatcatggtgtcatgccaacatttctt

SEQ ID NO: 692158 - DNA, 712 bp, Homo sapiens
gttcgcttctctgctgaacctctcatcgtcgaccgctgccagacgcacgccagctgccacaacatgtctacacggtccaatctgcatgccactgcgcactcaatcgaaagacttcatccagacacacgacactcaacgcaagattgacagcaggcggacactacatgcctgccgaaacacaagtccgaacgacgcatgcgaaggcgaaggacccagccacagaaaacacccgacacgaacataaacaaccaaccgcgggaccaaaacccaccctgcgacaacacgacacaactcatcaaaccgagcacagaagacgacacagcacacaaaagcctccaaagacaagaaacaaacaaaggcgagcgaaacaacactacagcacaaacgcagggaacaaaaacgaagaaaaaaagaaggaagacgagccaaactaaccacaaaacacacacacaacccccccaccaacgaagaagcgaccacagccgagcaaaacacaaccaggggacaccaacaaaaccaaacgcaccccagaaaaaaaaccttcctaacaaaaacacacgcgaccagcatacaaaaacgccaacaaaaaataccacaccaaaaaaacaaagacgaacaaacccacacaaagacaacaaaaccgcaccacacagagaaaacaacaagccacaccaccacaaggacaaaaagcccacacacaacacaaaaccaa

SEQ ID NO: 692159 - DNA, 269 bp, Homo sapiens
ggagctcggctacccctggtagactaactaaaagacacagaaagattacttccaaaaggtacagagaatttcaagtgttcaattcttgaaacatctccatttaacacctgacacataatccaaaggagagcaggctgaagtgcgggtaaaagaactagtcctgagtttactacagtcattgctatggtggcgcatggagactggttacactaaaatccactctcactgtggctgaacctttccatgataaaatggttaggtctacctgg

SEQ ID NO: 692160 - DNA, 176 bp, Homo sapiens
tttactatatattaaattatataaaatagagatggggtcttgccatgttgccaaggctggtctcaaactcctgggctcaagcgttcctcccatctcagcctcccaaagtgctgtaatcctggcctgtccagaagttgtttttttttttgaagtcagttaccagctttaaaaaaaaa

SEQ ID NO: 692161 - DNA, 427 bp, Homo sapiens
  misc_feature (28)..(28): n is a, c, g, or t
  misc_feature (55)..(55): n is a, c, g, or t
  misc_feature (78)..(78): n is a, c, g, or t
  misc_feature (140)..(140): n is a, c, g, or t
taaagcccccccctgaagtaaactgggnaacctaaaaggtgtgcggcccacccangcccccgacctaatttttgtaantttgaaagtaagaagaatggggaagtttcaccccatgttggcccccggctggtcctcgaaantccctgacccctggtgatttgccccgcccttggccctccccaaagtgcctgggattaacaggccgtgagtcacccacaccctggccccatggtgggggatatgttttaagacccccagttaatgcctgaaaccgctgctagtaccaaaccctaatgttttttcctgtatgtacgtacatatgataaagttcagtttataagttaggcacagtaagagactaacaacagctcacagcaaaatagagcaattataacaatatattgtaataaaaattatgtgaatgtga

SEQ ID NO: 692162 - DNA, 312 bp, Homo sapiens
tccacccgtcttggcctcccaaagtgctggaattacaggctctagccactgcgcccagtcttattttttaatattgccatatctgaaatacggactggaagatttctgcaccagtcctagcgtgtgtggatgtgcattgaaccctgttggtgaatttttcttgccttggagaaggaccctaaacagtttcctatatagctctcctgtctgcgcttggttgcattcctgtcgtctgtgattcccgcacatatcgtttggagcatcttcgtaaccctgacgtccagtcatcactatcagatgggtaccgagctc

SEQ ID NO: 692163 - DNA, 238 bp, Homo sapiens
  misc_feature (199)..(199): n is a, c, g, or t
gccaagtcatcatgacactttgtatgtggaaggattatgaccacatcatattccaccagaagactttgatggccctccggaaactttgctatgccccgggctctccagaacatatcctctttacttgcttcaaggcttttggcaaggtcatccctacttgaccgggaagtttaattgcattgcttcccgttccccattnccaacggttcaatggggacctcacctccctttagaaaac

SEQ ID NO: 692164 - DNA, 267 bp, Homo sapiens
ttttccgggtttttttccccccccggggccaaaaaaggggtttttaaaaaaatccccccccccaaaatttttttgggggctggggtttccccccgggggcccccccccccccggggggggggggtttttttttttttgggtttttttgggggggggggttttttcttttcccccccctttgggtttttttttttttttttttccccttccgggggtcccgggccaggggcccgttttttttttttttttggggggggggtttgttta

SEQ ID NO: 692165 - DNA, 707 bp, Homo sapiens
ggccactgcgcagaccagacttcgctcgtactcgtgcgcctcgcttcgctttctccgcacatttgacaaccgatatggctgaaacgaaatcgaatcgaaactgaagaagacagagacgcgagaaaatccactgccttccaaagaaacgattgaacaggagagcagcggcgaatcgtaatgaggcgtgcgccgcatatgcactgtacatccacaagcatgccttcttatttacttcttttagctgttaacttgtagatgcaagaggttggatcagttaatgactgtgctgcccctttcactcaaagaactactgacaacgaaggcccgcctgcctttcccatctgtctatctatctggctggcaggaaggaaagaacttgcatgtgtgaaggaagaagtggggtggaaaagtggggtgggacgagtgaactaagtaaaccaactggccggtgtcctgcgcttatcgttatcaagtgctttttttgtcatattatatgatccatttttattgcataagttaaattaaaaaaaagggcgccaaaattctcaggccgttacttccgttcgtcaggcctggagcattagtgagcggttacatcgagaacgctgctgagactctggtgcttgcacacatagcagatattaggtggaagtcgtgatgcgttgatgactattattgtagatctagagtcgcatcgcgaagcaccc

SEQ ID NO: 692166 - DNA, 431 bp, Homo sapiens
tagaggattccccgtcgggtagctgtgactaatgtggtgccaacttactaagctaataagatataagacatataattagtttacaaagttatgtattttcttctttgtgcatttatttaatcaaaataaaaaaagtttataatacacaccctagagagaaaagtggctacttacaccagtcaccaattccaaataagtaggtttttttccgtttttattgtttcttttcaacaactgtcatcactggtaattacctgcacacagtttttcagggaaagaaaccaaaattggaattggcaaaggaggcccaccaggatggccatatcataggaggatgttttccaggggcaagagggacagctacatcaaacttgctcctttattgtactttccctccacctttcttttccttaaactgttagacaaagcca

SEQ ID NO: 692167 - DNA, 814 bp, Homo sapiens
  misc_feature (2)..(2): n is a, c, g, or t
  misc_feature (69)..(69): n is a, c, g, or t
  misc_feature (73)..(73): n is a, c, g, or t
  misc_feature (75)..(76): n is a, c, g, or t
  misc_feature (79)..(79): n is a, c, g, or t
  misc_feature (91)..(91): n is a, c, g, or t
  misc_feature (103)..(103): n is a, c, g, or t
  misc_feature (108)..(108): n is a, c, g, or t
  misc_feature (112)..(112): n is a, c, g, or t
  misc_feature (116)..(116): n is a, c, g, or t
  misc_feature (138)..(138): n is a, c, g, or t
  misc_feature (165)..(165): n is a, c, g, or t
  misc_feature (208)..(208): n is a, c, g, or t
  misc_feature (210)..(210): n is a, c, g, or t
  misc_feature (239)..(239): n is a, c, g, or t
  misc_feature (382)..(382): n is a, c, g, or t
  misc_feature (429)..(429): n is a, c, g, or t
  misc_feature (462)..(462): n is a, c, g, or t
  misc_feature (517)..(517): n is a, c, g, or t
  misc_feature (534)..(534): n is a, c, g, or t
  misc_feature (621)..(621): n is a, c, g, or t
  misc_feature (635)..(635): n is a, c, g, or t
  misc_feature (654)..(654): n is a, c, g, or t
  misc_feature (674)..(675): n is a, c, g, or t
  misc_feature (687)..(687): n is a, c, g, or t
  misc_feature (723)..(723): n is a, c, g, or t
  misc_feature (731)..(731): n is a, c, g, or t
  misc_feature (740)..(740): n is a, c, g, or t
  misc_feature (787)..(787): n is a, c, g, or t
tngttatggatatcaataagtcaattttattgcagagtaacaagtattccatggtaatacataaacaanaatnannatnaaccacctaaanaaggataaaaanaaagnctanaagnttcccccattacaaataaagcngctatgaacattcgtatacaggttttngtgggatggggagggttcatttctctgggataaatgctcagangngcaattcctgaagcatgacatatacatgngtggttttacaagaaactgccaaattatattccagagtggctgtaccattttacattcccagcaatgtatgagatcctgtttctcttcatccttgccagcagttaccaccattaaaaaaaaaagttaagctattctgataggngatatctcacgattttactctgcatttccctcatgcctaatgatgtngaacatcttttcatttgcttatttgctatctanacttcagggaaatgtctgtcttttgcttattttctaattgtatttacttattacngttaaatttggaaagtnctttatggagtttacatacaaatcccttgttggatatgatttgcaaatattttttcccaacctgtaatatcatctttgtaaaaaggnctcttacggggggnattatcttaattttgatgnggtccaatttaacatttttnntccttctaaggngcatgcttttgaatcatctgagccttcttagctcantcctaggncctgaagtngttggtttactgcctatggatatccaattactccaacagtatttgcngaaaaggcgatccctcctccattaaaa

SEQ ID NO: 692168 - DNA, 394 bp, Homo sapiens
  misc_feature (320)..(320): n is a, c, g, or t
  misc_feature (322)..(322): n is a, c, g, or t
aggaagtgggtccttgcctatcctcacgggtggccagagatggaaagaaaatcccatcctataagtggaccccataaacttcaaacctgtgatgcctcaagggtcaactctgtaataaaaaatgtgcgtgtatgcgcatgttctcactcataggtgggaactgaacaatgagaacacatggacacagggtggggaacatcacacaccggggactgcccgggggtcagggaagcggggagggatagcattaggagatatacctaacgcaaatggcaagttaacgggtgtagcacaccaacatgtatacatatgtaacaagncnctacgttgtgcacatgtactctataacttaaagtaaaataataataaaaaataaataaataaataaaaaaaa

SEQ ID NO: 692169 - DNA, 139 bp, Homo sapiens
ggcgacgagtgtggtgagcagcggagtgttatatgtatgttcaaactgtcattgtatctgtacgctgttcgatatggcgagtcgtgagattgaggtggagtagattaggcgtaggcagaagtagaggttaaggagggcg

SEQ ID NO: 692170 - DNA, 371 bp, Homo sapiens
  misc_feature (37)..(37): n is a, c, g, or t
tcaggggctctaagatagtaccgtgtctctttgtgcnctgcacctctgggcgccctgcctgctctcttgaaactggttcctgactgtgacttaattacaagtattaaaataaaattaacagtatacaaggtaatacctcataggaagtttagattacattcatactattgtttcatcttgctataaaaagttactttaaactatttcttttgtatataaatgaaaaaagatatgaatatttggtcaactggttatattgctaggcacagacgtcttcaactgcaaagtatataatatagagattatgttcttacccactactcatctggatgcacggggagcctcgctggggtcataatggtaagcctttg

SEQ ID NO: 692171 - DNA, 158 bp, Homo sapiens
ttagaggtctgtgtggagagggtctaggaaagtgcaggcagggagagagggcgaattccatccactggggagctctggggggccttgttgtggaggcccttgtatgtgaaagccgcaggaatacttgttacggttgtgtcacggtgaattggttaccc

SEQ ID NO: 692172 - DNA, 124 bp, Homo sapiens
gtagttgtatgtgtgctattgatgtgatacctatagattatatgactgtgatgatgtgatggtggtatggtgtgatgacagtggtatgggatgggatgatggtatggtagggtacgagctcgaa

SEQ ID NO: 692173 - DNA, 563 bp, Homo sapiens
  misc_feature (236)..(236): n is a, c, g, or t
agctcccaacacttcatcgtcacccccactgctgtccagggtgccaatgtccatatgatcatgggactctccaagctcaatctccaggccaggtttctcctacaactcagactgaaggtccaactccctactaacacctgcaaggaacggcttaatgagaaaaccaactttccagcccaggctcctgcctctctctcccttaccataagcacatcagtcttatctaggttcctggnggatatcacacccaaaatttcccacttcagggcctttgcatgtgctgtcctctcagcatgggagactctgtcccccaatttgtctcaaagctagctgcctctcacattccaaagattagctgaagtgagttagaaaagtcaaaggggagagatatatacacctattgtgtacccacaacattttaaagtaaaaaataaaaacaaagggaagataaaccagaaaaagggacatcaaaaagaggtgaagagcctctttcagtgaacagtgaacagtgtcggcaactgcaggggcaaggagaagccaagagcagggcagagagaggccat

SEQ ID NO: 692174 - DNA, 522 bp, Homo sapiens
gaattcctatgatcatagtgctggtcaagtcaatcatcgggccgagatctatcgtacaggtcagtagtgaacgtgcaaggcgctactcaacaccggcctacgtatgagttaatggaaaatccagatttcgagggcaaggtagatgatctctatcctctacagtcagacctgtcagtctgctctctgggccatggagcgtctacaacaaagatgtgcatgtgtgagggcctttgcatgtgctgtcctctcagcatgggagactctgtcccccaatttgtctcaaagctagctgcctctcacattccaaagattagctgaagtgagttagaaaagtcaaaggggagagatatatacacctattgtgtacccacaacattttaaagtaaaaaataaaaacaaagggaagataaaccagaaaaagggacatcaaaaagaggtgaagagcctctttcagtgaacagtgaacagtgtcggcaactgcaggggcaaggagaagccaagagcagggcagagagaggccat

SEQ ID NO: 692175 - DNA, 145 bp, Homo sapiens
ggacttcggaatcaccacggatacaattgagatattctggtatccacatcatcacagctgtccatgatgacacacacggcggacataagagttagcatgtatgtctttgtacttcttgttctcaacaaaggtcaaatgggagccc

SEQ ID NO: 692176 - DNA, 172 bp, Homo sapiens
gtgaaatacgttgaagcctgactctacaaacaatgatgctccgtagatgccgacagaaatgcccaatggagacgcgatgtactctgatgctagtatgagggtaaaatagagacctattaaactattgataaccaatgctagaaatatctgggatccgatgaatactattaga

SEQ ID NO: 692177 - DNA, 321 bp, Homo sapiens
  misc_feature (281)..(281): n is a, c, g, or t
  misc_feature (298)..(298): n is a, c, g, or t
  misc_feature (318)..(318): n is a, c, g, or t
caaaatagtggcatttaactcatatatgaccttcctttaggaaggcttgactggtaagggaaaaactcctccagtgaacacgtgcacaacttcagtaaaaacactgcacatgcgtcccctcccaagtgctggcaggccactgtgcatgcagacagcccgccccaaagaaaaatcagaggaggagaaatgggaaaccccgggaacaatgccaatgtattaaaaccccaagttcaagggcctaccaagggcaattgggatctctcaagttcacccgcttgggntctctttcaagtggcanttttgctttcctttttgttnttt

SEQ ID NO: 692178 - DNA, 222 bp, Homo sapiens
acgatctctgcaggatcccccttcgttatttgcaaacggcttctctgctgttccccgtgtgggtgtggctaggctactgcgtcttgaagcgtgcattgctgcgtgctctatgcttgtcccttttcgactcgtggtgatttacgcgtgtgaactcactggaacgggtatgcttgcctttgtaatcttactaatagctaatagaaaggctaggaccaaacctat

SEQ ID NO: 692179 - DNA, 404 bp, Homo sapiens
  misc_feature (194)..(194): n is a, c, g, or t
gagcccaccgcaacctggtggaaccacattgatcttgagcaaagttgttttactcctcgatttgtcccatattaaagagtaaagtgagttaggccaggtgcggtggctcatgcttgtggttccaacactttgggaggctgaggcaggaagattgcttgagcctgggagttcgagaccagcttgggcaacatagngagaccgccccccctaccccgccccacctcccgctccccggctccatctctacaaaaaataagaaaattagctgggtgttgtggtgcatgcctgtagtctcagctactcaggaggctgaggcgggaggatcacatgagccgaggagtttgagattacagtgaactatgattgcagcctgggcaacacagcaagaccctgtctctataaaa

SEQ ID NO: 692180 - DNA, 355 bp, Homo sapiens
ccccgtctgtgggaaaacatttaaaaatgaaggccgggcgcggtcgtcacgcctgtcatcccagcacttccggaggccggggagggcggatcacctgaggtcgggagttcgaaaccagcccgatcgacatggagaagccccgtctccactaaaaatacgaaatcagccagacgtggcagcgcatgcccgcaatcccggctactcaggaggccgatgcaggagaatcgcttgaaaccgggaggcagaggttgcggtgagccaagatcgcgccaccgcactgcagtctaggccacgagagtgaaactctgtctcgggggaaaaaaaaacaattaaaaacggtgtgggcacatgtggc

SEQ ID NO: 692181 - DNA, 210 bp, Homo sapiens
ctgaactcgtcactggcaacatgatcagacttcggtcgctcgcgtaagctgctccagcaactgggtgggaagattccggatcagcagagttttattttctgcatcaaattcaagcttattcccgagcaagtgctgctcaaagctaatagacaacccctcgaaacggccgctgaatcgttggatctgttcagaccttttgctgctggtccg

SEQ ID NO: 692182 - DNA, 329 bp, Homo sapiens
agagatgcagaactctacagagaaacatcttcagtgggtgactgtttgagggatagttcctactaaggtcgctggaaagggctcccagaggaattggcgttgaggtgaaggttgatatgaagccagtaccaggatggtctgcggtgagatgcaggctgagagagcagctacgtgcaatgctgattgccgactacagtggctggcttcagggcaatgatgaatagagtgaaggtgtcagggcctcagtagagtgagacccgggagagtgggaggtgatggggccttgttcgccacagatttaactccgtacttcatgaatgggacgttaa

SEQ ID NO: 692183 - DNA, 361 bp, Homo sapiens
acgtgatgcagaagggctctcgtgcgacttcctcaaacacagatttgatgccaggatctccatcacccgagtcacagccgaactctccctggcaaagcgatctgtgctcaacaattccgggcaagaggaccatcattgagcgctccactggcagctccagcattgcggaagtgcagagtgagatcgagcgcatatttaagctggccaaatccctgctgctagtagtgttggacgctgacaccatcaaccacccagcacagttggcccagagacctcacatggcccccaacatcgtctttgtcaaagtttcctcaccaaaggtactccagcgtctcattcgctcccgtggtaattcacatat

SEQ ID NO: 692184 - DNA, 849 bp, Homo sapiens
  misc_feature (41)..(41): n is a, c, g, or t
  misc_feature (70)..(70): n is a, c, g, or t
  misc_feature (74)..(74): n is a, c, g, or t
  misc_feature (86)..(86): n is a, c, g, or t
  misc_feature (92)..(92): n is a, c, g, or t
  misc_feature (132)..(132): n is a, c, g, or t
  misc_feature (155)..(155): n is a, c, g, or t
  misc_feature (157)..(157): n is a, c, g, or t
  misc_feature (172)..(172): n is a, c, g, or t
  misc_feature (176)..(176): n is a, c, g, or t
  misc_feature (196)..(196): n is a, c, g, or t
  misc_feature (219)..(219): n is a, c, g, or t
  misc_feature (239)..(239): n is a, c, g, or t
  misc_feature (241)..(241): n is a, c, g, or t
  misc_feature (263)..(263): n is a, c, g, or t
  misc_feature (268)..(268): n is a, c, g, or t
  misc_feature (277)..(278): n is a, c, g, or t
  misc_feature (284)..(284): n is a, c, g, or t
  misc_feature (293)..(294): n is a, c, g, or t
  misc_feature (300)..(300): n is a, c, g, or t
  misc_feature (331)..(331): n is a, c, g, or t
  misc_feature (338)..(338): n is a, c, g, or t
  misc_feature (349)..(349): n is a, c, g, or t
  misc_feature (357)..(357): n is a, c, g, or t
  misc_feature (361)..(361): n is a, c, g, or t
  misc_feature (404)..(404): n is a, c, g, or t
  misc_feature (410)..(410): n is a, c, g, or t
  misc_feature (416)..(416): n is a, c, g, or t
  misc_feature (444)..(444): n is a, c, g, or t
  misc_feature (461)..(461): n is a, c, g, or t
  misc_feature (482)..(482): n is a, c, g, or t
  misc_feature (485)..(485): n is a, c, g, or t
  misc_feature (489)..(489): n is a, c, g, or t
  misc_feature (503)..(504): n is a, c, g, or t
  misc_feature (507)..(507): n is a, c, g, or t
  misc_feature (511)..(511): n is a, c, g, or t
  misc_feature (523)..(523): n is a, c, g, or t
  misc_feature (536)..(537): n is a, c, g, or t
  misc_feature (547)..(547): n is a, c, g, or t
  misc_feature (554)..(554): n is a, c, g, or t
  misc_feature (564)..(564): n is a, c, g, or t
  misc_feature (573)..(573): n is a, c, g, or t
  misc_feature (600)..(600): n is a, c, g, or t
  misc_feature (619)..(619): n is a, c, g, or t
  misc_feature (621)..(621): n is a, c, g, or t
  misc_feature (623)..(623): n is a, c, g, or t
  misc_feature (637)..(637): n is a, c, g, or t
  misc_feature (641)..(641): n is a, c, g, or t
  misc_feature (643)..(643): n is a, c, g, or t
  misc_feature (649)..(649): n is a, c, g, or t
  misc_feature (653)..(653): n is a, c, g, or t
  misc_feature (658)..(659): n is a, c, g, or t
  misc_feature (661)..(661): n is a, c, g, or t
  misc_feature (670)..(672): n is a, c, g, or t
  misc_feature (674)..(674): n is a, c, g, or t
  misc_feature (676)..(676): n is a, c, g, or t
  misc_feature (679)..(679): n is a, c, g, or t
  misc_feature (684)..(684): n is a, c, g, or t
  misc_feature (690)..(690): n is a, c, g, or t
  misc_feature (693)..(693): n is a, c, g, or t
  misc_feature (696)..(696): n is a, c, g, or t
  misc_feature (698)..(698): n is a, c, g, or t
  misc_feature (700)..(700): n is a, c, g, or t
  misc_feature (729)..(729): n is a, c, g, or t
  misc_feature (788)..(788): n is a, c, g, or t
  misc_feature (848)..(848): n is a, c, g, or t
tggggagagggggtgaaaaaaataaggattaaaatgtaaantaaagaaaataggatgaaaaaggattttnaaanttttgaaaaaanataaanagtatgaaatgggaaaaaaaaaaataaaaaaaaaaaatantaaaataaaaagagaaggaaaananaaatgtgtaaaaaanagtnaaaaagatgaaaaaaaattnagtaaatggaaaataaaaaaaanattaaaaggaataggatggnanaagtagagataaagaatgtaanaaaanaaatttagnnaaaagnaaaagggannattgantagaaaaaaggtggtaaaagataaaatgganatgtaanaaaaaaaaatnaaataaanaatnaggtaaaaaaaaaaaaaaatgatttaaaaaaaaaaaaaaaaanaataanggatanaaaattaaatagaataaaaataaaaatnaaaaaaagtataaaaangataaaaaaaaaaaaaaaaanaanaaanaaaatataaaaaanngantatnaaaaaaaaaaanaaaaaaaaaaatnnaaaaattatngtataangatgggaggnaggaaaaangtaaaaatagtgtattataaaatattntaagaagaataaagatttngnanaaataaatttgagntaangntagatntgcngcccnncngaatttgtnnnantnttnagganagagtnagntgnantntttatttaattaatagtatttgtaagggntaggaaaagagtgggaaagtgggatggagaattaattttggggaggatggttatgaagntgaaaatgtgtggaatagggggaatagagagtgtaaaatgtatattaaaaaaattgagtna

SEQ ID NO: 692185 - DNA, 680 bp, Homo sapiens
  misc_feature (32)..(32): n is a, c, g, or t
  misc_feature (473)..(473): n is a, c, g, or t
ccccgcgtccgttttttaaattttgtaggcantattttcaccccatagaatttaaaagggggccggtaggagaaacacagctcgtttggaaggggaaggtctcctttaatagatttttaagaacacgcaagggtttggaaatagaaccctaggccccctccccagtgtgggtggggttagaattaaaaacagtgtgggtgcagtagcataaagggccctaaaaattccccttgccccgtaggggatggtgaaaccatccccaaaggtgttgccccttgacctctagtggggaggttttaaaaaactgggcccttcatgagaaattccaaattccaaaggattttcccttttggggtatcagcataaactggaatggagggtccaaggaaaccggggcctggtttggttatgttttttttttttattccaaaaaaaagacccagggaaaaccttttgtagttcctcaaaaaacnggcctttttccccccaaaaccaaaggggaagtttttttttttttatgggccccctccccggggctcctggatttaaaaagggatggggatggtaaaaactctttttttatccaaagtttccagccctttttttttttttatgccttgtttgttttttacaaaaaaaaaaagtttttttgattgaataaagccaaaaaccccggggga

SEQ ID NO: 692186 - DNA, 138 bp, Homo sapiens
agagatccgaaaaaacctcccgacattctctcctcgctgaacactgtacacgataaagagtagaactgcagaagttgtatgtttgttgaacctatgttatgattggcatgacttatgcatcggttgacaacatgaaac

SEQ ID NO: 692187 - DNA, 223 bp, Homo sapiens
cattttcccctgcgcatcctctcgatgctgcccaaggagttgctgcagttctggaccctcatctggactgggatctcccacggggcctccatggcttcagtccccacctggccctgacgcacgccagcccttcttaccccaccccggacctgccgtgcacggacgcaacggtctgcccgacccactgtcactgctctacccccacgggtcgactctcagcttc

SEQ ID NO: 692188 - DNA, 872 bp, Homo sapiens
cctgacagagtgtgttgcccctatgacccaataggcaacgcaatggccccaaaaaaaacgcggtaaaaagcgctgacagtatagaaccctccgaaagggagcccgccccctcaagacgtagctgcttggaaggccagcgtgcaccaaggggtggccccttcaaactatatgagaggggttcaaaacagcgaaaatcaccgcgacatggaaacaaattaataacggcggggagaagttctaccccgtggttgggagccccacgccaggatcaccccagtcatggccggcaatgggtcacaaattcctttgcaaagccacggggtagaagaataataagggtggccgacgatgataaagtttggccccccctattgcccccttcttactttagtttccccccgagatcaaaaatgggtgtgcggtgaatgttatcttgcaagcatcttttactgtgggcttacagtgcgtgaaatattcatacgacgttcttgccagacccctttgcctccttatgtacacaacgtacaagaaaggggacccactccctgttgaccaagatcgtggcaccgacgctgaacccgtcacaatggactctgagtagtgatgattctccaaactcagtacctcctagctatagcgtacacatatttacggcggtgtgtcatcagccgccccacttctgaggaaccacaagactgttgagagcctgtacttctacatgggacgagtatgtcatttcgcccacacataaaaaagagggtcacagcagaccggcaagaaaacaccccacaagtttcctggaaaataatatgcagtgtccaccacccaagaaaaaaactttaaaaaaaaaaccccaacattataacaaaaca

SEQ ID NO: 692189 - DNA, 570 bp, Homo sapiens
  misc_feature (9)..(10): n is a, c, g, or t
  misc_feature (75)..(75): n is a, c, g, or t
  misc_feature (422)..(422): n is a, c, g, or t
  misc_feature (461)..(461): n is a, c, g, or t
  misc_feature (481)..(481): n is a, c, g, or t
  misc_feature (519)..(519): n is a, c, g, or t
  misc_feature (525)..(525): n is a, c, g, or t
  misc_feature (546)..(546): n is a, c, g, or t
  misc_feature (562)..(562): n is a, c, g, or t
tgagagagnnagagtcttgctctatggcccaggttagagtgaagtggtgtgatctcagctcactgcaacctctgnctaccgggttcaaacaattctcctgcctcagcctcctgagtagctgggactacagttgctcgccaccatgcccagctaatttttgtattttcagtagagacgggatttcaccacattgaccaggcgaactcctgacctcaagtgatccgcccgcctcagcctcccaaagtgctgggattacaggtgtgagccaccacacctggccatcatcccctacaacttttacgttgctaaattaaatgttctttaactttgattccctctactcatgcagcaaatttactccacagacgctcatgaagtgccaactatatgccagtgaccccatccattctcttaccttcccnaatgtgattacccatattcttccaggtcgacgcgggcgnaatttagtagtagtagtganccggaattccgaccggtactgcagcgtaacagtttccnatgtgntcgtattgagttggggtaacngggcaagcggttccgngtgaatgt

SEQ ID NO: 692190 - DNA, 241 bp, Homo sapiens
aacacaaaagcggtggttaccgctggaatatgagaaaaatcatttcgggtttagtggttacatataagtataagaggatgtacatgtacttaaactggcttttgtatatatgtataaatgctggtgatggcgaaagtagtcttgtttggtgaggatgtctgcattaaagcagtaaaataagcttcctattttattcataatctaatgtatgtgtatatatgtatgtgtccgcttttgtgtt

SEQ ID NO: 692191 - DNA, 2001 bp, Homo sapiens
  misc_feature (65)..(65): n is a, c, g, or t
  misc_feature (67)..(67): n is a, c, g, or t
  misc_feature (74)..(74): n is a, c, g, or t
  misc_feature (79)..(79): n is a, c, g, or t
  misc_feature (90)..(90): n is a, c, g, or t
  misc_feature (97)..(97): n is a, c, g, or t
  misc_feature (101)..(101): n is a, c, g, or t
  misc_feature (958)..(958): n is a, c, g, or t
  misc_feature (1221)..(1221): n is a, c, g, or t
  misc_feature (1446)..(1446): n is a, c, g, or t
gaggcaataggacatatgaaagaaggtgaagaagaaaagacaaagacctacagtgcttatttggncnaataaancgatncagaagaaagncattganttcntaaatgacataaaggacttaaaaatcgaccagaaaacacctttgcgcgtccttcaccgaagcccctggctgtgcgagctcgcgtcattcacttcatggagacacagtacgtggatgagcaccacttccgcctccacttgaaaactcaggctggcacctacattaaagagtttgtacatggagacttcgggagaaccaagccaaacattgggtccctgatgaatgtgactgcagacattctggagctggatgttgagtctgtagatgttgactggccacctgctctggatgactagctttcaaatttggagacaaagagtatggttttcctggcatgatgtggacatccatggagcacatgccgtaaaatggctgtttacccaccataacggtgtcttgaaaactatttggatcatgttgatctatataattgttaatttgttgtaacatctcaggatctatatatgtgtatattttgtgttaaattgttccaaggatgtcttaggatttttctcattccctctttcacccccacaaaccaaactatgaataatgaaataattctccttaattctttcatttagagaggtgcacaaacaggacacattctctgttaacctaagaagctgtaatttcagcaagatttccctccacaagagatataccacctttaaaatcatgttctaatttttgtaaattatctgaataaaagttatatctagatttatgcagcataatatcctataatagtctaagattgcaaatgcaaatctgacatcattattttccccaggaagcctcaaacaagctattaccatgaagttcttttggctgtgatttgtcataaatcttaaccanactatgaataatgaaataattctcattaatactttcattaagaaagaattttgacaatctaaaattgtcaatataggtttcctgtggagggaaagtaaaaccgtaggagccaaggcatgccatggtaggagcctttcataaaatcttttaaataaggagaaacaagtgcctttaataacttcaatcccagggttaagaatttgaaaaattgagattgctaaacaaagacgaactggtattatttcagaatgcttcaatatatnatccaattataaacattttaataataccttattaaagtagataggatattgtctccattttataaatatggaaaccaaagactagaagttaaatgacttatccaaaattgttagctacttctatattgaggactagaactgaagtttcttggtttctagggtctttctaataagccctattactgagcacctgtttgtgtgaaggggcagctatggatgccattnaaactcatgtaactgataattaacttttggaatgtagttaccaaatcaaagagcttaccaaaaaatagcccaagactatttaatacaatcttatatagttaccatttgttattaagttaaacctcagttggtattatgaagaggaaaaacattaagctaaacctaaaaaaaaatgaatgggtcactttaagtttcagaaaggagcctcattacaatttcagatatgagtataatttccatccaccctaattcaataatttgagctatatatacgaaatacatgtgactttgactaatatcagaattcctaaaacattttcccatctcatatattaaacataaattcacagaataccaagaattcacctttagatatgacagaaaaggtttaaatggacacaaaaggagtatgccaagatgagaaccaaaaagttaaatacacaagttgaaaacaagtgagaagatatgcaaataatagcaaaataatattcatactagaaatgcacagacatttaaaggccaaaaatagaaaaacgaataaaatttgaataaaag

SEQ ID NO: 692192 - DNA, 899 bp, Homo sapiens
cagctttgtagccgctgtgtccaccgggttcgcgagactataggtcggggctctatataggccctggtttggtccccgctccgcgttgtcgggtgttttcccgggcgcacggcgaaaaaatggggtgttgaccacaaacatggctgttggctacccctttagtctgggaaacttgtcaccgttgtatggtcccgcccactattggggggtgcgcaccactcaccgcgcgtttttttccctggcatatcccacggcacctctttttttttgggtggcccccccctacaccccagtctgtgccatctatggtctgtccgcaagtcatccgggtccgccacaccaactacgtccgtatctcttggtgaattggaacccctccctgcagagcccccacgcggggcgtttccaaaaccgctgctacgtaacaattgcgggagataatcacggtgtctgatctcccccctatggggtgtttcttcctatacgcaccagtgctacacgcacactcagtcgaagattaggcccctgttgccgagaagcggttcccagcactttttcggccacagttcgccaccctatgcactcgtctctttaagcaaagtctgcgggtggcccccctccctgttatgttgtttccaccacaggtactcccccggcattcttgtgctccaccgcggggtattaacctcgagcgcttcttcacaaagggcgctgcttcttcaatgctgaggttccccctggaagcccaaagcaatcaggccatcagagcagcccgtaatggtgtgatgtctattatcatatagaaatggggcgggactggcagtcgtcagagtacaggttgaccttctatgcgtttcacttgggggggaatacaacccctgaaactgctcctcattaca

SEQ ID NO: 692193 - DNA, 262 bp, Homo sapiens
  misc_feature (114)..(114): n is a, c, g, or t
gatctgaggatccggcgagatgcatactgaaattactgatatgcgatctatgggcaggtcagttgctacaatagagactaattatcacatgctactacggtccatagtcaaggntgcgtataagcaccctagttcccaagtatagtttagttccctctcccccacaccactgatgtgttccatgttatcttcagttacaatgcaactaaaggaaaccacacaactgagtcagatataccaaagaatcaagtttgcacttttt

SEQ ID NO: 692194 - DNA, 1800 bp, Homo sapiens
  misc_feature (330)..(330): n is a, c, g, or t
gatctcagctctcgcttagtctttcgtctctcgtggtttcggtctgcgtctgtctcatctcattcttgtcacgtcatctgctataccatcttcatctcctagtcgctgtttgttcatgcatctcgtgtgtggtcggtggggtgtctgggttgtgccagcgcacctgctgttgtgtgttgtcgtcacccagttgtgtgtctgtctttgtgcgttccttgctccggctgtggcgagctctcatccgtgttgtgtgtggtgtggggagggcacccccgacggtgagaggttgcgcgtccgttcctacctttgaatcatcagttctttgctagntctgcttcgtctcgtcttgtctttggtgtgggaggcttggtcgtctcacctttcatctgttctagccactgcaatgtggcgatgtttcttttattgactcagattcgttctgtctgctttgtgttatgtctaccactgtctgttaggtgggctgagaccaatccttcgttgttacgttgtgtggtgggtgtctcgcttatgcactatgtttcgtcctcctgctcttgttagtctgtgtctgcgtggttgtgtttcgctatgctcgtttgctggcctttttgtcttcttgctctgtgtgtttttgtttcttttccgtcctcttttgtaagtttcatctctcgtgctctttgtttgttgtatgtgttcttcttttctgtgtgtcttttgtctgcatcctgcttgggttttggtcttcgtacttccttctgcttcttgtgtggctgctgtacttccgattgtgttgttgtgtcttggtgtgttctatgtcgactatgcgtgtgcgttctagtcccttttcgtcatgctagtcgagcttcgtacgcttgttttgtttttgttttgcttctactgtgctcgtcagcgttggtgtgttttgctgctgctgtcttcgtcccctctcttgtgttttgtttttactctctcctctgctcctcagctcgttgttttacacacgggcggggggtgtgttttttacagatatggttggtgtgcctgggtggttgtgtcttctgtttgctcaacatcacttttcttcttcttatggcaccccacgggtgtggtgttgggtgtgttttgttcttttcatcgcggcgctctcttctcttcacgggttgttgtgttttcactctacagagtgtgttgttatgtctgctttctctctctctctctctgggtgttatttctctttgcccactgtgttgacaccacactttgttttgcactctctctctctttttgtttttctctcacgggagagtctctctctctggcgcgccttggtgagtgagcaccgagaggtgcctttgtttcttcacggcctcgtgtgtttgctctctctctgtgttgggttgtcttttttctctgggcggcgacgcccgcccgccgcactcttctctcgtcactcgttctcgtcttctgtttttctccacgcgggtgttgtttgttcacactctctctctctctccccagcctctgtcctcctcgcctgttgtggaaatatattgaagggcccgcggtgtgtcaccacgctgccgtcagtttcatgccactagtattcacccgttttcttggggggcgtgggtgcgcccaataattctcgttgttttcccggtccccgctgaagcggtcgtgctggtgctccgacctgtattttctctcctctgacgtctcccctcttggggcgccctaattcctctttccttatataaaactactgcaaaattaataataaataaaagaagaaaataaaaa

SEQ ID NO: 692195 - DNA, 180 bp, Homo sapiens
gccaccgtgctagtcctggctttgcaataatgctggattaaaaaatgactcttaagggaaactacatgtctttactcaatatattctttctttcctctcggcaattattaattaaccatgagtatttttagggggccagaagagtgtaatgggcgttgagaagcttgggtgccgatgcct

SEQ ID NO: 692196 - DNA, 456 bp, Homo sapiens
  misc_feature (89)..(89): n is a, c, g, or t
  misc_feature (236)..(236): n is a, c, g, or t
  misc_feature (304)..(304): n is a, c, g, or t
  misc_feature (385)..(385): n is a, c, g, or t
  misc_feature (450)..(450): n is a, c, g, or t
  misc_feature (452)..(452): n is a, c, g, or t
  misc_feature (455)..(455): n is a, c, g, or t
aaatattcaatttgtatgttgccaaatatatatcccctatgtgacctaatgttcctaatccaagatatagaatatcttgtcatcccaanaaagttccccttgtgcctaatttaagaatgatcttttaaaaatagaaatcaaattacccagccagatgtggtgactcacaactgtaatcccagcactttgggaggctgaggctggaggattgctggagccctggagttcaagaccancctgggcaacacagggagactcccatctctacggaaaaaaaaaaaagaaaagaaaagaaacaaaaaanccaggcatggtgcaaatgcctgtgttctcaattacttgggaagctgaggtgggaggatcactttggcccaggaggttgagntgcagcgagccaagattacaccactgcactctatcctgggcaatagagtgaggcactgtcttaananaana

SEQ ID NO: 692197 - DNA, 931 bp, Homo sapiens
gcggagcatgtagcggatgctggcggcggggctcccggggcgggccgggcggtggccgcgggagccgcacgcggcgatatggactgaggagggctaagaagggcaaaaagcctggaattgtctcgccatttaaacgagtattcctaaaaggtgaaaagagtagagataagaaagcccatgagaaggtgacagtagaggcgccctctgcacactgtggtgttgtccattgcctgaacgcgtcgagccaaacgagactgttgacgcagactatattgagaacggaggtaaagtatttaggtcagttaacgtccataccaaggatacctgaatccctccagtaggacatgaaatcctgcatttcatagactaatgcaaaaagagagcccaccagcttccagggacagatagacgtcaggagcacgatgctgtgctcaaactgtgctgcgtacaaccgtcaatggctggcactgggagggacggggaggatatcatcctcagggtgtccatccatgacatcgacgccgatctcctatgttcgggatgacagctgtgagcacctggatggtcctgaaagacaggccaggaatccaggaatctgccccagacagagactgtgtgcggaaaagttccagaggcctcaaggtgtaagcatcctgtcggcagagtgcagttggggaccccgtggaacggcatgctgcctgggtccttcctggttgcagagaagccggtcgctggggaggagccttggctggtctgctaggcgcagtcctcccgcggtggttaccgggagtccaccattcatttccgggacgagcgctattggtggggcttaacccggacaccactttccctgcaggagaacctctcggtggcctcgggcctcagggcgcgcgtctggccgaggaggggggggcccccactttcggcgccc

SEQ ID NO: 692198 - DNA, 311 bp, Homo sapiens
taaacatcactcaaggacttaacctcctcttctggggaagaggttagtgtgattttagttgaatgcaggataattgtactatgtcaggcagaattatgaccttgttattgtctttatttggagattaagtacgatttaggaagatgtgtatgggtgtcaagttgacaacagtggacctgtgatggttcattttatgtgtcaacttgactggatcactgggtgcccagacatttggacaaacgttattttgttgtatctgtgagggtgtttccagatgagaataaaatttgaattgatagactgagtaatac

SEQ ID NO: 692199 - DNA, 709 bp, Homo sapiens
gagcggagtgtacgggtgcaagctctgcaagaccttggccgagtgacttctgctgctcttttgcctgtgggtgactctacatggcactggaccagcaacatgacgagacgcatggacgttctggcacaacccaacaacaagctggcttcagagcaacattggggcaatatgcctttccatactcttacctgggcactttatacggaacggaggccttgggctccacacttctcatatacagatggaactaccaacgcggacatccgttgaccaacacgttaacgcccaaacggtataagctacacaagggggcgtcaaacgctacattacctgggccttggcactttcttccagttttttaagttatatggccccagaatctgtcacaggttccccccttggcacaggtatcatacggacagcaaagttatcccctgggtatatacttccaacttgtaaaaagacgttgtccccagtagacagaacacccccggaaagggggcaccttccaaaacacccggaggacccgtataagctcccgcttaacaagagtggcttcataaaacccacatgtgccccggtaaataacccggtccgggtctcttaaggtgcccctaaaaccttatggatggtcccccaatacacacgtaataagcatgtggaaccaggttggattggcgcaatggggatcaggtaacttcgttcccca

SEQ ID NO: 692200 - DNA, 1259 bp, Homo sapiens
  misc_feature (327)..(327): n is a, c, g, or t
gaaactcctcgtgcagtatctcatcaggactgtcgacagcgttctccccgttttttcgaatggatcagagcatgttgccttcattaagcggtacagcagcttcccatgatcggaggatactgtagccatctttagtatacctcgttaccatgtgggccttaatcacgtgtggtacccttggatctcgagtagcctattagagatccctcttctgcgggagcgatgtaactctgagatgaaagatgattcatagtagtgcagcaagtagtgaaccaaggggggatcatctcgtgtcgattagatcgtgcgcatacacgcatggtattncttaaagtcactcgaagtaacacgtctctgtagagaaatatcgtgcgttctgagctgtcagactttcatgccctatgaaggaagagtgataacggtatcccacagatgaagggttaatggttgaagttagaccttattgacatagagtttgcaatatttaggcattcttactaggcgaagtagtggtgagtggcacttgagatggctctggtcgtattgggtaattcccttctcatagaatacttactccagcgttgcctccgacctaaaggatgaaacatccttggattgtagacgtaactaatctgtgagcgtgatcagtgattcacttggagatctatgggcgttttcaagttaatatcgacgaaagtatggctcaagcgcgggtccactacgagtactccgaagcgtggggtggagttccctaggggcaagtagctcgaaggtagcaaggtgagatttcgtaattttccccagaaaacatctatagtacaccaagaaggtggtgtgggtttcacacataaaaccgtccagtttatcccataacacggttattttggatcgccatagttactccgcgttggttcattgtgaacatcgtccacaattctgaaaaaaatccctttgaagtaagggaactaaaatgaggccctgtggcattggcccaaagggtttttcgccctacgtggaagggggtccatagagagccccggaggtatctttaacaaaagacctcgcaaagagccctaaaatttacgtaattctccaataagaagcgatcgtccatggtgtaagccaaaagaaactctcctatacagccgagcatagtgggaatatagctgggggccgatggcgcctaggggcactgtatgtgtatgggaacagctgtaacaggccggggaacagcatggacctaacatgtagaaccctgt

SEQ ID NO: 692201 - DNA, 1574 bp, Homo sapiens
gtgagcttaagtgaagaggtactgccttgttcggtggaaatcagccgtagccatgagtttctgccggtggctagccctagagtacgtgagcaggcgtgacttttctggttcccctgcccctgccatgtgtgtgctgtgtggcctactatgtgcctcctgtggcatcccctggtctcaatgtagtgcctcatcttgccgtgcaatgtgtgctgcccgaaacgcggtgaggctgccatgtctgctgtgttgcttactgccagacagctgatgagatgctgagccgtgatgacggctgatgccctgatgcctggagtgaacgacggaggctggttgtgctccatacaatcatggtgcccagactttagtgtgggcattgttcgcattctcgtcaccttgcgccccaaaaggtgtcccgggccatttgcctgtgcccttcctgtgcacacacattcaagagtggcttgtgctagccaggcaccttattaacacaagcagaaccggctagcatgatagaccaaccaaagggcacagacgaaagaccaagagaagtgaggaccagagcacaggaaggaaacagtcggcccacacacgcaagcgaacccacgacacgtccaagtgaaacgagaccacaacacagtaaacgcaagagtaaacaaaagaggagcagagacaacaccgaaccaaacaacggcagggaaagcaggacacgaagagcagaagacacccaagacgagaaaagagagaaaaaaaaagaggacagaccacaaaacgagaggcgcggccagcaggaaccacacacgacagcagacccagagaaaaggagaagacgcagaggatccaccccagcagcaccgaacccagaagggggcacgcagaaacaggaccgacacgagacaagaggacgaacaagaagcacgggagcgccaaacagcctcccaagacaagagacgcaccagaccgccaacgagatgaccaacagaggggacgagaaggcccacacccccgacagggagacaccagcaagagcaagccacagacggaaaccacccaaggaacaaggacgcgcacagcgacacaccagaggccacacgaagcccactcgcccgcacgcagccaaccacacacagccccacacacacactccaccgacacgcgagcccgaccagcacgcgaccacccagccgacgcacaggccccgagcgacaaggagggcccgacaccgcaccggcagaggcggccgcgcaccacacccccaggcgagggaagcacgcgacagccgcagtggcccgcaccacgagccacagaaccgacaagaccagcgcagagcagagaccgaaggaaagccagaggacaccaccgccgacagccaacagacacacacgacacaccgaaagagccgcgccgcagcggcgcccgcacgcccacaccagagcgagagacacacaggggtcacaccaagcaagacgacagaagcacggcacaccagcgacacagcgagagggccacacgcagagcagacacaccgagaggcacctacacagaccgcagcacgacacagagcagcagcacagaca

SEQ ID NO: 692202 - DNA, 605 bp, Homo sapiens
tagtagggctctgacaccataaccgacctccataatgaccacgtcagctgcgggcatagcaggagccgcgataaggtagactggttggataagcccatccgtcccatcattgggctaccataagcgccagcagttggccctgctgtagaattcaaaaaaagttctacatagctgtgatcgtaagcacccgcactagtacctgcagtagaatctaagaagagctccacatatctgtgtaggatattagctttgtctttggccatagctgccagagtatcttcatgagtagctgattcaacatctgcctcaccggtaactctgccatcgggtccaagtccaatatgtactctcatgggattcagaggtgagaagacattataaatatcattctcaggggctctgtacggtaaccccctcatgtgtacacagtgccctgtggtgctctggaaactggagccaccatctccgtatctatgatcagacattcctgaaaaacagtaattgaggtcacttccaaatctatcagacccaaaggcatatccatcattatagccaccatagtcatcataggctccataggctccaacatagggaccaagcctcat

SEQ ID NO: 692203 - DNA, 332 bp, Homo sapiens
tttttttttgatggagttttgctcttgttgcccaggctggagtgcaatggtgggatctcggctcaccacaacctccacctcccaggttcaagcgattctcctgcttcagcctcccgagtacctgggactacaggcatgcaccaccatgcccggctacttttgtatttttagtagagacaaggtttctccatgttggtcaggctagtctcaaactccataccccaggtgatccacccaccttggcctcccgaagtgctgggattacaggcataagtcaccgcgtccggctgaaaaaaaaatattcttaatccataacacttgatcagaaatta

SEQ ID NO: 692204 - DNA, 247 bp, Homo sapiens
tctgtccacatcacacaggcccgtccaaaggatcacgtatcatacacaagggagggaccagacaacactgcacttaattcaaatcaaaacaagaagttcggacactctacgctatgtgcctagttaaaggcaactaggagcaatcagaaacaacttacctaccaaccttcccctccaccaagtgatggctgctcattatgtcacattctaaaataataaatacaaagctatacatatcaaatctttg

SEQ ID NO: 692205 - DNA, 228 bp, Homo sapiens
gatttgcatggcttgcatttgttcagatgtcggtgtgcctaagttaatactgagcgctgcactaatgcgtgtgaaactttctgcttcaaagggattatcaatcatggcaggtgaggcgcccgcagccaataaaacgttggctgcataattggcagcaacactgttggtgatacattgcaccaaaggttgttgcgtttgcagggcagtccaagcttctgcaacatatgc

SEQ ID NO: 692206 - DNA, 176 bp, Homo sapiens
  misc_feature (69)..(69): n is a, c, g, or t
  misc_feature (95)..(95): n is a, c, g, or t
  misc_feature (100)..(100): n is a, c, g, or t
gctgaccagcacatgcggttgcagacagcgccttacgaaggcggcaaaagggagccagagaagtggttnatccattttctagaaagattggtatnatgtnaaagacctcctatgttaattagaaatattggaagccgttcgtcaaccaggacccaggaaccaaattgcatctatgg

SEQ ID NO: 692207 - DNA, 923 bp, Homo sapiens
gttcgcctataagacaccttggcttggctacctggagtgacgtacgagaagattagcgccgacctagtgttgcgacccacccaatgtgtgcccgcccaccgggtcgtccagacgcctcattttgttgggcgcccggtgcaacacagatatgcacgtgtgtaaaaaggggtaaaaacggttggtaaaactggcgagacgcctttttttcacacaaagggctgttttgccacagggaaaaagttggggaggttccagcaaagttgctgcgcgcgacccaccacagcaatttagggggacaagacacaccgaaagggggggaaaccacggcggcctctgtttaaccggaggccctagaaggacccactctcttcaaagggggtaagagagtccccccaaatatggccgcttcaaaagaagctggatgccccatttgttgcccccccccgcccccacgattggtaaattatgggatttaattgagggaaacccctggttgcataagacacccaggcgggtagtaacccccctcctgcaaggtgatattttcggcaggctcaatcgtgaggttggaacaaattttcttgttacacgcaacgaccacacgggcaaagaaccgctttttaggctttgacactaatatggaaacgctcatttccaggaacagtccttaaacagtgtgtctttcttcgtgggcacattcgccccaactaagggtaatttcacacagtcccccggtggtgtgtgtaaactgaccaaccccccacgtatatgtctccaccagccccctgtctggaacaaaaaatctgaacccgctgtctcccttgaccgcgcaggttccgcgtatttcattttttgtctgcggggcgatcagaataagttagtggaatcccacgccccaaaaacaccaaatttccccaacataa

SEQ ID NO: 692208 - DNA, 257 bp, Homo sapiens
ttttttttttgagagtctgaatgagcatttattaggaaagatttatggggtgaagacttagccaataagagtgtgatttttcagagactctaaacaatcaataggtacaatcagagaaagggagaaaaatcaataggtacaatcagagaaagggggaaaaaatacctacaaaagggccagatgcagtggcgtgcacccataatccagccttcggacgctgaggtaggaggttgcttgaggcaggagtcgacgcagcc

SEQ ID NO: 692209 - DNA, 596 bp, Homo sapiens
gccgggcacggtggctcatgcctgtaatcctagcactttgggaggccaagtcgggcggattacttaaggtcaggagttcgagagcagcctggccaacactgcaaaaccccgcctctactaaaaatacaaaaattagctggatgtggtataacctggctactccagaggctgaggtatgagacgcacttgattccgggaggcggaagttgcagtgagctgagatcacaccactgcactccagcctaggcgacagaaaaaaaaaaaaaaaaaaaaaaaaaacacccataaaaatagaagaaaaaagaaagataaaaaaaaaaaaaaaaaaaaaaaggaaaaaaaaaaaaaaaaaaaaaaggtaaagtaccacaggtgtcatttgaaactgaggcctgaatgatgaaaaaaaaaaaaaaaaaaaaaaaaaaaaaaaaaaaaaaaaatttaaaaaattaaaaaaaaaaaaaaaaaaaaaaatgcgcccgaatttggggttaattggcccatttgcccttatggggggcggttacaattcaatggcccgcggtttaacacggtgggactggggcccttggggtcccaattttccctttggg

SEQ ID NO: 692210 - DNA, 313 bp, Homo sapiens
tgcagctgggtggctcgtgtcatctgtgcaggtggctcttcctccacatcacgactggggcctcgaagaggacgggggtaggaaatcctccaggcatcttagcgaaatttcactccgacttctccatgctcaacggctctctttggctcggcagggctgttcttctcctgcgctctccgcttttcttcagcctggcccttatcgaagctggcgatttcccccatgtctggtttgtctgccattttcttaaaacaactccgtgcagtctcgctccgagcccgagcatcctggcgctcccgctcgctctgccaaa

SEQ ID NO: 692211 - DNA, 676 bp, Homo sapiens
  misc_feature (531)..(531): n is a, c, g, or t
  misc_feature (645)..(645): n is a, c, g, or t
ttttttttatatataaaatctttattacaggcagtattggtccatacactaacacaataccaacagtacaggtttaatctttcaaaatcatcatttaaacagcaaaagaccaagaaataaaatttgagtcaattatttttcaaaatattctcaatgcacattatccttaattcccttattatagtgaaacatacaaatacagaaaaataacccatttaacaaatactagtgttaaatggttatttggcttaaaatctgagttaagaaaatcctttttagcaacctacatacagataagtagcaaactttattatattaaacaaattcattctgctaaaacatgtaaagaatttcatccatccatgttattctgatcccagtacaagttgtttattctcttaccgtcacgaatccttatatgaaggaccaactccaaagagtttgtccctagaatataacccttatcctccttcccccaacacacttccatcccaaaagttctgttccaacagaatggcaaccgggttagcnagtccacttccacccatcctgaatgcccagtggttcccgttgagaaccgtttggccaagccctgttgaaaacagccccaatttccctacctactggtggggtttggctgctccngggaaggaaacgaatatacgccccaataccc

SEQ ID NO: 692212 - DNA, 237 bp, Homo sapiens
cccggggcctggggcccccccccaattttttttcccgttccaaaaaggggggggggggggggtcccctttttgtttccacttcaggggggggggggggggaaattttccccccccctttaaaaatagacccctggggaaaattttttttttccaattttccccccggggggggggggggtttattaaaggggaaaattccctaaattttggggcccaaaaaaaggggggccctggga

SEQ ID NO: 692213 - DNA, 591 bp, Homo sapiens
agttgaaatgtgttgttataatttttattgagagttgttttgtggctatcatatggtctttcttggagaatgttccatgtgctgatgaaaagaatgtatattctgcagttgttgggtagaatgttctgtaaatatgtgttaagtccatttgttctagggtatagtgtaagtccattgtttctttgttgcctttctgtcttgatgacctgtctagtgttgaagtccccgctgttactgtgtagctgtgtatctcatttcttacgttgagtactaattgttttataaatttgggagctcccgtgctaggtgcatatatatttaggattgtgatattttcctgttggactgatccttttatcattatgtaatgtccctttttgtctttttcgactattgttgctttaaagtctgttttgtctgatataagaatagctatttctgctcgcttagggttagtatttgcatggaatatcttttttcacccctttaccctcaacttatgtgagtccatatgtgttagcagatattaggttggtggattcgtatccattctgcattctgtatctttaagtggagcattagactattaca

SEQ ID NO: 692214 - DNA, 108 bp, Homo sapiens
  misc_feature (80)..(80): n is a, c, g, or t
aaataaatgagtattctcataagcaagacgccgtctcaaaaaaaaaaaaaaaaaaaagaaagaaagaaagtgcttctgcntccagcctgggcaacaagagtgaaattc

SEQ ID NO: 692215 - DNA, 881 bp, Homo sapiens
  misc_feature (881)..(881): n is a, c, g, or t
gacttagtatataaatacatcgttcagaaactatatggatttccctataagattcctgctgttgttgtggaaaaggcatgcagtatttattccagcagggtgggcataatgatcaagcaacacataggcaatattcacatgaaacattttcaaacattaaaagccagcacagcatcaattttgaagcacatcatcaactaaaaccacctgttcgaacagttttgtacatgagaaggacaattatcggcagcaagatgatcagagtagtttcttagtgaagctacagtccccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaacaaaaattgatccaaacatgaaagctggagctacaagtgaaggcgtactggccaaatttcttcaacagtctgtagacgtaaacaagactggctctccagagaagccctggtgtgagtggtagtagccctgcaggtggggctggaggtggcaagcagtggtataccagcatccagcataacacgtctgggccagcaagccctgtacttaagaatgtacattgccagaaacttacgaacagacatttacacggacaatccaagttaacacggataactatccacaacaacaccctaccaatcttccctaacgggaaagggacgacagcctttctttgaacgaattacccaacaataacaggccactcactcctggatatcctagaggcagtacatgttaaccatgcccttccggactgtgatcccttccaacaagtgcggacacttcagaccn

SEQ ID NO: 692216 - DNA, 2243 bp, Homo sapiens
  misc_feature (526)..(526): n is a, c, g, or t
  misc_feature (909)..(909): n is a, c, g, or t
atagttgtgttgagtgtgcattcgtgctcgttgttacagcagttgagtgtgtgttgttccgtacgcgtggggtggacatgtgatcagtgatcttgcactcggtgttcaatggtggagtctgtcgtcagcgtccgacgagctgacaaatcaagtgtgttacactagtggtaactaagaacgggtgtgtggcatcaagtggtggttagacaatacacgagtgtgtgcgtcattgtaatttcttcgtgcggggtctcacaccaatagtaatgaggttcagtcaataggtgtggtggtgacaccaagaggtgacccacaacaatagggtgggtgaacatatattcgctcgtgttttgatgaccgctacatcaaacatatgtgtgttcgacctcgtcggtgcgattagtaagactggcgtctgcctacaacactagtcggtctgttgcgtctggcatgggtgatctaatcaaaccatctatgtgggttgggtgtgtgcccccccccagcatacaatccactgcaggtgggngcatgttgaataatcaagtatctactgtcatgtctgatttgtggccagaatacgagtgatgattccatatcaatcatccgtctcgtgtggtttatgaataccatcatccgtgggccagcaactgtgtaggttgttagatcaacaaaccacattgccggtgggtcggaggtgggaccatccacacatcgtagggagtacgacaagagggatgttccactccatctgtgtgtggaggcaacagacacaatagctggtggagatggagagagacgatctggtcgtataccaacatgggtgagtgtagactagagacacaacaataacgggggtggtcaccccaccatcattgtgtttggtggtgggtacactccactacacgagtngcacaacacaatcgtggtgctccgccgcgtgagtgtgggttggaatgagaggtaatatttgttagctagctagagagtgttcttgggtatgcctaacactcttgagttgtggctgtccgcttgtcacctcagggtggtgggtgtgccctcccacacgtcggtcgcgtcctgcagcataacagtgaggtgtattgcttttgatagcaacaacacggctccatcactcctgtgcctacgcgtggtgtgtgtcccacacaaaaaaagatgtggttgtgggattggtacggatgtgtggctgtacatccagcagaatgtagagagccgagcgggggtgttggcactaccaacaagcggtgtgtgttgggtgaagtatgaatagtgtggtgttcgttgtataaatacaaacaatagtagctgctgcgggtggaatgagtacatccaacaacaaccccccgcctgtgggggggggatcacgcactctccaactaagcagtgtgggttgttctcgtgcactacaagtggtatgacgacgcaaacactacagttgttgttgtcactcctccaccacacataaaagtggtggtgtagataacaaccccacacccacagtgtggcgcccaacagtaggtgtgtgttctcgtgtagcattatcacactgggggtgtcgtcagctctacagatacggcggtggtgttctacacgtgggtcacggctgtgggtgacaccacaccactgttctacctccagagagatgagcagcgggagagaagaatacggcgtgtgtgtgtgatgcgatgtgtgtgtgtgtgaggagagaggtcccacacagagagagagcgcacacacagtgtgctccacaacaggagacccccctgctgtgcgtcacgacgtgtgtgatcatcacacacacacacaacagcagagagatagagaaatagtggtggtgctgagtaccctcacacaccccaatagacccgctgcgcgctgagagggtgtgtgtgtgtggcacgtgtgtgtgtggatgaatgtgagagcaacacacgtgtgtgtgagagcacacacacgccgtgagacacacccgctgtgtggtgtgatacacacagcgagagataggtgtgtgtgggtgcgactgtgtctggtgacacacagccctcagagaacacacacacacacgtgtgtgtgggggcaccccacacgggcgtgggcctacactgtgtggacgtgcaccgtggcgacagtgtctcttaaagtgtgcgagatgtgtgtgtcacacccttgtctcacacacgagaagtgttaaaagtggtgtaggttcctccccaaataaataaata

SEQ ID NO: 692217 - DNA, 1035 bp, Homo sapiens
  misc_feature (167)..(167): n is a, c, g, or t
  misc_feature (194)..(194): n is a, c, g, or t
  misc_feature (347)..(347): n is a, c, g, or t
  misc_feature (361)..(361): n is a, c, g, or t
  misc_feature (393)..(393): n is a, c, g, or t
  misc_feature (399)..(399): n is a, c, g, or t
  misc_feature (447)..(447): n is a, c, g, or t
cggaaataaacccaataggagcatcatcgcttggggccaatgtaacaaattgctccatggttttaatccagaggatatcttgctagcctctacgggtgtatgttaaagaatgcgtgctgcttagatgggaaactaagtttagtcgttcctgtttcacgggaaccagntgatcttctgacatgattgaccaatgntgatgaaacacactacattttccatcatcatttggtgtgatcgaatgtgcattgactggatcatctgattgtgaatcttgcttgtgtgtaactatagaaaagtagggactaccagtagtgaccagaggtcacgggataggaatcaacggtccntgataagctccgcnagtcgactctttgtgacaaggcatagagggcntgggcngggaaatccacgcatggaaaggacgggagtagaattcaaatggatcgnacgaccttgagacctaagcaagtggcatggaagacgcacatcatcatccgtacctcgtgaaaaatggacaagattcttagcctaggcgcagttgggtgtgccagcagtcacgtgaagtattcctgaaactcactactgggtaggtgctaaaagggcgaggtaagacctccatatgtgaaatccccgagcgacaggcaaagatgggtttgataggggagagagcttggattgttcggacaatccacttggggaacatcccataatgcttgggggcaaaccgggggaggcctaaaaacattgcgtgcgtccacttggatagcagaaaaaacaatactagcatcgaagggcgggggtgggccctggatactccgcaatttgcggacccctatataagcttaaaggttcggtgatttcaccagtactcacttgtgggccgatagagtattttaacaagcaggatttgtgtaagccttgggggtgaccccagtggaggagttttcccctcctatattataatacgtgcccttgtgtgagaggaatatgttcgcccccttatttggggtcggaggtcggcggtcgtatagctac

SEQ ID NO: 692218 - DNA, 304 bp, Homo sapiens
ctcgtacctggtactcactatcgatccggaaagcaaaggctttcgcatatcaccctgcgttcaccgctctacgtgcgcggcacctttaagtcgccgaatgcgggcgtgaaggcggggccgctgattgcccgcggcgcggtagcggcagcgctggcgaccctggtgacgccggccgccgcgctgctggcgctgatctcacccgccgaaggcgaggcgaaccagtgtcgggcaattctgtcgcagatgaaaaaatagtcggcaaggagacgcccctcgccggatggccaggggcgtggagggagag

SEQ ID NO: 692219 - DNA, 1957 bp, Homo sapiens
actggtgctgcaagtcgctgagctgacagttgtgccgaggactgtcaccattgggcaggcatggtggccagctcctcacttggctgaggtccagggatggacacaggtccgctgaacgcggccagcctgagggaggagcagctccacctgtccttgctggtgtccagcggctggagaacaatcagcttccacgtggtgcccgtggtgagaaggaagcttggggcgcctgccctggagggggtgcagcagatgcccggattccctgagggcagcttgagaagaatcctcagccaaggggtggacctggtgccggccagtgcccagctctggaggacctccactgactacctgctcacgaggctgctgggggagctgggctccctgcagggtcatcgcctggacagcctctccatcctcgaccgggtcaaccacgagagctggcgtgacagtggccagactgacggcctgacctttggccacctgaagatggtgctgctgtgggcctctgtgctcttcccggcgcccgaggactgggcagagccgcagggcgccgtgtaccgcctgctggtggtgctgctctgttgcctggccacgcggaagctgccccacttcctccacccgcagcgcaacctgctgcagggcagcggcctggaccttggtgccatctaccagcgcgtggagggcttcgccagccagcccgaggcggccctgcgcatccacgccacccacctgggccgcagccccccgccgcgcatcggctccgggctcaaggcgctcctgcagctgccagccagtgaccccacttactgggccactgcctacttcgacgtcctgctggacaagttccaggtcttcaacatccaggataaggaccggatctctgccatgcagagcatcttccagaagaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgatgaaatgctgtatatttggttttgaaaaaatgaatgtgctgggtatacacagcagaaagggtactgtccactttttgtatatcagtgtgaaaaatatttcccctagaagtagaaaaggctcatgtgctgatggataattttgagtcttctccattctctgtgaatgacccccttccccaggcatccccacctcctacctcgttcttagagcaaactaaagccaactgagggtgcacacacagccatgagcccacctgcccaggactactcccatctgcttcttcccgtccccgtggaagtggcccctgatatggattgtatctgtatccccacccaaatctcaggtagaattggatctgtgtccccacccaagtctcaggtagacttgtaatccccagtgttggaggaggggcccagtgggaggtgattggatcatgggggtggatttctcccttactgttctcatgatagtgagtgagttctcatgagatctggttttttgagtgtgtggcccctccccctctccttttgctctcttcctctttctccggccatgtaagatatgcctccttctccttcaccttccaccatgattgtcagtttcctgaggcctcccagccatgcttcctgtatagcctgcgggactgtgagtcaattaaacctctttattcatt

SEQ ID NO: 692220 - DNA, 1077 bp, Homo sapiens
cgagaacatgcttgcggaatgctcggcttagtcggaaccataggacgaggatgacgatggtgccggtggaagcgccgagtctgactccggggacgaggaagaggcaggggcccatctgtgcgtgggcagacgacgcaagaacagctttggggaagaacctgcagttgctgagtttcagcccgtggatttctgttattcactgatgaaaggccggggacgtaacgatggcagcatggtgccctgtgctgatgtcatgagccgaactccaagacagcagagcagggcagcccactcacaattcagccatgagcagagattgcagaaaccgttcgggaccagacacgatggcacaaaccagcagtgcattcaagagcaatgccaaaggtcctggccacggtccgcggaagagagggacgaagagaaaggcagaccggcgtaccagggcctccgtggaaatcccatgaaggggacgccaacgtggacaaggaaccccgtctccacaggacgcacgacttgcaccttgaacgggtacacgggggttccacagggaccatgacctcgaaacgggcactcctggtcatgcaacctgggatccttacagcttcagatgcatgtgcattgcacttggaccggcgagccaacttcgccgtccaaaccccacaatgtaggggccaggcaagttaccaattggttcccgagacacggctctaccaccggggggcactccgcgtcacacgcgcagccggcaacaagggacaaggcgacacgccaaccaacgggggaaccccccggggaacaggcacgcacgcggaacgcggcaacacccctagctacgcggggaagaacaaaacgtcagccacgctgccactccaagagacagcatcccgacaacgtgcagacaccagcagcgggccaacagcaaccaggcaatacaccgccatgcggacaccacagctgcgacaaacgcgccaagagtagcaccactcctcggggccgaccgcacgtcccagtacacgcatcggggagccaagagcgagagcacacaagacagtaacagcacagcggaccactcaactg

SEQ ID NO: 692221 - DNA, 259 bp, Homo sapiens
ggacggtcccatgctaccagtcgagaagcatgctgggcgcagagcagtgctattgacatccagagaaaccgctgtcacaggcaacagctctggatcaagaatgggctacactgagaggctcttgcttccctgtttcaacaagtccactatgctacaatgcatgattccaaatctaccttctactctcactgtgaaagtctttcaaaatgctaaaatatcacaaaagctttaaaaatcaatgtgtggatatatgtgcttt

SEQ ID NO: 692222 - DNA, 288 bp, Homo sapiens
ttgctttttaaagtttatttttacaatttttttatccctttattggatcatcccccttggtttcaaaaaggaaaaactaaatgttgaaccaattaaatgtcaaaattttttattcccaaagtccatgttaaaaggggggctttcaggggtttaaaaattttttttgttgttgttaacattcattgcaaaaggactaaatgggggataactctaaagttgaattttaagggattccctaaaatggaaactatctttttatttgaaggaaaaaaaaaacaatgattttga

SEQ ID NO: 692223 - DNA, 1521 bp, Homo sapiens
  misc_feature (234)..(234): n is a, c, g, or t
tgatggcctcctggggcctcccctcatgcccaacacttaagaatttttaccccagagcctgcagattagggggcaaaggccatgctctgtgctctcagcagacctgtgtgggcagggtgcggtgagggtggggtggtcaccggaggcagccttcaagcagcaccgtgtggggcctcctcctcagtgtaggcccatgccaggacgccgtgtgtgaggaggggctcagggagcagnagaggctggggccgctccgcctctaggatgcctgtccaggcagatacccggggcaggaaggcccggcatggcccagggagggccagttgttccacgctgtgctctcggcctgagagcttatcatgggctccaggggtccctgtaacccttctcccctgcaaccctgcctgtagttccaggtcttcaacatccaggataaggaccggatctctgccatgcagagcatcttccagaagaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgatgaaatgctgtatatttggttttgaaaaaatgaatgtgctgggtatacacagcagaaagggtactgtccactttttgtatatcagtgtgaaaaatatttcccctagaagtagaaaaggctcatgtgctgatggataattttgagtcttctccattctctgtgaatgacccccttccccaggcatccccacctcctacctcgttcttagagcaaactaaagccaactgagggtgcacacacagccatgagcccacctgcccaggactactcccatctgcttcttcccgtccccgtggaagtggcccctgatatggattgtatctgtatccccacccaaatctcaggtagaattggatctgtgtccccacccaagtctcaggtagacttgtaatccccagtgttggaggaggggcccagtgggaggtgattggatcatgggggtggatttctcccttactgttctcatgatagtgagtgagttctcatgagatctggttttttgagtgtgtggcccctccccctctccttttgctctcttcctctttctccggccatgtaagatatgcctccttctccttcaccttccaccatgattgtcagtttcctgaggcctcccagccatgcttcctgtatagcctgcgggactgtgagtcaattaaacctctttattcatt

SEQ ID NO: 692224 - DNA, 2003 bp, Homo sapiens
gcggtggaccaccgaggataccttcactgcctcctcggagggtgacgccaagtgccgtggacacattgtgcccagcaaggtcctgtgtgtcctcaaggacctgctggtggcagccatcgtacactgcaagcaccacagtctcatcgcaccaggtccgctgaacgcggccagcctgagggaggagcagctccacctgtccttgctggtgtccagcggctggagaacaatcagcttccacgtggtgcccgtggtgagaaggaagcttggggcgcctgccctggagggggtgcagcagatgcccggattccctgagggcagcttgagaagaatcctcagccaaggggtggacctggtgccggccagtgcccagctctggaggacctccactgactacctgctcacgaggctgctgggggagctgggctccctgcagggtcatcgcctggacagcctctccatcctcgaccgggtcaaccacgagagctggcgtgacagtggccagactgacggcctgacctttggccacctgaagatggtgctgctgtgggcctctgtgctcttcccggcgcccgaggactgggcagagccgcagggcgccgtgtaccgcctgctggtggtgctgctctgttgcctggccacgcggaagctgccccacttcctccacccgcagcgcaacctgctgcagggcagcggcctggaccttggtgccatctaccagcgcgtggagggcttcgccagccagcccgaggcggccctgcgcatccacgccacccacctgggccgcagccccccgccgcgcatcggctccgggctcaaggcgctcctgcagctgccagccagtgaccccacttactgggccactgcctacttcgacgtcctgctggacaagttccaggtcttcaacatccaggataaggaccggatctctgccatgcagagcatcttccagaagaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgatgaaatgctgtatatttggttttgaaaaaatgaatgtgctgggtatacacagcagaaagggtactgtccactttttgtatatcagtgtgaaaaatatttcccctagaagtagaaaaggctcatgtgctgatggataattttgagtcttctccattctctgtgaatgacccccttccccaggcatccccacctcctacctcgttcttagagcaaactaaagccaactgagggtgcacacacagccatgagcccacctgcccaggactactcccatctgcttcttcccgtccccgtggaagtggcccctgatatggattgtatctgtatccccacccaaatctcaggtagaattggatctgtgtccccacccaagtctcaggtagacttgtaatccccagtgttggaggaggggcccagtgggaggtgattggatcatgggggtggatttctcccttactgttctcatgatagtgagtgagttctcatgagatctggttttttgagtgtgtggcccctccccctctccttttgctctcttcctctttctccggccatgtaagatatgcctccttctccttcaccttccaccatgattgtcagtttcctgaggcctcccagccatgcttcctgtatagcctgcgggactgtgagtcaattaaacctctttattcatt

SEQ ID NO: 692225 - DNA, 950 bp, Homo sapiens
agaaccgttcgcggaggaaaggcgaactagtgttgggatggcaccaagtgggggagcctcttggagtgataaacaggagctagaggagctggcacggcatgggcgtggatcggggccctggctgagggatgtattgttgaggacctcacaggagtccacttcctcggaggtggtgagctatgccccattctacggctcttcccctcactggttcccagtgtcctgctggagcaagcctatgctggtgcatatggacttcacatctgcgtagatgggatgcatgtcgagacagaacgctgtccttcctggagcaaactctttccacgtaccatcaacaacaggtatgacatttacctgctcagtcatcttggtgatgatcgcactaagcaagtctcgtaaaagagggccttggccagaactgtgttcctgggccgtgaatcggtcagactagatgtctccaacgcgaagcggcagatggatcaccagagcgctgatcatcgtgatgcgagagtctaacgagctaatctctgcgcagctttgggggcgctggcctcggccggacccgagctgtgcaccgagatgttctcagtgtcctgagttaggaccaaccgaagctggatagatcctctctaataatcgcagtcgagggactggacctgggaatggccaaacgcctgggagctctacggtcacccaatgctctggctgatagtgatagctcgagagacggaacagaagcgatatttgaccaggcgtcgccaatgagagaatgagctacgtggccaaggagcatccatgtgatccgatgaacattcgagggttgtctctgaaacgggtcttggaccaacacgaaggcgtttgtggttggcaggaattggggggtaattcggggtgttaatgcttggaaaagtctaaaaatggagggtcacggggggacgcactgtgcctgc

SEQ ID NO: 692226 - DNA, 914 bp, Homo sapiens
ttttttttttaacatttccatataaagagctctgtggaatgtcatgaatagactggaaaaaaaaattttaagaacctgcatatgtggtttactagcagatgacaactacaaaaggaagtctgaagaacagcgtaaaacttgggtatttttattatgtttgtggggatagattaaaccatagcgggccttatttaaaaagggttaattcagctaaggggacaatgttatacttttgtgggtacttcagaactatatctttgatttgtcaaggttgtcacgaccggtaatttaagaatttatacggccacttgttattgtaaattttaagttggtctaaagtaaggaatggggtgaaaagctattatatgcgggagttggggctcaaaaggactttatgttggcaaaaaaaataaactacggggaaagaagggggctgtattattgaaaatacgggaagacctcacatttgtgggctgggaaaatttcccttataatgaccttacggaataaccctttgattttcccttgggtttacagctttctcaaaacgattgaaagtgaattttagcaaaattgttaaccctttttaaattaagggggtccccaatttttgacatggaatatggggtcttcttcaaattaaataggggtgtaataccccctttattgtggtcgtcaaccactctcagtcgggtaccacatcagggggcggtggcgagaccattaaaatatttctttcccccaggatctttttctttgggtggacacccctcaaattacacttgattactcgggtggcgttcacaactccaaaaattttcccgccaaattatcgcgtaaaaaacatggctcgggaccaaagacgttgggaaacacatggggccccacatatggaacaaacgctcgcggtaaca

SEQ ID NO: 692227 - DNA, 201 bp, Homo sapiens
gagctttgtctaactggctatcggagtgtattgtgtgcatagcgagcaggtgttatctgggcttcgtgctgtgactccacggggtgtagatggctggaggaggctgcatggctcgggtaggtacaccatgctgatgaggaacagattagccacattatcaggcgtcagcagaggctgcaggaactcagctgtgatgtccgt

SEQ ID NO: 692228 - DNA, 683 bp, Homo sapiens
  misc_feature (12)..(12): n is a, c, g, or t
cgtggaagacgnagccgcacttcccgggtgactcctccggccagccggcccctcagatgagggctgctccccgaagagcacctgcagctcagcctccagcagcagctgcgccatctgcagttggctcacctgccgctgcgccccggcagccaggcctgatggccaagatggctaccaccgcggccggtgtggctgtgggctctgcaagtgggacacaccctgggtcacgccatcactgggggcttcagcggaggtggcagtgctgagcccgcaaagcccgacatcacttaccaggagcctcagggagcccagctgcagaaccagcagtcttttggaccttgctctcttagagatcaagcagtttctggagtgtgctcagaaccagagcgatgtcaagctctgtgagggcttcaacgaggtgctgcggcagtgcaggattgcaaatggtttaatgtaatcaagaaattcaagctgaagagatgtaacattggttctgtataattgatagtacaagtgtggacccttatatttctaacagttcattgctttggaatggccgtgaaagagatctaactgtggatgcttactgaggcttgtatgtagtgttggttactggggaagtgtttggcctccttggactgtgttgtgattgtgagttaaaaaaaataaattggttattctga

SEQ ID NO: 692229 - DNA, 904 bp, Homo sapiens
gaaagatcatgtaccttggagttgtggaggcatgtatataagcagagctgagtttgccacactggaatttatttattcattgaacaaatatttaatacctactacaattcttagccgtctgttagagattgctggaggtccactacagacactgttttcctggatatccccagcagaggctacagaacagcaaagattcctgcctgccccttcctcttgaaggttgttccagagggacacctgccagatgccagccagagctctcctgtatgagatatgtgttgatccctgctgggaggtgtctccagtcaggaggcatgagggtcaggtaactacttgaggaggcagtctgtcccttagacagagctcaagtcctatgcttgggagatctgctgctctcttcagagccagccaggcagcaacggtcttaagtctgctgaaggctgcgcacacagacggcccttacacccaaggtgctcctgtctcacgggagaagggaagttaatcgtaaaagcccctgactgtgtcttgcttgactctctttcaaatatgccctgcccagtgaggcggacactgtagacagggacggacctggccacaggggggctttgcaatgatggaagctcagactggcccagacagaagtccggcaggtgcacaccgggacggggcaaacgtcgcagcaagctcaggacggacgggcctcccccacgacacggagacccacaggaggatacacggcgtgcggaaggacataagcaccggacacggggccacagcagccccagagaaaagcggcccgacaacacataggcaaagtgtcaagacacaagagagcacagcacacgagagaacggcacaaaacacacacagacaaacccaacgagcaacaagacaagataaa

SEQ ID NO: 692230 - DNA, 804 bp, Homo sapiens
  misc_feature (534)..(534): n is a, c, g, or t
gctcctctctccgtccatggggtgtgctcgcccattgtatatcggtgtactccggaaaagggggagtcatctggcaaacaatgtcactttggccatgctgatattactaggacgtcactaattgctgacctaagattattgtgaagctttgttctatcactctaagagcttgctgcaaaggacatacaggacaggccctattgactgtcgagtccgcaattgatgcaagtgtcaatcgaggactcagtgctgatctcttgggggtactggcagagctgtggctcgaattcccaaagtaacgacgtgctggtcgtggacttcagctggtcatggggccagagatcgccggttctgcgaaagccactggttgatcaggtggggaacgggtcccgtacacttgtttattgactaaaccctagagctcaatataggaccctgagagctgcccggctttggggccatttccggagttacgtaaaggcttggaaagcgaagcaaaaaccccgagaaaataaccaggcgggaaattagcgncggcctccgaacttcgttggcttatccatttggggcgccaccttttgcgggcctttggcctccggtgccaagggtctcccccgttaagctccgaagggcccaaaccttggggggtttctcacgttttggtttccgttcagggacaccggtgtgtcccaatttgcgcgggttcacctttgcggacacgcgggaacaagtgttgtgcctccttgtggacaaggccgttgtcccccttttcccccggcggttcacggtgtgtcgacgactgag

SEQ ID NO: 692231 - DNA, 107 bp, Homo sapiens
agtcgcctacatttcacgctacttcttctcattttccagacatagacgctccatctgcttctggtgcttctcctcccgggcctgtgccattcatctgctgcagctca

SEQ ID NO: 692232 - DNA, 1070 bp, Homo sapiens
  misc_feature (613)..(613): n is a, c, g, or t
  misc_feature (729)..(729): n is a, c, g, or t
ccaacgtgacaaaaccccgtctctggtaaaaatacaaaaattagccaggcttggtggcagttgcctataatcccagctacttggaaggctgaggcaggagaatcccttgaacccgggggacggaggttgcagcgagctgagattgtaccactgcactccggcctgcacaactagagtgaaactccgatctcaaaaagaaaggaaaaaaaagacaagcttgcttcccaggttatgaccttgggggctgagttgtgcagaaaagaccaattaggaagagcttgaccaggggctttggagctggggaaccgggggattcacttgcgtgagccaccaggccgggccaggttggatttaataagtacttagaacaagcttctcttacagaactccagccatttaaacacataggtccatgtatatgaccctcgtcttcccataccaattcctccggtaatgggcctggtcttcggtaggtaccctaatctatttataaggttatcaggtacaacggtggtctacactggataagattcctttggcacctggtttatacaccctgccccagaggctaaagctggtgggtccaagtgtgggtaacgccattaaccatatngtacgctgtcagcagttaacacggtgactacaggtaatcaaggtttcggacgatgggacgtctcagctcctggcaactcccagccgtgagttggacatgaggcagaggaattcccnggtcgaaaaatatatatcacaccgccgatacaaaagcagacgaacatcgagcactcttgtgggccccacacccatttataacacgtgggacacgggcccacaaaagtaccccagtagtgaccacgccgaaactagggcgacccagcaaaaaaaattcaggggggacggaacatagcaacaggtggggaccaagacgggcaaaaaggcaaaggagacggagcccaccaacacgcagcagagcgacccaaaggtcgcccccttgtgacacaacaagagaacaccacagcagggtggtgacaaaagcgacgagcggccgccgcatccatcacctaccaccaaca

SEQ ID NO: 692233 - DNA, 266 bp, Homo sapiens
ctctagaggatccgcgaaaatttccagtatgctctcctgtccatcagcagctctccattccctgttctgtgatcgtggcctcagtcctggtgtccttccctaattccagggccagtcctacctctagacattttgatttgttatccaatacagatccttggattatttataccaggtgagtcaggttttgtttgtttgattgtttgttttattttgtcacttacaacaaaaaaagccccgaaaaaccactggaaaaatacctggta

SEQ ID NO: 692234 - DNA, 982 bp, Homo sapiens
gtctctcctcccgccgtccaagatgccgaaaggaaagaaggccaggaaagaaggtggctccggtcccagatgtgcgtgaagaagcaggaggctaaaagagtgtgtgaatcccctgtatgataaaaggcctaatgaatttttggctaggtttggaccatggatatccagcaccaagaagagatctctatcccgctattgtgaagatgggttcccgtctatatcaggttgcggtcggattgaggagccatgctctataaacggctgaataggtgcctcctgtgattaaccagtatcaaccagtgccctggcaacggcaatacagctactcagtctgcattcagtctgggaccactaagtgatcagtaccattagaacagtgctagagagtaaccataatgactgtttggctccgggggctcgagtaacgaaggtcgtgctgccaaaggcgggacgtcccctcgactgataccatcgtgtgcttgctgcatcctagagagtttatcaccagtcaaccgccttggtgtatatacaacgacggtgctcacttggtgttgatttgcagacgacgtggactccatcaaagcttggattgttttcttgacaagccctgtgtccgttagaatgcgggtccattacttgcttatcacggaaagccaaactgggacgtagtagcctacggaagaacttgagccctgcgcctcacgaggggactcggcgggaacaaggcgctggctaagccggggaaccataagaaggagaaaagaaggaactgagggagcgcggccggggggcaaccccgggcccaacggggcgatagcagcaaaggagcgcacaaactcgcaacagaggagtggacggggggcgccgacaaaggagcatcgccgacaaaaaaaagggcgccgccaagacaggcgcacgagagaacaaagcagaaacgcaaagaagaggtcacagcaacctagctcgcacagcacacaacaga

SEQ ID NO: 692235 - DNA, 116 bp, Homo sapiens
cggacgtggtgtgtattttgaagcagatgtggtgatactgagattgtcgtcagtttccccatttgtttgtgcttcaaatgatccttcctacttgcttctctccacccatgaccttt

SEQ ID NO: 692236 - DNA, 692 bp, Homo sapiens
cataacacaccacgctcttcgccccatgtaatagggaaagtgagaattgcccaccacctcaccactgcgtttatctctcctcttcgctctcggcggcaatgcttttctcgtgtttcttcgatattttgtctgtctaaaatacacgcacaacactcctgatcccctctcccctcttcgctatccgcccttctctgttgtctagacataaaatttatgaatcatcttactctctctttctttttttctctcgatctcacctctctgccacaacgcgctagtctctttctgctctctgtcggggcgtgtcttgtctctgtatagatacaccacgactcagcctgcccacgcgccccccgtcttcgcgtggccaccgctcgcgcttcccgctcgcgcgcgcgtgtcaggaggcccgccagctgtctctctcgccctctgcctgctttcccctctccccgcctctcctcctcggcagaggtgcggctctgtcgctcgctggtcttcctctctcggccgtctcgagtatgtgccgcgtctttctgtctctcctatgtcgtcgttacctcccctccctcttttttttcttctatagagtacattctcttctgtgtgttttctgctcctctctaccaataaacaaacatagaatacaataattatactacctcccagtacccatagaagacatacaaata

SEQ ID NO: 692237 - DNA, 143 bp, Homo sapiens
attaaaaggatttttaaaaagtaattactgcacataaaatgataaataggtaattggaataatttgatttgcgctccttggattagttatttggtctatcgcctcagctataactccaaattgctacatactatggggaatta

SEQ ID NO: 692238 - DNA, 596 bp, Homo sapiens
  misc_feature (350)..(350): n is a, c, g, or t
tttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctcagtttcattttcatctatgctattgctattgttgactcatgctaccgctngatgtttgcccttgtcatatatcaagaatagggcgcatcatgtgtccccgtgaaatacatttgtgttgtgctatgagcctctggtaatcaaaatgcttggtactcagatagagaggtgtaacaatcacgcatgttgctatagtaacaataatatcttcataattattctggtgtaatctttataacatacttatgacaacccccagtgagggttacttaataataaaatgttattaaaaataatgc

SEQ ID NO: 692239 - DNA, 294 bp, Homo sapiens
agtcacaggatcatagctcactgcagcttcaacctcctgggctcaagtgatccttccacctcagcctcctaggcaacaaggaccacagcacaagccaccatgcccagtaaatgttttctacttttttgtagagatggggtctcactttgttgcccaggctgtcctcgaactcctggtcttaaacgatcctcccaccttgacctctcaaagtgctggagttacaggcgtgagccactgcacctggccgaaggggcctttctttatgatacagctgtcgacgcggccgcgaattta

SEQ ID NO: 692240 - DNA, 115 bp, Homo sapiens
atcaggccgtcagatcccagcatgaactaacatcacgccagccataccgagcaaattaaatccacccacttttcgccaaggacatacaacgccatcctagcggatataggttgga

SEQ ID NO: 692241 - DNA, 365 bp, Homo sapiens
ttttcagagttgaaggacacaggtttcctaactgaaagggcccccccaagtgcctagcataatgaataaaaatagatcacacagccgggcgtggtggctcatgcctgtaatcccagcactttgagaggcccaggtgggcagatcacgaggtcaggagatcgagaccatcctggctaacacggtgaaaccccatctctactaaaaatacaaaaaaattagccgggcgtggtggcgggcgcctgtagtcccagctacttcagaggctgaggcaggagaatggcgtgaacccgggaggcggtgcttgcagtgagccgagatcgcgctcctgcacttcagcctggtcggcagagcgagactccgtctca

SEQ ID NO: 692242 - DNA, 909 bp, Homo sapiens
  misc_feature (24)..(24): n is a, c, g, or t
  misc_feature (46)..(46): n is a, c, g, or t
  misc_feature (74)..(74): n is a, c, g, or t
  misc_feature (87)..(87): n is a, c, g, or t
  misc_feature (122)..(122): n is a, c, g, or t
  misc_feature (135)..(135): n is a, c, g, or t
  misc_feature (144)..(144): n is a, c, g, or t
  misc_feature (150)..(150): n is a, c, g, or t
cctcagccagatgccaccacttcnccgggcgtccagagagacctgngctagcacgctgctgctacagaggtagngctgaaacctccnggctcactactgactttcagtctagggctatgcantggacataacgancatacttgnaatggntaagtaatattccaccatatgatgtgtggttaattaacatctggtgaataaccaggactttaggttcccagttttcccaggaacatcatgcccctccatcattggcccacctggaaggataactacaggataagcagctcttagaactggaattgctgagttaactgctctgtgcatttccttgctttttcttgcttttcttttctttcttttattatttttttgggtaaatttttattgaactatagcatagcgtagatacaggaaagtgtaaaaacttaaatgtacaattcaatgaattttcgctaggcaaacactgtgtcaccagcacccagatttagaaacagaatattaccagaatcccaaaagccccatgagctgccgtccagtcactacttaccgtttccctgatcccctgcataggataatccttatcatggcttctgacactttcggttggttttggatgtactgacactttttgtgtgtgtgtgacacttttataatacaaagaaaatcatacagtatgttcagtttggggtctggcttctttcactcagtgtgttgttgtgggcagttggagtatgtttattctcattcttctgttctctttctctttggttgagtttactgggctggaagcagtacaaggaccagaatatgctgtgagctgaccagccactgggctggctggctggttgacaaatgacctaacaaatggttgacaaaatggatggatgaatgaatcacagacccact

SEQ ID NO: 692243 - DNA, 263 bp, Homo sapiens
ttacctcacaggtaatagagctgtgtgtcatcccttgatgcatcccgaatatgagtagaggtcagttctaacgtagcaccaagcatccctccagtaatgtcaagacctgtatagctcttcctccatttccactccgcttgcccccaaatcatataactgtatttgtcacttacaatcccatcacaacttcagctaacacatcagcagcttagccaactcaattgcagtctgcatagatgtaaaacagttgtcacaatgcccaa

SEQ ID NO: 692244 - DNA, 100 bp, Homo sapiens
cgacctagaggatccggcggcatggggctgtacgggagcaaagctccttctccgcagcgtcgacacacagcagctcagcccgccgatgatgcaggctgcg

SEQ ID NO: 692245 - DNA, 734 bp, Homo sapiens
gccgacccgtgcgcaaccttcccccggctctgtcgctcccaaggctttctgcagccctccgtgctccaggcctgcacacctgagggtgggaccccccggagtgcctgagccggtgtcggatcaaactcgtgagaccgagcagggcccaaaccgggacctgtgagtggggacgggcgtgaggaatgccaagatggctctgatgacctgatggctctgcccacccctctggctgcctgcctggacccgtgcgccactgtggggaatttcccttccctgacttccctgctgctgtgactacatgccccagctcctgtccatgccccctgcttcctctgtgcgcaccactgggggccagtggacgacggtcgatgccccctgaagactcctgtcgcatgcacccgtgaggggagtcccggggcccccggtttctggcctacgctaagctgggacctccatcctcgggcagctggtttgcatctgtgcccccctggtgcataggcactcttgtgtgtgaactccctgcctgggcggaattcaactctccaggggcccattgtgttcccagccaacgcacgggcttggttcaccgcaaggggtgagtgagacggcctgccgcgcgtagtaaggtagcaccccactaggctatttagaccagtttatggtccaggcgcacctggcttggaactgggccttcctcgcctcccggttacgccccctaacggggcctgttcaac

SEQ ID NO: 692246 - DNA, 730 bp, Homo sapiens
  misc_feature (123)..(123): n is a, c, g, or t
ctggccatccgcgagtccattgaaaatgagtcagacgggaacgtgataggcagtacaatccttctgcaatgaagctgaacgaggatgacacagtgcgtgagatcagaaaggaccatttcgagnaggccatgcgctttgccgccgctccgtcagcgataatgacatccgcaaatatgagatgttcgcacagaccctgcaacagagcagaggcttaggcagtttcagatttccatccagtaccagagaagatagtggaacaagtcagggctcttctggtggtggaggcggcaacgtcttcaatgaggacagcgatgatgatctttacggataaatgtgaccacgttgctgaccctcacaggccactcttcataaaggccgccatgtacaaaagacaaaaaataaaaaattccacatttttaggactgtgctttttttgtatcttattattttccgcttctcatggccattccccctgtttattattcgcttcgttcccttcctgtccacccccttctgttgatagagaaaagcatgtagctgcttgtgttttgctctggtttgtgaaaggatgatttctgagaactttgatcttaacattctgtgggtgggggtgaatttcagtgaaaaccatacacaatagtgatttcagtaacttttcacaagctatatgagcagctttagtggtggggtttattgctaggccgttggaaggattaaaaaaatccaaaaa

SEQ ID NO: 692247 - DNA, 218 bp, Homo sapiens
agatcgagctcggacccctagtttagaagttcaatagcaggtcgacgtgcgacctaacataaccatgtctaaagttaactatagtatattatcctaactactaccgtagtccgtactactacacagttaaactgcagcaccataaccttactgttattgcgcaaccgaaacatattatcctgactataaccgcgtactgcatacacgctcgtctgcct

SEQ ID NO: 692248 - DNA, 894 bp, Homo sapiens
ggggcctgcgtgctcagcatggaccctgaatgcgcccgctgctccggttctctgtgctgttctggtagatccatgcagccgttggcagatgatacctgtttgtgagacatgctcctggactggtttactgcggtcgacttgaaggagattcctgtgtcgtgctgctgcttgagcacccctgcctggtggcagctgttgtctccagtgtgctggccaagtccgaggacctgagtttcatgttgggtccctcgtccattctcgacctgcgccatgtgaataggaagcggcttcgcagcccagtgattaaacttgtcttcccagtatcttccaggtgtgctggtccgatagtcatcttctccctcgcagggtagacgtccagccttgtttgtggcctctcgtcggccagtcagcttcctggtgcacgtcctggctttgtccatgcgacgtggagccgaggggcgagtcctgcctgtcggggggtgactgggccgtgtgtgtccagaatagtatcatgggatcacggttgcaaggagtccttgggtgctcctgcgtgcgtccccaacggttcgactcagtgtcctgtaacgttctgaattacgaaccttcgtggcgctgtccgaagcccctggatggcatgcccttgtgggtgcgggtgagtccccgtgtggctggtctgctgtagatagttccctgtccccgggcgtgacactttgttcgtggacctgcttctctgtgtggctcgtttctcccgtgttcaggttcttccgacgtggcagtcttgtggcgagacagtggcgccgggctctgacgcttgccgtgggtccacccgtattggacccctggcttggggatccttagtgctcaagcactgttccccaggcactgaggacccat

SEQ ID NO: 692249 - DNA, 126 bp, Homo sapiens
gacatactctcgtattcccttgtcccacctcccacccccagcctaccactatggtattctctgcttctgtgagttaaactttattagattctacatatgagatcatgtcatatttgtcttctcgag

SEQ ID NO: 692250 - DNA, 134 bp, Homo sapiens
taacataaaaagcaacaaaagtaaaaaaagtacttaaatgaagatgtgaatggattcatggcaatacctcagacagaatacacagatggttcacaatgggcacaattatagcaagcagacagatgaggacagta

SEQ ID NO: 692251 - DNA, 1144 bp, Homo sapiens
  misc_feature (1)..(1): n is a, c, g, or t
ncgcggtccttttttttttgcttttttcctctttggttgcttctgtcctctttctcccgctcctttgttttctgtggcttttctcttttctgcttctcctcgtgtgtgccgcctccgtgattttggcctaggtggtggtctctttcccttcgttgagtgggcctgtttcccgtctctttgttcgcgcgtgtttggtttccgcctcccaccttgttttttgtgcgcctcctttgccttggacgggtccttcctccccgggttttttttttcttcaccccctgttttttccttccccattccttcctttggcctcaagttagcttccccggtcgtgggccattgtccgttttcaaggttgctgcaaccctgttatcgtgcctctgattatcttgggtatagcagccacacagaatgctgcaagcctttgttagtccctgatgtatgagcccatggtggtgtaagatgaagatggtttgcggccttgccccagatctatctccagcaccaggcagatattcttctggaagggtacgagatctggaagaggccccggttaataactgggccccagatccgtcatcatccagtaccagtttctgccttcagagcttccagatgagcccttaagaagcctcttctattttatgccagaccccggccccaagactttgcgttccactttcccaagccttttgggctttcggggccccacactgccccaacaccccagcactctcccctaagtgcctgcccataccccctgggcctggcccccgccccagtctccgcgccagtacatcccctgtcccctctccccactcccacaagtgccttcaatgccctatgggcccccaccagtggcctgcccctctcccacgagtatttatacgcgtccacacgagtatttatttaaccgctgctgtacctccgagtcttgaattctgccggggccccacgcccacactccacaccctgccacgcacagcttccacgccacgtccccaccacgcctcactcaagctctcttcacccggttttttgataactaatcttcccccaccccccacgctaacccacatataggggctgcagagttataagcccccaaccggtcatgctcccattaaaatgattctacctacca

SEQ ID NO: 692252 - DNA, 191 bp, Homo sapiens
atagctgtataaaatacacaagataaagaatgtggcaacaagtgtggagaaaagggaaccctagtgaacgtgttggtgatgaatggaaattagtacatgctctttatggaaaacagtatggcggttcctcaagaaaattaaaaatagaaccaccatttgatgcagcaatcccacactgggttaatgtagca

SEQ ID NO: 692253 - DNA, 1433 bp, Homo sapiens
  misc_feature (60)..(60): n is a, c, g, or t
  misc_feature (177)..(177): n is a, c, g, or t
  misc_feature (233)..(233): n is a, c, g, or t
  misc_feature (262)..(262): n is a, c, g, or t
  misc_feature (660)..(660): n is a, c, g, or t
  misc_feature (1248)..(1248): n is a, c, g, or t
gatcgatcgacgtctctagctgagaagactgacggcccgcagactgatatgcgcgtatcngttacctcgccactctctctgcgcaagtcggtcgatcattgtgaagagctgagtggtctgcaaccatggatccctcttggcacaaggccgtctacgtggtagcatcccatacacgtngacgacgcatccctccatggacatatgcgtggcgtgctgcctggatcatcacatcnagcgatcatccagatggaagggtggcccntttagtgggagctccctccccatctagctaagggctatgtcaatcgtggtcgaggtacaacccgatgcgcctagatcgcgcacacaaatgttgtgtcgtctctcgcgattgctcaatacacacacagacatgggacgcctaagttggtctgtcgaacgggacaaggcaatgtcgggtgccacaagctggactgacattcggtggagactagagcgagtctcgcggttcttaaacacaattgatcgcacggggggccgcacggcaggcgcattcgttctggctacttatgctcatagagcggttggttaatccgtaagcggtgggttacgaagagacgcgtgaaaacaattaagaggacccaggggaggtttgttgccaaacggaggtcgaaccccaancctgagagaataaaacccgacctggcttggattttcgatcaagcgaccggtttggtcggttgatcctccggaaggcggcttagcgctcatatgtgtcgagggcgaatcgcctcgagagcaatatccccttgagtgacacggttggggagcttatcaaagctacaccgccccggtcgaggtaaccttcttggctcggcaaaatgggcatcgctccacaccatttgaggaccacaaaacttgggatacatgttatagagaggctcccctgaagcggtttgccacccatttcattcaaagtttcacgcggggtgtgtggagcaaccccacctttctatttggtcgcatgcggaggccaaattcgcgctcttcccaatggggtctggtggggacgatcccgtgtgtggcgctcggtgcccctgggctggagacagttttggggccagtatatcagatgtaactccataattcttgaaaaatgcagtaaaaagttaaccggtgtggtcccatggggcggcgacagttcgaacacaagcgacgcgagaagctggccctggtgtcgcgcccagggcagcaacccacattggggangccaacgagggcgttttttgcgacaccgtgtgtgtacacaccccaacatggtatgagccttggtgctcaattgtggacgacacgctattccaagccggatttctgcaaccctagggacgcgtgcccgcatcctgaaacaccaccgtggtggtgctggtggtggcgcccccctatatacaccctcg

SEQ ID NO: 692254 - DNA, 402 bp, Homo sapiens
  misc_feature (17)..(17): n is a, c, g, or t
  misc_feature (76)..(76): n is a, c, g, or t
cttttaagggaacttancattcctaaagttcaagtcaagttgtcatgaagaagtacttaaatgaggcatacttttnaatctttgaatcgtagtgttgtagggctaaaagaaacctcaggccaggctgcatggtggctcacgcctgtaatcccagtactttgggagaccaaggcaggctgatcacctaaggccagtaatttgagaccagcccaaccaacctggtgaaaccctgtctccactaaaaatacaaaattagcctggtgtggtgatgcatgcgtgtaatcctaactactcgggaggctaaggcagaagaattgtttgaacccgggaggcggaggtttcagtgagccgagatcatgccattgcactccagcctgggtgacaggagccaaactccgtctc

SEQ ID NO: 692255 - DNA, 207 bp, Homo sapiens
caaagttggggctggaacttggccctggggactcatgtttggaatcgtaggggaacatttggctgttaatcccttgcccagttgaaaacatttcctaaacatcggcttttaattttagctcttatttcattttggaattttattttcttttgtcggcatgttcccaaaaccaagccttaaatgttttttaataactaaaaaaaaaaa

SEQ ID NO: 692256 - DNA, 200 bp, Homo sapiens
tccggcccgtggttggagtgactatgaatatagcagttctacggtacaagcctaagtaccatacttaatttagagctatttatagttatcctaaactactaccgcattcctactagtcaacgtgaaactcgagcaccacgaccctagctactatctcgtcacctgtaaacaagctaaacatgactaacaccctctaattc

SEQ ID NO: 692257 - DNA, 80 bp, Homo sapiens
gcttgagctcgggagttgagagcggccagggaaatgtggcaagaacttgtctctacagaaaatacagaaaatcggaattc

SEQ ID NO: 692258 - DNA, 214 bp, Homo sapiens
gagctctgagcatgatgatggatcatgggcggtcgtgctgcagcctgctctagtccctactgaagagggagaagcgactcctcctctgatacattaaaataaggctggtcttgtgctgttggtgtggcaaggtcttcaccaatgtgacgtaactgtagtctcacagtccacaacatctcagacactcactccccatagcctgcacggcactcct

SEQ ID NO: 692259 - DNA, 810 bp, Homo sapiens
gcgtccaaattgcctgttttactcgcagtgctctattcctgttcgctggttctgccacctcagtgtgaactgatggccatggagtccacagccactgcctgcctgtctgcctgctggagctggtttctgcctgacaaaattgaagatgttcctgctccttctacatctgcagataaagtggagagtcttggatgtgtgatagtgaagctaagaaactattgggtttatggacagaaacatctggtgatgggtggatattccagcagctgtcaatgcattccatggaagcagctagtcttttatggtaagaatggtatgtgagagacatgctaatgagtgtgtgagaagccttctttattctatgtggaaatcacttctggagttggcaagaattggagaatggtgtgttgggaaaacgccttggaaggtgttgcattgtggaatgaggaagaagtgatgaaaaacggaagattgaatctctgttagaaaagtaatgataacatagatgaggaaagcaaggggaagagttgagagaccaggttaatgacgccatgggacgaaaagtgaagaagccaaaaaacatgaacgaccaaggtctttggcaacagccttgaacgtgatacgagccacgtaccttgacagttgagaaggtgtgcacgagacgcatatggatatagtacattgagacagagccactggacaagtgcttgctctagctggtaacttaaaccttaacagccaaggacggcaggccaagtccgcataactaggcctctgggacgcaacaggggcaatgccggcgcagccaat

SEQ ID NO: 692260 - DNA, 240 bp, Homo sapiens
ctccgtacgccaaaatgcattgaaagttagaataaaaaaaaatacacacacacacacacattaaagaaaaaaaagaaatttataagaggttaatatggcctgcccgggaacgaaaaaaccaagacagtatttagtcattaacttcttggctatttcatcaattgtaaatagtttggggcgtacggaggagggccccggagcccgaattgcgaaatccagggccataggctggttcccggt

SEQ ID NO: 692261 - DNA, 139 bp, Homo sapiens
cagaggaccttaagcatcctaaccaggagctcagactctgaagaggctctgtcgggattggcggaagcagaagggaggtcactggtgttgtggctgctctggaacactgggtgctaattggctcccttggcgaaaggag

SEQ ID NO: 692262 - DNA, 159 bp, Homo sapiens
tatgacacacagtcagtgtgcacgtatttcgtctgagtgaactgaggggacctgatgaaaccggtgacgtggcacacgggaagccagctggcccaggattccgtacatggccgcaagctagacctacacgcgtcgacgctaactttaatgctatcccac

SEQ ID NO: 692263 - DNA, 169 bp, Homo sapiens
cctgataagtggtgagaaggagtagagacaaagaaagacaggaaagaagataaggaaagcaacagatgaaagaaagagaaaaaagagggacaaggaacaagaccaagaaaacaacgaacaagaaaaaaggaaaaaaaaaaagaaagaaaatagaaacaaagaaagaagt

SEQ ID NO: 692264 - DNA, 267 bp, Homo sapiens
agttcccccgcgcgggcggggttccctgcggtccatttaccatgccactgggcccctggaggagcggcagattgcctacgtctgccgagatggcctgatggggctccaccacctgcattctcaggggaggatccacagagacttcgagggagcctaccttctcctcactctccagggtgatgtccctctggctgactttggggtgtctggcgagctgacagcgtctgtggccaacaggaggtctttcattgggaccccccccgcact

SEQ ID NO: 692265 - DNA, 567 bp, Homo sapiens
acctggcttcttcccagcctacctggttttgaaacttccagtgacccacagacccaggctctacctatgggaggtgatgatgatggccttgccagactcgtgggcgtgtgccacagcattccagaacaggcgccgggccacggggtccatgccagtggatggctcatccaggaagatgaaggcaggctctccaatcagggcgatcaatgccagtgctcaacttcggcttgttaccaccaccgggggtggaagggagaaggttgggtgacggcaatggtcagtctccagcagtgagcactgccggctcaacactcaccccctttccttctctattcaggaagtattcccacacccctcatggggctttcagcaatgcagtccaccactttcacccagagctgaattgtggcttgggctatccactcaggaaataacttgttcccctggacacagggatgagtccagggtgagcacatggccgacgagtcttctttgagggtttgaagtgttgagggcaagcacctctccatctgagaggaaaggcattggcccaaaaaagctaactta

SEQ ID NO: 692266 - DNA, 878 bp, Homo sapiens
  misc_feature (431)..(431): n is a, c, g, or t
agcggctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccaaccggccggccgcaggccgggaacgcgggccggacttccggtggtgggttcctggttaagaacctgggtggcacaagtntccggcaagggccaatccagggtgaccggtgtccaaccctataacaggtggtaggatcctcgtccagcgtggtgaccgtgccggtgtaccttaccagatgacctcgagccccaggacaaaccatcgtcattcgggaagtacaagtctttgctgccgggaccgcatcgccgatgccttctccccgggccagcgtcgacaagcagctcaaggcccagctggggcagccgggaacccgaggtacaaccccatacgtggagtgccaggacagcgtgcgcaccgtcggggtcgtggccaccaagacgggcaaacgctgagaccgtgggaagattactaccagggccggaggaatcccaatcagcgggaaatgctgacctgacctttggaccaaggggtgggaaagacagcggtgtggaatacggggacggggtcacggccaagaacctcagg

SEQ ID NO: 692267 - DNA, 799 bp, Homo sapiens
  misc_feature (1)..(1): n is a, c, g, or t
  misc_feature (25)..(25): n is a, c, g, or t
nttgacaggatggctatgaagcccnctgatataatgtttaacaagtccctcaaagccttgtctcgcagtccttaatcctttaatcccacatggaatacctgagaccatctgtcttgttgcccctcaggttgccccatattctccagagtcactagtagggccagcagcagccccttttggcctgtgaggtttggggccaataagcctgttggggtgggaatgaagtgtgggctttgaaatcagatggacttgggccaggcaccattgctcacgcctgtaatcccaacacttcggtaggccaaggtggaaggattgcttgaacccaggagtttgagaccagcctgggcaacatggcgagatcctgtctctataaaaaatacaaaaatttggccaggcacagtgggtcatgcctgtaatcccagcgctttgggaggctgaggcgggtggatcacctgaggccaggagttcaagaccagcttggccaacatggtgaaaccccatctctactaaaaacacaaaaattagccaggccaggcctggtgactcccacctgtaatcctagcactttgggaggcccaggcaggcggatcatgaggtcaggtattcaagaccagcctggccaacatggtgaaaccccgtctttattaaaaatacaaaaattagctgggcatggtgtgtgcgcctgtaatcccagctactctggaggctgaggcaggagaatcgcttaaaccagggaggtggaggttgcagtgagctgagatcgcaccagcgcactccagcctgggtgatagagcaagac

SEQ ID NO: 692268 - DNA, 699 bp, Homo sapiens
ttgtccagaaatgagttggagaaatctaaacttctgacagaactacccaggtgttctctctgatgtccaggaggagaaaggcatgaagtacaaattgaagtatatgagaagaatgattaatatgaaggtgttgactagtttaagctgttcccccttccctcatgataaaagtgaatgtattttgacattagaaaaggtttgcggttgactttagatctataattatttctaagcaacttgtatgtgattccccagctactctggtctcatatcagataccatgttatgagacattctggctataactaagtgcttcgtccaagacccgaactgagtccccagcacctgctacagtgagctgccattccacacccatcacatgtggcactcttgccagtccttgtacatcgtcgggctttgtcacatgtcggtaatatttattgaacagatgacagatccacatacccttcaactgagcagtttcacatagttggaaatacgcaaaagcttcctacgtgtatatccagaggtcgtagataagtgtggccaccttgtcgtaacagtgcagacattggacaacaactggaagtccagtgatgggaaaatgagtatgtacctgtcttagatcgggaaccaaagcagatgcaagactgaactttccgtgaaggcaggcataggtagggcatacagaagtcatca

SEQ ID NO: 692269 - DNA, 123 bp, Homo sapiens
  misc_feature (31)..(31): n is a, c, g, or t
  misc_feature (38)..(38): n is a, c, g, or t
  misc_feature (69)..(69): n is a, c, g, or t
cggagggcgatgtcgattgttctgccgcgcncacgctngccttcagcttgtcagcacccaggctacttnaaggatcccttccccatctcagccgcctcctgctattgtacctttatcgttatg

SEQ ID NO: 692270 - DNA, 303 bp, Homo sapiens
ggctgtctagaggtcccaggcggacgctactgtaacttttcagtacgtcacagttgcgggggctccacagaagttatgcagggaaaaggtgacgcccccagaataccgcccgtgatgtagtacgaccaaccgtgaaatctcagaatccaggtttacaacatcgtgggcattagtgaactccagtccatatgccattcacttatacctcataacaaggagtcgttgagtagataggccggtggcggcatctgctggagcgtttctatttccaaaccaaacataaacaccatcatttactacttg

SEQ ID NO: 692271 - DNA, 433 bp, Homo sapiens
aataccccaaaaattaagtttttctttttccaaggtgcccacgccacccctatgtcacgcctgaagtagttattgagaaagtcgtccctttccccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttggggctgatgccattttaggcctcagcctgtctgcatgcaggcgctcattaaaacagcatgttgctccaaa

SEQ ID NO: 692272 - DNA, 374 bp, Homo sapiens
  misc_feature (100)..(100): n is a, c, g, or t
  misc_feature (141)..(141): n is a, c, g, or t
  misc_feature (152)..(152): n is a, c, g, or t
  misc_feature (190)..(190): n is a, c, g, or t
  misc_feature (205)..(205): n is a, c, g, or t
  misc_feature (211)..(211): n is a, c, g, or t
  misc_feature (215)..(215): n is a, c, g, or t
  misc_feature (225)..(225): n is a, c, g, or t
  misc_feature (353)..(353): n is a, c, g, or t
gtgttcctgttgcttggactttaacaaatattatacataatctggggatgtacgtattttgcatgcagtgaaaggaacacctttcgaaactccctgaccnagggtaaaaggcaagggctccctaacctccattggggaacnactgggacctnggagtaccgttttacatccttcacgggaagtttttccncaatttctcccaatnaatccnatantttccgggcnagtttcctatcgaagtatgatccaactcacttcatcctaaacacagcttctctcctgagtgtactaattcccaaaatgccacaactacatggtgttcggatctttgggattaataagtattggaatgntttggactggaaaaaaatttt

SEQ ID NO: 692273 - DNA, 659 bp, Homo sapiens
cagcgtaggtgctaccaccgttgccgtcgccgccggccatcttgatggcaggaacgcagtccggtgtctgggacagctggagacagtggtggctgagctgaaataactttacctcgaaacggaaatgcgtattgttgcgagagctatctgtcgtcctacgacgtgccacgcatggccaagtgtgactatggtgaacagagtcgctagtactgggtttccatatctcccaggatttcgctctttagttaaaagggtggtcaagtcccaaagcctgttcgaatgcaggatcatcaggttcggatgagtctcatgtggcttgctgcaccttccagatgatatagctctcgaacagtgatggccatgatgagaacgtactgggaccctttggtacctgcaacgatcggagaggttccagcttcctcgggagacataggtcctgatggtcaccgtcaagtgggacgtagcattcacgagaagaaaggcctggattcgataaaactttggcgtgatgttctagctagaaccgtttatcaagtgagagacgatgagtttgtagatggcacatatatgtgaatgaatttcagggtaatgatgcgagctgttgaacaagacattaacagtggggaatcttagttttgaaggtgcggagtagagtgtgc

SEQ ID NO: 692274 - DNA, 249 bp, Homo sapiens
  misc_feature (26)..(26): n is a, c, g, or t
  misc_feature (129)..(129): n is a, c, g, or t
gatcgcttaggctgtggtcagaaatntgttagaagaggccttcagctgccatctggcagagcatagcagcatgccacagtgtaggatctctgtagggtcatgtagttgggttcaggaagttctcctgcnttagtgatgctgcctggcaggctgttgacctgctcgtcgcaaatatctttagcctcctgcggtgagatgagaacaacaggccgtggagggccattgtctttctcgtttgtttgttccgta

SEQ ID NO: 692275 - DNA, 142 bp, Homo sapiens
tagaggatcgttacatgaccaagcatgcatgcatgcgtgttatcgacgtgtattcaccactgcggtgcatgccttccctgtacaagttccgtctacacgtgagccggcgtgctgacctccaaatatcgttaagctggagcct

SEQ ID NO: 692276 - DNA, 1287 bp, Homo sapiens
tggcatctcccattttttttaaatttggcaattttattattttggcaaattattttggagagacattgtgatttttctctcccgcggtgcctccccgcggttctctcccgtggcggaaggtgcgcgtgcgcgcgcccagcccgtggtcgcccccgcggggggtgattcccttcccttccgtgccgtgcccgccagccgtgaccgtgtgtgcccggcttcgggggccgcagcctcggccccggggcgccccgcgggagcttctcgggcgcgaagtgaaccattagaagaacgcctaacggggagggcggccgcgctttccgtggaatatggacaaggcgccagaaacaacaagaagaagccacggtgagagggagccgagggaggcggacttcgcctggggagccgagggagcgaagagagacgaggaaacagagaaagagagaggcgcaaattagcgcgtggcccagaggcgtgggcccacaatcacccttctccgtggtggagagggaacccccccgggatgtggagagggcgcccaaaccacgcgtggccacctctgtgcgtcttcacaacagcggtgactatccccccggacggagcgagagacaaaccccaacaagaagaaaacggcaaagatgaggaaaaaacaccccaatgaaccaggcaacaagagaacaagagaacagaagcaaaaaaagacaaagagaggaacggcacaagagcacaaaaaaacacacacaagaaagaaaaagacaagtaaagacgaaacaaaacaagaaccgacggggacagcaacaagacacaaaaccaggaagcaagaaaggagagacacactactgacgagacagagacgaaagtaaaagcgacaaagaacgaaacacagcagagaaccagagagacgaaagaaaagaccaagaccaaactcaaaccaagtaccaacgacaggaagacgctgcggagggagagaggtacaggccaaagagaagcaggacaggagcaggaggaagcagaggaaccacagagagaagtacccacagacgcatgcaagacgacaagagacgagaaagcgcaacaggaacaaccggcagacaaagcacagccacacaacgagaccgagacgagataagaaacaaacaaaaacaaccccaacaaacacgacgtaacccagcacaacagatcaaagaggaacacccgcacacacacgacaaacatacacagaagacaccaagccaaacagcgacatggagagagaagtccataaacgataggacagtgattagcgaacaa

SEQ ID NO: 692277 - DNA, 449 bp, Homo sapiens
caatcatggctctaagggtgccaggcagcaggcagcaaagctcacttgggaagcagtcttggtctttcagcttcttccccactgaaacactatacactgggtggccacagttcatggcaaaacacacacaaacacacactctctcacagtcaaacacacatctcaccaagttggtggcaggtagctctgggtatcatgggtctggcattcgcccattcggattctaagctgtcctaaagctctttccagttacttcccgctgtttccgggccgtgtgttgaggcactccagcttctattctgtcacgctgatcgtcaaggcacaagtgtgggcaagtcccctactgagatggccgtcgcttggaagcagtggagctaaggggcccgaaggtgccaaggatgatgtaggcttcctctgctccgtcagacctcaaagataggatcagtgtc

SEQ ID NO: 692278 - DNA, 194 bp, Homo sapiens
  misc_feature (129)..(129): n is a, c, g, or t
caacgagccggccctacttagaagagacgagatggagacaccagccccaactctcggaacaagaaagatgactggggaggaaacacaggtcagcatgggaacagtgtgtcacagctggacacgggggtngggctgtactctccacctcctacacagttaggctaacagggaacgcagcacacatatcagagtgc

SEQ ID NO: 692279 - DNA, 222 bp, Homo sapiens
tctccatttgcaatgttttcttacattttttaaagcactttttaccccccttttgcccaaaatttcatgatatccaaatgggtagttacagtcttgtcccgtcgctgcaactcccgtacggactcgggagaggcgaaggttgcactgctttttgacacacggctcgcttaacccggaaaacagccacaccaatggggtgtgcttcacagggtaccgagctcg

SEQ ID NO: 692280 - DNA, 544 bp, Homo sapiens
agcacaaggcttcacgctttacgaccatctgtggttttcagtgaacaacgcgctgagcaccagcagactagaaaatcaacaacaagaaaaacacctcgttttttaccttgtcttctagacatgaaagaggcagtcgcattccactctgcattatgttctacatgttgctttagtcagtatatgctatagtctgtaagtgacaaggtatttttttctgaacagaagtttacttagaaataccatgcacttgggggtaccaattaaccgcctgaaaattatgcatattgatagtgcttagagagatccaggatagtagagttcgtaagaatttatagtgaaagattgtgtatcagttagagccagaaataattttatattaatatataatacagattaacattatatataatatgtacgctagtggttcacattccgtgaacgatgagcctagtaaacagtatattcatatactgtacctgcacatgtacccacacgtgatgtaggtcttattcctttagtatggacttaaagtacttattcataa

SEQ ID NO: 692281 - DNA, 448 bp, Homo sapiens
  misc_feature (74)..(74): n is a, c, g, or t
  misc_feature (87)..(87): n is a, c, g, or t
  misc_feature (94)..(94): n is a, c, g, or t
  misc_feature (103)..(103): n is a, c, g, or t
  misc_feature (152)..(152): n is a, c, g, or t
  misc_feature (223)..(223): n is a, c, g, or t
  misc_feature (247)..(247): n is a, c, g, or t
  misc_feature (372)..(372): n is a, c, g, or t
  misc_feature (399)..(399): n is a, c, g, or t
  misc_feature (403)..(403): n is a, c, g, or t
  misc_feature (407)..(407): n is a, c, g, or t
acgatgattacgccaagctacgtaatacgactcactagtcaatgacagcaccttcacccagtaccgcagctggnaccttgcatacanctacggngaccctcanaccgggatccgctcatggaccctcctttgcactcctgacgtaacctgcngctcggagcaggtctactggtcgttgccagacatgatgcaagaccccgtgaccttccgctccacgagccanatcagcaactttccggtggtgggngccgagctgttgcccgtgcactccaagagcttctacaacgaccaggccgtctactcccagctcatccgccagtttacctctctgacccacgtgttcaatcgctttcccgagaaccagattttggngcgcccgccagcccccaccatcaccancgtnagtnaaaacgttcctgctctcacagatcacgggacgcttccgctg

SEQ ID NO: 692282 - DNA, 377 bp, Homo sapiens
  misc_feature (170)..(170): n is a, c, g, or t
tggtgagggtgatctagaggatccctctaccagctcattcttttctcccaagtaaatggtgtagcctgtattaatggtagacgtcatcttcctgaaatatccatttagcaggttaatgccggtggagctgcagtggggccggagcctttcttccaggcctctgttattgnaatccacctaccgcggtctatttggagctatggggggcctttggaacgggttcatgagatgcgttggccaagcagaaggctggtacagaagcagaacaaagctctgagcattcctgagagttttctgttgagaaatgccatgggtttatgtcttcagcctgccttgggagccctgcatatttttacttgccgtggggaaggaggggg

SEQ ID NO: 692283 - DNA, 136 bp, Homo sapiens
ccgcaggaaaaaaattggtttgggtttgtcttctgtcgtaatatacacaatgacgtttggaatacaataataaagtaacagtcttttgcactgaggaaaaggttgtgcatgaaacatgaactacaaatagttgttg

SEQ ID NO: 692284 - DNA, 151 bp, Homo sapiens
atcacccatccagcaacatcgagccacccccgcgccccgcgactagacgcgcgcacacacccacgaaactacaacactaaacgggaccccccacccgcgaccgtcacacatgatcacgaccacacccccgcccaccgcagcccgagcacgc

SEQ ID NO: 692285 - DNA, 244 bp, Homo sapiens
aaagcagaatagaagttggggatgctacatgatccaaataatgagcttaaaaggtagtaacaggaagtacatttgtgagcaaaagagctactcctgcacaggtacagtgccacacagactgtggtacctctggagaatgcaatgggcttctgacaggggagggactgctctccatccagaagggactggcaaagaggtcagaattggctgggcgaggtggctctccctgtgatctgagcacggt

SEQ ID NO: 692286 - DNA, 278 bp, Homo sapiens
cgatctagcggatccttgatatgtgtctcaggagtcatgaggagaggtggaactacttgtatatctatgtaaatggggagagcatggtaacactccaatccagcatgacacaataagctaaggtttagataatttaaggtggttttatggtctttgagcagaggctcatatcatagtagcttaagactcatggaatgccatgtcaattattgcataccaattttttcatgctgtcattctatagggcgtcgtgtgtgtgtggtgtggtgtgtggtgtg

SEQ ID NO: 692287 - DNA, 299 bp, Homo sapiens
  misc_feature (64)..(64): n is a, c, g, or t
acctgtcgcgcgagcacagcttcgggtggaccggtcaactcagctctacgcactgctgctggtngacctggcgccacctccccgccgagtcacctctgcggtgcacgcctccctggacaagttcctggcttctgtgagcaccgtgctgacctccaaataccgttgagctggagccccggtagccgttcctcctgacccgctggggcctcccacacgggccctcctcccctccttgcaccggcccttcctggtctttgaataaagtttgagtgggccgcaaggtgctcggcggccgcgag

SEQ ID NO: 692288 - DNA, 168 bp, Homo sapiens
  misc_feature (23)..(23): n is a, c, g, or t
aggcgggtctgaactgggccggntctgaactggggctggcgcgttctgagattttcgcccacggaaggatcctgggtaacctccagggcaaaaagtcttagacttcggttgcagggccagctcagttcctcctgcctgatgaggttgagccccgatggttgtggacac

SEQ ID NO: 692289 - DNA, 485 bp, Homo sapiens
ggaagaaaaatatgatccaggttatgaggcatcatattgtggtgcttacggagaacatccatgctacagtgaaccttgtggcttctcttcaaatgggtctaattgcacgagcgtggagcttaagatggagaatcagctcttcagtggcattcctaatgggcagtggatgacccaatcatttacagaccaaattccttcctttactaatcactgttgacacacaagaacaggaatatagacacatgccatgcttctgaatggtgcttctcagctctggttatatgctgcagtcttaatgcacttgtcaacaagtataacctcattttgctaactgaaggtgttttattagtattttactctagtggtgtaattgttgatgtagaacagttgtgtggtagtgtgaaccgtatgaacctaagtagtttggaagaaaaagtagggtttttgtatactagcttttgtatttgaattaattatcattccag

SEQ ID NO: 692290 - DNA, 129 bp, Homo sapiens
tccccgtcccgccgccggccgcggcggcggcagggagacgcgcacgtacttgctcgcgattcagcccaatctcggcgccgaggcgggcgggcggccggcgggccgggccgggcggcctcgtcgctcgct

SEQ ID NO: 692291 - DNA, 308 bp, Homo sapiens
  misc_feature (170)..(170): n is a, c, g, or t
tctcacgctgctatgaagaaatacctgagactgggttatttatgaagaaaagagggttaattggctcacagttccttatcgctggggaggcctcaggaaacttacaatcacagcagaaggcaaaggagaagcaggcaccttctgcacatgatggcaggacagagtgagtncaagcagggaaggtgccagacacttataaaaccctaagctctcgtgagactcactcacttattatgagaacagcatggggaaaccgtcgccatgacccagttacctccacctggtcccacttttttgacagattgggg

SEQ ID NO: 692292 - DNA, 206 bp, Homo sapiens
cgcgcgccatacctagtctaacattgtgtgtgaggctgctagaagtcatcaaaaagctattagtgcgagtagagtttgaagtccttagagaggattatgatgcgactgtgagtgcgtccgtagtttgagtttgctaggccgaatagtagtgaggatgtaagtccgtgggcgattatcagaatgactgcgccggtcaagcttcaggg

SEQ ID NO: 692293 - DNA, 327 bp, Homo sapiens
acccctaccacgtcatgataccagaaatgttgatggctgatgtaatacctggttcttatcttcttagttaaaaagaatttaaacaagagacacacagcaaaagaagtacagcataatttattgcaaaaaaaacagagaatattttgaaaattaattgcagaatagacggtacagtctgagaaagagattccagggcagcctgctcataaaagtgagacagcgctaattattgctggagaaaccccctttatgggagttttgcatgattattcataagaaggtggaaagaagcgttgcagaaagcatgttctgtacacatttgtgcat

SEQ ID NO: 692294 - DNA, 879 bp, Homo sapiens
  misc_feature (254)..(254): n is a, c, g, or t
gtgtacagtgataactgagcagcgagtactataaataagtgactcccatgggtgcgactcagtactatggaataaatccgcacagttggttagtgcaccgacgcagaggtcatggtagttatgctcatgatgtgtgtgcaggttttacttcacatgatcatcagagtacataaataagaatgaggtgggtagttacatccatctcctgatgtttacgtaggcctaataagaagcgtgatgaattaggtcgaagnacaagaaggtcccatcgtatgctcttctctagagttcaataggccacttataagtgacggagactcaggcgtgtaaagtgacttcggcatgactagtctattcccataatttaacaatagcgtgcatgtgtttctacgtgctatagcataaaatccacctgagaaggcctgaggctgaattggcctccccataggattcccttcaaaatagtccagagtcaacaaatgttcccttgtggcttttccttgcttgcaatatggggaatccacggtcatgtggttcccttaatctgtagcctgggtaattctatgggccttagcaggtgggttcaacttggaataaatagcggtcattgccagagcttcaatactttggaatgggtgtaagagggagcacatcccggagaacattataactcacgttcgagtgtgacctgagcattagcttcgcgaggtcacgtgagacgcttttatccaggagttgttacccccctaccgtcctatataagtggaccttttcgtggcgccaaggaaatgagggaagcaaagctcgtagaggacgaaaccatatctacggtggtaaaaccacctgggaagccgaatatgaaagcttgggacttagaag

SEQ ID NO: 692295 - DNA, 366 bp, Homo sapiens
  misc_feature (81)..(81): n is a, c, g, or t
gctgggcgctagtaatataatcgtctgtgacgtggcgagaagcgcattgcggcccgagagcaccccccgggtaacgagatntacagagacgattacgtctcgtcttcgagattgatgggaggcggcagcggacgtggtgccgcaatctgtgtcttttgtccaagatgttcctggaccacaagacgctctactacgacgtggacccctttctgttttatgtcatgacgatgcggacggacaagggatgccacattgtgggatacttttccaaggaaaaggagagcgcagatgcatacaacgtggcctgtatcttgactctcccgcagtaccagcggaaaggctatggccgtctcttgattcagttct

SEQ ID NO: 692296 - DNA, 215 bp, Homo sapiens
tgccgtctgttcactgcgccttgactggaaaaagctttactaggaagtgcctgccgttctgttttatgtcatgacgatgcggacggacaagggatgccacattgtgggatacttttccaaggaaaaggagagcgcagatgcatacaacgtggcctgtatcttgactctcccgcagtaccagcggaaaggctatggccgtctcttgattcagttct

SEQ ID NO: 692297 - DNA, 310 bp, Homo sapiens
tatcacaacctagggtcgtcttgcaggtggtagcatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgcggaatgaggtcattgtgcccgcaggttgtttgtgattagctgtttctaacaattgttcatacaatcattgttcattattgttctcaacttggggctctccccaacctggggacccttcctta

SEQ ID NO: 692298 - DNA, 99 bp, Homo sapiens
catggatttgctggtgcagtacaactaggcttaatagggacatgtcactgcactccagcctgggcgacagagtgagactccaactcaaaaaaaagaaaa

SEQ ID NO: 692299 - DNA, 491 bp, Homo sapiens
agcgttcattgcttcagatagatatacatcctactgtcggtgctgtgcctataactgtaggatcattacctctgctaggtgggttacctattacaccaccctaagtcaattcaggccatattaccggttactctcttctaatttcatcacctcattatctaagattaactacgtgaggcggcaagatgagaattaggtgtcacactagataagacgttatatgtataacagtataagagaatcctatagctatcttgggagtcttatctatgtttttaaagtaatggtattttcctaattctgttttttcgatttgctatgcttacctctcacttatgtttaaggttgaggttgtactatctatgtaggtaatgagtaatgactaatgacgcatttaaatttattaaccttgtactttggtactctgtagtttaatatatatatgtactcccaagtttccttagattgttaattaagaaaattttcggacc

SEQ ID NO: 692300 - DNA, 261 bp, Homo sapiens
caataacatcagagagcaggagacgcatgctgcagctctaacagtccaggcctgaggcgctagaaggtgcgttaccaggtgaggtccactctgcccggtctcgggccgaaccagggggctgctgtggcctgatagtccgagtggaacaaagccaactacgtgcgatataaatgtctggaagattctagagatctgcagcatgacaggacccgtatctggatcattcatccaatgggtgctgtacagtgagtactcccagca

SEQ ID NO: 692301 - DNA, 226 bp, Homo sapiens
gcgtaaggcgagtcgggtatgggcaatgacacggatgacttggcagtacttcttccatgctgctgaaggccttctccagctggttcttggcatcctcaatctggcatttcttgccgtacttgggtaaagggcttccttccttaaaattattggccattctttataagaaaacggcttcttggcattccttcaacttggatggttgctccaaggcaaaagaacaggt

SEQ ID NO: 692302 - DNA, 148 bp, Homo sapiens
atgacaaactctgcaagtacgtacacggcacagcatttgcgtctgcacaagagggtacgaaggagggcgaggctgtgacaccctggagatccacaggactgggctactttaggagttcactggtcgtgggctatcggcgatgtgcagc

SEQ ID NO: 692303 - DNA, 156 bp, Homo sapiens
tgtccctattgcatataaactatcatatatagaaaaacaaaagacttacagtcacgatggctcacacctgtaatcccagcactttgggaggaggaggctggtggatcacttgaggtcaagagttggagaccagcctggccaacatggtgaaactcc

SEQ ID NO: 692304 - DNA, 124 bp, Homo sapiens
ctggggcttctagaggatagagatttttgagctgagcaagatcccggattcggtcccccagtgagcgaatggacaggtctattggcagagagataggctaggatgttcataggtaggaatacag

SEQ ID NO: 692305 - DNA, 118 bp, Homo sapiens
ccaattttttccctaggggaaattgtttaggcttagggcccttggttcaaatatccccagggaattgccctcggtccccccctattttcccaaaaataaacctctcccccccttttta

SEQ ID NO: 692306 - DNA, 399 bp, Homo sapiens
  misc_feature (8)..(8): n is a, c, g, or t
  misc_feature (399)..(399): n is a, c, g, or t
tgaggcgngagaatcccttgagcctggaaggtagaggttgcagtgagccgaagttgtgccactgcctccagcctggatgacagtgtgagagtctgtctcaaaaaaaatatatgtatatatattgttaagactaaatgtcttaataaataaagaggctgggaatggtggctaatgcctgtaatctcaacactttgagaggtgaggttgaagtatcacttgagcctaggagttggagaccagcctgggcgaccatgggagcctcccatctctacagaaaaatgttttttaaattggctgggcatgatggcatgcgcctgtggtcctggctactcaggaggctgtggcaagttgatcacttgagcccgggagttcaaggctgctactgtgagctgtgatcgn

SEQ ID NO: 692307 - DNA, 518 bp, Homo sapiens
tctagaggatccctcggtcaggttgtactgctttaaagaaataccgagaatgggtattgataaagaagagaggtttaatcggctcacagttctgcaggctggacaggaagcctgactggggaagcctcaggaaactgacatgaatgtcagaaggcatagggcgggcaggtgcatctaacatggttagaacaggagcaggagagagagtgagaagggaggtgccacacactattaaacaacttgatcttgtgagaaatcactcactagcatgagaacagcaccaagaagaggatgctagaccattcatgaaaaagcacccccatgaccgaaccatctcccaatgggccccagctccaacgttggggattacaatttgacataacatttgggtgggaacacagatccaaaccttagcaggtgggaaagcaggctcaagggataagagaatggcattgggaaaatgatcacgtgtcttggcacccagaggttggaccatcttgcactgactgacagtgttg

SEQ ID NO: 692308 - DNA, 1120 bp, Homo sapiens
gcagaagccttggaatcagtccccatcagaacctgagctattttcctctggccgcagaggtgtaggggtggaatgagccgcggggaagctggctttgaaacctcagggcatgtcccagccccggctaagccacaggaaggaggggacgagacaggcagacccagacagtgtggagaccctgccacagaccagaggagggcatgagtggagaatccaagggttgagagccagtggcgggtgatggccagcccctggggcccagccctgtatactggttcttgcaaaatgggagctgagcagcctctggacagccagtgacctttgacctcggttgaccactcttctttaagccatagaccctgaggccctgggctgggtgctgggaagggagggttgaaaggcaccgtgaaccagaagggtgtggctttccagtcaccctcagggagcctcaccatctgtccagctggggccagaggctggagaagtacctacctgattcaccgttggcggcgggtactctggaactgtaaaacgcatccaccagaatcacgcttatgcttgaatccagaagagccccataatcagtaagatggcatctagtgtcgatctgggacattatcctcactcgtgacctacaagacaggtttaagcgggccaacatttcccccgtttagcaccttcagggacatgcagtacctaggggatctagagcgtcaggacggctccttcagaggcgccaggacagacagaagcccaagaacggacgaacacagaggcgttagcacacagcagtgtgaattagcctggaccacacgcatacatacgatcagcgtcagaccccaattgtcggagactaaaggatcagaaaagcagacccttaatcaggaactgagcaaggacccaacgtgagttccagggaacaccatgagaacatgtccagaaaagggaagcggggggaaaaggagacataacaggcgaacaacacaggagaggagtagagacatagaagcaccacgcgatgacagaggaaaaagagacgcgaccgaagaggaggagaggacaaaagaaagaacagagccagggagaaagggcagagaagagcgaagagcgagaacgcaca

SEQ ID NO: 692309 - DNA, 492 bp, Homo sapiens
  misc_feature (480)..(480): n is a, c, g, or t
  misc_feature (488)..(488): n is a, c, g, or t
tgatgcctgcttctggcctctgtgagccccaggttctctccttctacctttgtgggaattaaactcaggtcatcagccttgtgcagcgaacactttacctgttgggccgcctcacagccctctccacacacacccctcctaaaaatacttatgtggggcagttggtggcacacacctttgatcccagcactccggaagcagaagcaggcacatttctcagttcaagggcagccagtctacaaaatgagtttcaagagagccaagagtttcaaggaggtctgaagagactttgggcctcttagaactggagatagagatggccatgagccatgtggtgctgggattgcagtcctgtccttcctaagagcagtgagtcctcctaactgctgggccatcaccactcttgtcttctgccccatactcaccctccttttttcctgagacagagtttttatatgtaacccagactagccttaaatntctagctntgac

SEQ ID NO: 692310 - DNA, 98 bp, Homo sapiens
catggatttgctggtgcagtacaactaggttaatagggagcttctaacgttagaagcttgaattcgagaaaacgttagaagcttgaattcgagcagta

SEQ ID NO: 692311 - DNA, 1145 bp, Homo sapiens
  misc_feature (1145)..(1145): n is a, c, g, or t
aaaaaaaaaaaaaagaaaagaaaaattaagggagaattttgggtggttaatggctgaggaattggcttgagtgggttagttgttaccaattttctctttggaacctttgggagctaaggatgctgagttctagagaaatgctagtctcaagcccgtgtttaagtccctcgtgtttctagcccgtagtttcatagcatcaggtgaactggagccacaacagcaaatttctattcagctgtggtgttaccattacagcttgggtgctgaagggcgaattttcttgtgagccatttacctcagtattaaaggcacttgagtttcataatcttaagggaattaactcttataagacgcaatatttctgggtacagctggtggcttctggcgaacctaaaaattatttcacaaggggcaggtaaggttgtggcgcaggaggagcgcaatggataaattggggccagggcacagaacaaatctaagcttcataataattggtctggggactatacaccctaatttaatggtaagttttacagaagtaatatgactttggattggctactataccacaaagagtttatgaactggagatcataaggggcaactggatgttgtgaagaaagtagtcagtacatccgtggctcatgctctgaaagaattatccagagaggctctctaaaaaatcagggaaatgtttcccatgccatgcaccctggtttccaagcattctgctgggtccaagtgagcttaatgcactgaagtttaaagtatataatatcacgggattaaattcccaacttggttcaactgtgatcctccaagttgggacaacagtagggcaaaaataaaatttcgactttccaccgttcaagagcggacatttataagcaaatagagaaaggagaattaccccgagatataagagggaaaagtgggtttcgccaaagattccacttatacacacatatagcagacacattaaggagagagggaagagaccagacgtgaaaataaggagaaacatcgtgcgaagcaagaaaaaaccagtgtaggggagagcaaaacaagcaggaagacaaacacgacaacagaaggaaataggtaaaaaaagaacgaccatagtattgtcggttctctttcccacn

SEQ ID NO: 692312 - DNA, 204 bp, Homo sapiens
ttgcccggctcattttgtcatttttcagtcagcagcctggttttgccatgttggccaggctgtctcgaactcttgacttcagatgatccatctgccttggcctcccacagtgctgggcttaccgtgcgtgagccaccatgcccggcctctttctcacctttatacctgtcttcttatcctcacatctgttttcacattttggcg

SEQ ID NO: 692313 - DNA, 104 bp, Homo sapiens
tggcccgggtagtacggtgtgtcaccggaagagcatcccatctcctgcacttgagacgcctctatcccaccacctgaagcattgcccctgtcccaccatttgaa

SEQ ID NO: 692314 - DNA, 260 bp, Homo sapiens
tggacagcacagagggtggacagcacagaggagctggacagcacagaggaggtggacatcacagaggaggtggacagcacagaggggtggacagaacagaggaggtggacagaacagaggaggtggacagccaggaggggtgggtgggatacagtgaggccaaacaaggcagaagcggatgcagtagtccctggctactgcccagcttccgggactcacagagctgggctcagccttggatctggcagtgctgagctaaa

SEQ ID NO: 692315 - DNA, 271 bp, Homo sapiens
gtaggccaaagggctgcgatcactaggcttgatcccatatttaccatggtgttataattgcctacagttattcgatgtatagtaatgtgctgtgcagtgttagaggcgtaggagcaataagcaataccatgtagcctaagtatgtagtaaactataccatctaggtttgtgtaattgcactccagtaatgttcacacagagtgacaaaattgcctaatgacacatttctcagaacatatccccatcgttaagtgatgcatgactgttatta

SEQ ID NO: 692316 - DNA, 1001 bp, Homo sapiens
cgccaatctaagcagcggctgtgaggaaaacatggcatgaggggtcgtctttacggaaatctgtgccacaccggccctaccatttacgagggtgaagctcctcgaacaccatggtgaacacttttcttgcacgaagtctggtcgccagcggcatgactaccagaagcattcactcgactgctattaatgcttctaccatgattgctgccctggtgcattgacacaagcctcaatctcatgcacccagttctatagcttcagttgccatcaccatctcatcccggggaggcagagatcctctggactatcaagagggagcgcaggggagacccttataaagctcgtcttgaatgccttgcgtattagataattgtggaacgcagagcgcgaaagtcctgcggattgagccgagccatggctgccccgaggctgggaatccccaggagaaaggtatctcgcgcggggttccttggcaccctacttcctgcagctagcggtacaccgcctggcggcgccagtgtgtcgggataccggggaggccgagatacctagcacgtctggcgagatgccgtcctggctggtctggtagcgcaggtggagtgatggctggcctctccgggtccatgcccctctgcgaggctctgtcgccgtgcggaaggcccaggctggtgccatgagtccagctagtggttgcagctttggtgtccaaggctcggagaggccgtcgtaggtccgtgaacgagacccgacggccgctacctgttgttccacttgggcttggcgagacccctaggtcctcgccttagccccgtgatcccctggggtgcccgagccgggattgttgttgtgccctccgatccggactgtgaccagttcggttggaccacttcggcgtgttcacgaaggctatcggggccgtccaccggccggcttagcgtttcgtctgctggcttggccggccccccgtttgtcctctccgggccctttttctctttccttgc

SEQ ID NO: 692317 - DNA, 271 bp, Homo sapiens
  misc_feature (260)..(261): n is a, c, g, or t
agggtctgccatctatgtgtagagaggagtatgtctgtacccaggctgagtgcaatggcacaatcaaagtttactgcagcctcaaactttggggcttaagcaatcctcccacctcagcctccagagtagctggtactggaggtgtgagctgctgtgtctggccatgctctattgttttcttggctgtgcagaagcttttggtttgatgtaatcccatgggtctactttggcttgggttgcctgtgctttctgaggtcctnnatctcaaaaa

SEQ ID NO: 692318 - DNA, 206 bp, Homo sapiens
  misc_feature (72)..(72): n is a, c, g, or t
tcccatcaaccaaaccccccttaaaattaacctgtgggtcagttttcttaaaaaaaagccaaatttattttncttatcatttagaatttgccattttcaggaacaaaactttttggacattggaaaaggaaaacattgcagtttggttttaatttccccatgaaaatcaagggtaatttttaataaattatttggagaaaaatgta

SEQ ID NO: 692319 - DNA, 1171 bp, Homo sapiens
aattcgctggatttttaagagcgcgttattatttaacgcaccgacaaaagtatagccctgaaacgtttgaagtggcctcattcttcttagatgatgtcattgcgatgatggttaaccataactttaccagcttcacgagcaatgaacgggcggtcgttaagttaaatgaagtcatgcaagccgcattggtcaatagtgatgatcgcgattggcgttactttgtgatgcttgtgccagtgctttatgacatgcaacaattcttggttaaagaaggtagcatgaatgaacgctttgtggcacaagcaccgaagtttgacattaacttctggcgcatgattatcacggtgatggcgattaacttcttcaagtggcaaggtaaagatgtggctgaattgatgaagacatcttctgcaatcgatgatttgcaattcaagttcttgcaggtggacgataaggatgatcactttaacctaccagtcattgctgagacgtttagaggattgtcaccaaagatgaagcccttaaagggcgctgattcagttgttgcgcttgaacctaagttgactgaagcgcaaattcaagctgaactcgaatttgctgacaagcgcttggcgcaattcaaggcggcttctgtaaaagatgtggtcagtgataacgtggttaacatgttacgtgggttccatgaaggattggcgactgaatatcaagcgacacatgacttatggcaaccagcgatgtttaatgcgttagcaacggataagttgtttaattattggtcaccggcttgggataaccttgatggcattggtggtgaggtgaaatcttatctcactttcttgagtcaaaagcaagatattagtggcttaagtgaatttgtgacagggactgctggtattgatcgctacattgatgtggcagccttgaatcatcttcttgagcaaatgccagaagatgttttggcagaacgtgccttataaaaataagtaaaaaggacaatcactattgaaatagcgattgtcctttttataatgtaatatgacgaatcgtaccaggtaaaatgatggtcatttgatgggttttgggggattggattaaaatttccccatgttgattctgataaacatagccagtaaaattcgtcacttcttcagatagtagtgacacattgact

SEQ ID NO: 692320 - DNA, 153 bp, Homo sapiens
acccttatgtgctagaccgttgataaaagtgtcaattgattgaatgacaaagtgaagacgaaagctctaacatccatttgaaagggataccatcttcagcaacttgacttgggcagcttgataaacaatggtttctgaaaatggcctgacatg

SEQ ID NO: 692321 - DNA, 601 bp, Homo sapiens
ctgcttcacagtgcttggacggaacccggcgctcgttccccaccccggcggccgaccatagccagcccgaccgtcacctcttcaccgcatccctcggacctgcccaaggaccccgcgccgctccagcgccggcagcaccgccgacgtcgccgactctccttagtcgccgccatgacgaccgcgtcacctcgcagggtgcgccagaacctaccagcaggactcagaggccgccatcaaccgccagatcaacctggagctctacagcctcctacgtatacctgtccatgtcttactactttgaccgcgatgattgtggctttgaagaactttgcccaatacttatcttcacccaatctcatgaggagagggagacatgcttgagaacactagatgcagatgctggcagaaacccaaacgagagattgggccgacatcttcctttcacggatgattcaagaaacaccaagcactgtgatgcactggtgaacagacggggctggagatggcaattggcgttgtgtcattaacattagggaaacaaaatcgtgcatcagtccctaaccggaaactgacgaaactgggccctgacaaaatggaccca

SEQ ID NO: 692322 - DNA, 229 bp, Homo sapiens
  misc_feature (87)..(87): n is a, c, g, or t
  misc_feature (99)..(99): n is a, c, g, or t
  misc_feature (128)..(128): n is a, c, g, or t
  misc_feature (134)..(134): n is a, c, g, or t
  misc_feature (179)..(179): n is a, c, g, or t
  misc_feature (192)..(192): n is a, c, g, or t
gtaagccggtttctcggatcaagcatactgaccctgcgatatcgcagcgttttgctcctcaatgaatacgctttcgcatttcttcanggggcgcgcccnatgcttcttagcgcgcttgtcaaaatatnagctcntcagtctcagctgaggtactctggcatccgttcatgtcattgtgntaataccgtacanactggtgtttcctcgtaccgtccactccatctacgcg

SEQ ID NO: 692323 - DNA, 272 bp, Homo sapiens
  misc_feature (87)..(87): n is a, c, g, or t
gtcgactctagcaggatcttaagctccaacaagaagcataacttattatgatagaaacagtacaaattcaaaccaagctgcagttanctcctttgagacaccaaaaaaagtagcctccatatggttaccattgttaattccataatccgctttacaataatcattactgttgtacttcaggggctccggactgcctttggctctcgaacacattttggctttgtgacatggacccaatttcttatgttcctataaactttcttacaccctgt

SEQ ID NO: 692324 - DNA, 336 bp, Homo sapiens
  misc_feature (5)..(5): n is a, c, g, or t
  misc_feature (37)..(37): n is a, c, g, or t
  misc_feature (131)..(131): n is a, c, g, or t
  misc_feature (207)..(207): n is a, c, g, or t
  misc_feature (264)..(264): n is a, c, g, or t
cctancccttgcccctgcaatttggggaatgttaaancccctatcctcataggagtgtgtatggggtagcatgaacctaaggtagataaaggcttcacgtggtgtttggcatggcgtaggtgtagattggncctcagttttctgcccatgtttgctcttcacgtacctgtctggtatctgtatgtgctaagctctgagccttacaanccatagggagagatatgcaaacttgccctcaatgagcatgttgtctagcgaggaagntgaaatgcatagacagacaacttagaggtggggtttgagggagcccaagaaataagcactgacaacacttta

SEQ ID NO: 692325 - DNA, 365 bp, Homo sapiens
cccagaaaaccaccttcgtccctgcccctcgtggccgatggctgccaatttatgtttattttgcccggctcatctgtcgtttactgactgcggacccccataaaaaccccgctcctaggaggaaaagacaggaggaacatcataagggggttttttcctacgggtcgcattgaaccccgccccaccccccgggtggggagatattttctgaaaaagggcccgcaaacccggagcacaccccctccccgctcttttgtgtgggtttcgaacgcactggggcccttttatataggggaaggcggagcgccctttttgaggggcgcgcgactctatatatacaagctcacaaaaaactccaagtccac

SEQ ID NO: 692326 - DNA, 717 bp, Homo sapiens
  misc_feature (364)..(364): n is a, c, g, or t
gctcaagtgactaaagatgcattactgcagatgcctcatgcgagacaccagtatgaatctcgacgcgaagctggccccactaatggcatagctctctgactaggatgattgctgacaggctcgggcactaggcatacttgagcacgctctgcgagctctacaacaaccactcaaatacatactgccacatacatgagacattgtccgaggactaggactacacttaattgagaccacgcagtgaaacattcaggggctgccacccctaaggctgtagacacattctctgggtgtcccattgagaggagcctttatctgtatgaacattggcacatacactaagcctactctatgcctgtcaganatacgcttttacataactggggaaatctggatgtctgatgccaaagggttgaagctccttggatacatttgctggatatacagccactacgttatttgtgatcagcggactttgcgccactgtacaggggactgcccatcagcagcagcattaggggcttgagttgtgcaccttgaggatggtgtgtccgcggacatgagaatcttgatgggtggtatatgaaatgaactacgttagcactctgatgatgggtttaaaatggacatcctcataactggtgggcgatgagcaggactttgttgcgactcgtactaatggacctggactgattttgggcttttagatttttgggc

SEQ ID NO: 692327 - DNA, 172 bp, Homo sapiens
atacacttagcacaatgttgtcagttcaagctgcggcatctgacagtatttccttccttttctatggctgaataacattccattgtacgtatatactaaattttctaaattcattcaaccatcaatgggcatttaggttgtttccatctcttggctattatgataccgcgaa

SEQ ID NO: 692328 - DNA, 100 bp, Homo sapiens
gtctatcttctgaagtcggctacagaagtcaatagcccaggatgtgtagcctttgagtttgatcacctcattagcactctcaagccacctgctttgtgat

SEQ ID NO: 692329 - DNA, 102 bp, Homo sapiens
gaatatagaggatccccgtgtgctgcttatgatgagtcgagcgtggcttatcgcccgagctggtgagcaacctggcgtcgctgctgatgcagcttaatctct

SEQ ID NO: 692330 - DNA, 309 bp, Homo sapiens
gggcttattcctaaatccccactttcctgatgtgtaaccaccacttacagtcagagtctcgctccctcatcctcaatctccctatttattgttccattccgaatgcctcctctgcccatgctaggtgtgctattgaaagctcagccccaaagaaaggaaaaggggagggcttgggcaacacgaggaaaaagccagctggaaagctgtgccttggacacagcagacagactgctgcccttgactgaaggtgacccctaaatacgcgtccacatcctaacccccagagcccgggaatgcacccttatttgg

SEQ ID NO: 692331 - DNA, 1391 bp, Homo sapiens
  misc_feature (209)..(209): n is a, c, g, or t
  misc_feature (554)..(554): n is a, c, g, or t
tgcgtactatcgttgtctcgttgtagaggttgtcgctacagtgagtttcgtgtgtggcaggatatggttgtcggttgtgtgattgtgtatgctgatggtatttcgtccgcgttgtatgttgttgtagtatgcttgccgcgtatatctcgcgtgtatgttgtgctagtcgttcgctgcgcgccgcagcggtcggggtgcgtgcgtggctngtggtctaaaatataagaaccagcaggagacaccttcgctgtttttgtaaggtgggaacgcccccgttgccgcaggagtttgccccccctgggggtgtgagtacacccgccccgattctccccaccccccgtgtggttttgtgggccgcccctccccacttgggaaagaccccctcggggggccccggacttgccccaggcgctcttctccggggaactttcttaggcctttatggcccccgcccggggcacccggtgattacaccccaaatggtgtgcgaagccacccgagggggacaccacagctatttggcacccactttaggcgcccttatatttttaggngtggacacacagctttatttaaggagaaccacaagtgtttggtgacacacacaagaaaagccacaggtctggggtaaccccggggtgcccgccgaaattttcccccgcgcgattaaattccggtgccggagcgccacacccgcgcgcttccccgcaagggtattgtaaatttatatttagccaacgcttttcttaaccccgctaacacaacccgctgttaaccactaacccccactttgtcctctaaagtgtgtgagacactcagtgtgtaatgagttgagtcccctcagaacttatcttattccgccactttccctcaggctaaacgtctcacagactgtttgaaagctctccacgcgcaccccaccggagcccctattctagctatttcttcgccacccgtgtgaaccacagcttataacactgagctaaccacccctttaatgtcccactgccacccctcccttctccctctaaggagggccctcgccccccacctatacccggctttttggccccacaaatgggcccacattattcgcagaagaaattcacccacaaaaccacaatatgccctcactcactctcccacccactcatatatagccacccactcacccccctcttataacctctatacttttatacctatcgcctatatctaactccaccctcacatcaccacctatctccccaatattctaacacacgtataaaaaataaatgaccacgtttgaaacaaaccacaaacccacccccacttcctccccaccacctcattcgcccttatccacgctactcctacctatctccccttttatactaataattttatta

SEQ ID NO: 692332 - DNA, 259 bp, Homo sapiens
aaaggcaccaaggggttaggagggaagggaaagggcaatggagttggggaataagaagcagcaggacttagtggggacgcagtgttctacttacacagcacgtcattcatagctccacgcaccagacttgctacccatgtgtccctgtgggctgccctagtgcttggtgtttggaaccccatgccccctagcctcacagtgcagctacaaggaccatgtttggggcagaatgccttgtgccttgcccatatgcacaggg

SEQ ID NO: 692333 - DNA, 106 bp, Homo sapiens
ttacttctgccaaaagatgctgcttctctccttattctttcccctcagaatctcgctgtctccttccgaaccaccttggccggcatcctggcgttattgcctaatg

SEQ ID NO: 692334 - DNA, 787 bp, Homo sapiens
ggacgcgtgggcttctctcatggttcttatctccccaccatcccaccctggggccctttcagtgactcctaaagggacagcctgatggcaagtggctcttctcattggcctggcttccccttgagactggggatgaggaaaatcaaacaacaaccatttcctgggtgtcctgggtgtttgcagcaggccatgtactaaggattcacataaaagcaacaataacgaatctcatttacacttcacaaatggaagtcaaaaaataccacctctattatggagatgtgaaaagagagacccaaagacctcaaacaacttaccctaaatcataggctaatcaatccctaatcaatccttagcagatggagaggcaggattcaaacccagaattcttaaccagtacccaacagtccatctacaatcttaacaattaccctctactgccccttgggccccctgtccccaggaccctggccagccaagactcacatccccaggtgagtggtaaccaccagaagtggctgtgtcagggctactgccattgattttctttttcctgttagctccttctggaatgccagggctcttcctctgccaatattcttttaactgtgggaaagaagagtagtaacactcatgagaacaatcagcccctatagccacatcctcctttacagttttgacaaaatactcttatacaccatctggtttaatgccaccaacaactgtacaaggtgttgtcacaatcagttagtgactgagagggattgatatcatggatagaaaaaaa

SEQ ID NO: 692335 - DNA, 378 bp, Homo sapiens
tgtgtggggggtggagaaaaaaaaaggagcggggcccaccacaaaaaaaaaaaaaaaaaaacaaaccacgggggggcccccccgcgaggggggttctcttccagagagaggagagacaacaaacaaggggacacacaccagggggggggagaaaaatatatattttctctctcacccccaaaaaaaaaaacacaaatgtggtattgatgtgggggagagaaaaaaatatttgaggaggtatgtgtgtgagaaaaataatttcttctcgggagggtggagtttctctcacacatatatatctttgtgggggggagaaaagaaaagctgctaaaaaaaatacagcggcaaaagagggggcgcaaaaaaaggggcgccacc

SEQ ID NO: 692336 - DNA, 661 bp, Homo sapiens
ggacgcgtgggcttctctcatggttcttatctccccaccatcccaccctggggccctttcagtgactcctaaagggacagcctgatggcaagtggctcttctcattggcctggcttccccttgagactggggatgaggaaaatcaaacaacaaccatttcctgggtgtcctgggtgtttgcagcaggccatgtactaaggattcacataaaagcaacaataacgaatctcatttacacttcacaaatggaagtcaaaaaataccacctctattatggagatgtgaaaagagagacccaaagacctcaaacaacttaccctaaatcataggctaatcaatccctaatcaatccttagcagatggagaggcaggattcaaacccagaattcttaaccagtacccaacagtccatctacaatcttaacaattaccctctactgccccttgggccccctgtccccaggaccctggccagccaagactcacatccccaggtgagtggtaaccaccagaagtggctgtgtcagggctactgccattgattttctttttcctgttagctccttctggaatgccagggctcttcctctgccaatattcttttaacttctgtcgctccaagctgcactctgctgttgcctttgactcatggtggctacgt

SEQ ID NO: 692337 - DNA, 121 bp, Homo sapiens
tcggaaacttataatgctgagcagctccatatacaaatgttctcacagcaataacccatggagctgagttgcaccttcccctgataacataaggcagtttacctattaggggagtgatgct

SEQ ID NO: 692338 - DNA, 148 bp, Homo sapiens
tgggcggatcccaaggtcaagagttcgagaccagtctggcccatattgtgaaaccccatctcttctagaaaaaaaacatactaaaattagccgggtgtggtggcgggtgcctgtagtccagcctgggcgacaaaaacagatttcctct

SEQ ID NO: 692339 - DNA, 229 bp, Homo sapiens
  misc_feature (27)..(27): n is a, c, g, or t
  misc_feature (87)..(87): n is a, c, g, or t
  misc_feature (93)..(93): n is a, c, g, or t
  misc_feature (105)..(105): n is a, c, g, or t
  misc_feature (143)..(143): n is a, c, g, or t
  misc_feature (146)..(147): n is a, c, g, or t
  misc_feature (156)..(156): n is a, c, g, or t
  misc_feature (170)..(170): n is a, c, g, or t
  misc_feature (174)..(174): n is a, c, g, or t
  misc_feature (210)..(210): n is a, c, g, or t
  misc_feature (224)..(224): n is a, c, g, or t
  misc_feature (228)..(228): n is a, c, g, or t
tattaatcaactgatgtcttgattttnctaaatgggaagattgctttatttttaacactaattatgggagcagattcttagcaaacntctttngaaaagttaatnttatgatgtgcattaggctgccccatcgtgtatataantcnngcagatttnattttcctattctnacgnttctctgctttgtagttgtggctgtacttaaagganatacagaacttccntatnc

SEQ ID NO: 692340 - DNA, 132 bp, Homo sapiens
gattacatgacattactttgtctctactttttcttcaaatagagattaagactcagttaaaaatgtactttattaactgatgaatctttttgctattgaaacttctaaaactagggaaagtgttgggggtgt

SEQ ID NO: 692341 - DNA, 166 bp, Homo sapiens
ggggtagttttaaaaaattgctgggggttgtggcttgcgtctgtaatctcagctttttgggaggctgaaggaggaggattgcttgtggggcccaggagtttgaggctgcagtgagctatgatcgttccattgcactctagcttggtgacagagcaagactttgtct

SEQ ID NO: 692342 - DNA, 108 bp, Homo sapiens
tttgaaaactttgcagggtgggtttggataaacttatcctctgggttcccaaaaggtggaaaaatttaggccataatttccttataaataaatctataaatattttga

SEQ ID NO: 692343 - DNA, 356 bp, Homo sapiens
cccccaacatacaccacccccaactcttcttcctatttccccttaggagagcaccacttcatgtcagacctgcgtgtccaaaccgaaaagagcgagaagcaatgatcttatcatcatacgctggagtcttaatggtgaggggaagcgcactgtatctgtgcacactttgtgtcttctaagatcatttggtgctagtgcatgtttacatgtttttaatgtcgcttctaaatgccttggatttactaacagtaaaatttattattttaaatgtataatgaaaaatttgacttccataccctatcgcaaaaatatttatgggaggtcgacgcggccgcgaatttagtagtagtaggcgg

SEQ ID NO: 692344 - DNA, 167 bp, Homo sapiens
cggaccactcgcagtttgtttggtgatgcgaggaaggaacgttcaggcagctgattccaggtactcgggactcttggtgcgatctgatgactgctcacagtaggaccatgacgtgagcagatttgtagtcctgcatgaatgaaggaaagaaagaaatctgacaactc

SEQ ID NO: 692345 - DNA, 480 bp, Homo sapiens
  misc_feature (186)..(186): n is a, c, g, or t
  misc_feature (199)..(199): n is a, c, g, or t
  misc_feature (202)..(202): n is a, c, g, or t
  misc_feature (239)..(239): n is a, c, g, or t
  misc_feature (245)..(245): n is a, c, g, or t
  misc_feature (319)..(319): n is a, c, g, or t
  misc_feature (427)..(427): n is a, c, g, or t
  misc_feature (456)..(456): n is a, c, g, or t
ctcaggaggtggggtttgatccactctatcctggttgctcatgccccagtatctctgtgtgctcacaggagcgtatggcagaatcctgacccgccctgctcacatgccccatccctgtctgtcccctgtcagtgaggttgcaggcccatgatccccgccaggcctgtccatctgtccccgtgtcgnagacagagacagncanccctctctaccggccccccctccctaaggccgccctngttttngcccatactcccccccaccacggcattcaggatgtggaggaacagtgacccgcgtgtggctcccacggctggcnctggctggtctggaaaagcatgcgtgtctgctttctctgaccagatcgtcatttcatgtgcttatttgccatctgtacactttctttgaagtacctgaccaaatattntgctcatatgtgaaaactggggtgtttantttcttactgagctttgagaactt

SEQ ID NO: 692346 - DNA, 258 bp, Homo sapiens
  misc_feature (8)..(8): n is a, c, g, or t
  misc_feature (10)..(10): n is a, c, g, or t
  misc_feature (13)..(13): n is a, c, g, or t
  misc_feature (87)..(88): n is a, c, g, or t
  misc_feature (106)..(106): n is a, c, g, or t
  misc_feature (116)..(117): n is a, c, g, or t
ggtactcntnctncacttaccgcaagctgctggagggcgaggaatgcagactcagtggagaaggagttggaccagtcaacatctctnntgtcacaagcagtgtttnctctgatatnncagtgcagtggctatgcggtgcctcggtggagatcttggcggcggcatcggtggaggtctggccggaggtagcagtggatgatactactccagcagcaatgggggtgtcggcggtagatggtgggcgcacgtgtgaaacgc

SEQ ID NO: 692347 - DNA, 1453 bp, Homo sapiens
  misc_feature (338)..(338): n is a, c, g, or t
  misc_feature (396)..(396): n is a, c, g, or t
tgggagacccagctgagacgctactacagtcatctcggcgggaaaagacggctcggagcagggtggtggcagaggtgggagaagaggtcaggtctggggaaatttcgaaggcacagccaacaggatgtactgccgggctggatgcggggtgttaggggtcagggaggccgccaaggctctgcctgagaactggggagggccaggggcaccatttacggagctggggaacagcaggagctcgttttgttagcaggtgcgaggcgccgggcatttaaaggcggcctgacgggaccggccgaggcggaagaacggacagggccctgcgggaccgcgctcgnatccgcctcctccctgacctcggcgtccccggctactgcctccagagccgcttcgggnccgaccccggggactcttcccgcctgcggcctcgcgccagcccggccggctcgcctagtgcccggcgcccagaacgcgtggagctgggagaggccacacaacccacgccggaagcctaaccccgtcggccccccgcggccggcaccgccggaagcccgcgaagcctaactctcgcgagacgcctcctgagtcccgcactctccgcggttccgccagtcgccgcgctcctgtctgcgttgctgtggcagccccgccgtgcgtccgcgttccccggagccagcgcggcggcgcgcctgtgctcggggcttggccgtagcttttcctcaggtcccgcgcggcgcgcccctgtgtcgcaggcgccctgccgctgcccgcagcttttggggggttcgggggcgggggaagcagggccgcagaaggcccaatcggagccttctgacacccgccccggcccgccgccctcccggagcttccgtccccgccgctggtccttactgacgcgcgcgccgcccccggtcgcccgttttccctgggctccggcctcctctcgcttccagccctggcctgaggtcctgagggctccctggagggggcggcttcccagcacccagcgtttaacagggccctttcggcctccctgtcccccaagctcagagttggggtctgcagcaggggaaagaaggagggagactgggcagctcaagttccccagaccgcacctatcagacggagggcggcccgctcccgtcagagcccgacctcggcggacaggggaggggatgggttgagaagcgggagaaggccactagctggaaactccctgacgacagggacaccgttctcgccccagccccagcgctcggcctccgcagagccggcccaacgaaggaagaatgaaaatatgaacgtgacatgatgtgggcttgagaggccgccttgttctttggattcacccagaaacctgactgaaaggaaagttactgcaactggggaaaagcacagttggctggagaatttggtttaaaaataaataaataagttttaaattatgtaactc

SEQ ID NO: 692348 - DNA, 248 bp, Homo sapiens
  misc_feature (201)..(201): n is a, c, g, or t
ttggctacaagactgatgaataccagcttcacactaatgtgaatgacgggacagagtggggcggctccatttaccagaaagggaacaagaagtaggagaccgcgtgtcaagtctcgcctggacagcacggagacagataacacggcgcttcgagaatagcagccacagtatcagaatggaccctagacgccgtgcttctcnggctaaacgtgaacacactccacgcctgattaggtttacggatacac

SEQ ID NO: 692349 - DNA, 111 bp, Homo sapiens
tcccgctgtacagttgcggctgtaggttatatagtgatgcagcagctaggactgggagagataggagaactaggactgttggtggattaggacggatcagacgaagagggg

SEQ ID NO: 692350 - DNA, 81 bp, Homo sapiens
gttgaggacacggctgtgtattattgtgtgaaagagggaagcccgtatagcagcaactggtacggagcctggggccaggga

SEQ ID NO: 692351 - DNA, 382 bp, Homo sapiens
  misc_feature (340)..(340): n is a, c, g, or t
  misc_feature (352)..(352): n is a, c, g, or t
gtagtgtatcacagtagtagcctccaggtttccttaagggcccacatcctgaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggcagggagaatcgttttgaacccgggaggcagaggtttgcagtgtgggtgagatccatggccantacattccagcnggggcgacagaggcgagatttggttttcca

SEQ ID NO: 692352 - DNA, 249 bp, Homo sapiens
gtatatcgctcacacctcatatcctgccctactatgcctagaaggaataatactatgcgctggttgcattatgagctactctcataaccctcatactacctcactccctcttagccaatattgtgcctattgcctatactagtctttgccgcctgcgaagcagcggtgggctcaagccctactagtctcaatctccaacataaatgcgtagactacgtacatacctacttcttgttttttttgttttta

SEQ ID NO: 692353 - DNA, 219 bp, Homo sapiens
ctgggaggctgcagtgcagtttttatgcaaagaaaccgataaagaaggtgtttttatgaatttaatggccttgatacgcatgtttaccattcgatttcggatggaaggcgccattggcgtggtcttgttgctgttaggtttgctcggtggcgttggcatgtggagcatgctgcgcatttatgacttgcaccaagactttattcaagtgcacttggctag

SEQ ID NO: 692354 - DNA, 927 bp, Homo sapiens
  misc_feature (4)..(4): n is a, c, g, or t
  misc_feature (105)..(105): n is a, c, g, or t
  misc_feature (134)..(134): n is a, c, g, or t
  misc_feature (139)..(139): n is a, c, g, or t
  misc_feature (156)..(156): n is a, c, g, or t
  misc_feature (176)..(176): n is a, c, g, or t
  misc_feature (303)..(303): n is a, c, g, or t
  misc_feature (322)..(323): n is a, c, g, or t
  misc_feature (330)..(330): n is a, c, g, or t
  misc_feature (337)..(337): n is a, c, g, or t
  misc_feature (363)..(363): n is a, c, g, or t
  misc_feature (547)..(547): n is a, c, g, or t
  misc_feature (558)..(558): n is a, c, g, or t
  misc_feature (567)..(567): n is a, c, g, or t
  misc_feature (569)..(569): n is a, c, g, or t
  misc_feature (602)..(602): n is a, c, g, or t
  misc_feature (614)..(614): n is a, c, g, or t
  misc_feature (619)..(620): n is a, c, g, or t
cacngcgtgttgctaacacatcaccacagacaatgggtccacgtcctgcagctgcagcccgctgcagctactcctgctgtccgcaccgatccacagtataaatangctgcaggagttcgcaatcctcagcaacntcttnatgcacagccacaagtnacaatgcaacagcctgctgntcatgtacaaggtcaggaacctttgactgcttccatgttggcatctgcccctcctcaagagcaaaagcaaatgttgggtgaacggctgtttcctcttattcaagccatgcaccctactctggccggnaaacgcactggcaggttgnnggagatngataatncagaccccctccatatgctcgagtcnccagagtcactccgttctaaggttgatgaagctgtggctgtactacaagccccccaggctaaagcggccgccccgaacgccgttcaccgtgccaccggtgttccaactgtttaaaattgatcagggaccatgaaaagaaacttgtgcttcaccgaagaaaaatatctaaacatcgaaaaacttnaatattatggnaaaaaaacntngccaaatataaaataaataaaaaaaggaaaggnaactttgaaccntatgnnccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtgaaaaa

SEQ ID NO: 692355 - DNA, 102 bp, Homo sapiens
gatcctctagagtcggcttcgtcctgtcctgctcgcccccaggaaacgtaatttggattataaaattcttgctttaataaaaattccttaaacagtgaaaaa

SEQ ID NO: 692356 - DNA, 165 bp, Homo sapiens
tgggaacgctatctggactatatatcaccaataacaacaaagatgatatatcgagccagaactcttagaagtagcggatctgagagaattgcagaatagcgtactagaagactgaaaataatgactgctgagaaacagctaccggcaagattgggatgctgtgct

SEQ ID NO: 692357 - DNA, 120 bp, Homo sapiens
cgtcgaccttgctcagttatcaattctgttacttaaaacagaactgacattctgagcaaggaaacgtaatttggattataaaattcttgctttaataaaaattccttaaacagtgaaaaa

SEQ ID NO: 692358 - DNA, 153 bp, Homo sapiens
ggtattgagtggcatgtgcacacacagtgagaaggcagctgcattcagctaagaagacagtgctcactagggctcctcaccaaatttgccagcaccttgatctgggatttctagcctccagaactgtgagaaaataaatttctgttgttcaag

SEQ ID NO: 692359 - DNA, 932 bp, Homo sapiens
  misc_feature (47)..(47): n is a, c, g, or t
  misc_feature (61)..(61): n is a, c, g, or t
  misc_feature (97)..(97): n is a, c, g, or t
  misc_feature (791)..(791): n is a, c, g, or t
  misc_feature (822)..(822): n is a, c, g, or t
  misc_feature (827)..(827): n is a, c, g, or t
  misc_feature (847)..(847): n is a, c, g, or t
  misc_feature (898)..(898): n is a, c, g, or t
  misc_feature (915)..(915): n is a, c, g, or t
ccattgtgctcttcaggctgggcgacaagaagtgaaactctgtttcnacaaaaagaaaagnaaaagccaagacatcaacatttttccatcaccccanaaacatcccccctgtgcttcttagtaatccatcctcttcctggaacccaaacctgggcacaactcatgcgttctctgtgcttggagttttgcctttcccagaatgccatggaatcatacggtgtgcagcggctcgtgtctggcttctccagctcggcacgatgctcctgagatccgagttgttgtgcgtgtcagtcggctgctcctcttcgctgctgtgtagcaccgctgttgtgtgaatgcaccgcagtttgttcatcgcttcctctgacgatggacatttaggttgttaccagtttttagcaattaaaaagaaagccaccataaacactgggtactggttttcacgtggacgtatgtttctgtgcagtcctgttttgattaaaatgtgaactcgtctactgccgtggtaggcaatttttggatgacttggggcctaaatgaagagaatgcaggcgcttgctgtgttctccctttctgtagtctgggactgccatggaagtcgtgtggtttctttgggcaggatggtgggtaatgcgggaattcttttatctatgccctgttccatcttcatatgcatgtcccctccagtgcccaaaagtttgcaaacacttagagcagcgatcagatgttttgctctactgaccccaaataaatacatgctgtttgcaaagaacagaggcaaggaggctttntctcccatttcacgaccccacttggcagagnaaagnaaagcattaggttgctgaantctaatgctttgcttacagctatgagaagtacagtaaatgctggttctganaaaactccacgtccaanaaaatgaatgaactgcc

SEQ ID NO: 692360 - DNA, 539 bp, Homo sapiens
tagtcaggagttacccagagtgggcgaaggaatatagagaaagaggaagacagggcagtacaaacgccaggtcgctctacctacggcttgagtgaggtcatttttgattatgtggtttctgactgattccaggctgaaggatatcttccatagctaagaaggatatttagaagaaaatatttaaagctaaaggctaaataaccaaatccaaatggtaggttgtctgttgacatattttgctcttggctccatatcctttaaatataattaagcaaatttttgatggaccaggtacaaaactggtactgtatagggagaaagttactgtagaaaatccatatattttccccatcttctaagactctaagatctagcaagagtttaagacataaccattcagcaaacatttgtcaagtgcctcccaggctcactatgtacagctgcacaggttgtgcatagcacaattgcaggggtaacatttacaaagattacctgtgaaaggaccccattagaactggtagtgcatgacctaacccagc

SEQ ID NO: 692361 - DNA, 144 bp, Homo sapiens
  misc_feature (118)..(118): n is a, c, g, or t
agctcgtaccgagctctctctgttggggagggagcggcactggacttgagaggtggctggggaggtgggctagctgcctagtggcagctacagcgagtttcataaatgccactgcggncaactgtatgctgcacccatttgatg

SEQ ID NO: 692362 - DNA, 163 bp, Homo sapiens
accggttaggggatttgggttttacaaggaagactaaactcctggttattgctaaaagtgggttttgcccacttaattttaaaagcagcctttttaaaattttcaaatccatggttttcccggattgtttggtaattttttaaaaaagtcatggtcagggtga

SEQ ID NO: 692363 - DNA, 625 bp, Homo sapiens
cccccagagcaaccgggagatttattgataaatacagaaacatgggcggggagccacgctccgacaacccgaactgggcccccgtcccgagctcaggccacgtccccaccttctggaagcctccaagctgttgttaatgtcagtttttttcaccaggcaaacggaaggggcatttttgctgttgttaggaaacggttaccacttttccgggtttgttaaaaataggatctttgcataaatggggataaatcacctggaggaattacacgtaaacaaggcgtgaaataaccattgcatgcatggcctgcaaagttgaaaagtgcaaattttcgttataaaaacacttttagtttgaatgaaaaaaaaaaaaccaccaacttttcataaacatgacttcctgcaaccgattttggccccacatgggggtggatcccaaaagcgggagacagccttccacgaaaactttgaaaactggcccaaaattttataattttgaaaatggctttgaatttttgggggggaaaaagaatcctgataaacacaataaaggggagaaatgctccctttgaaaaggtttgggttgggtttataaacaacctctttggggggaccttccctggaaaaa

SEQ ID NO: 692364 - DNA, 491 bp, Homo sapiens
tgcatcccagcgcaggcctagatccttgaaagcaaggtcgggtgtggcagtggggaagccagggaggctgggaagggcaaagggtggagaggaggagtgaccgggactggagccaggttctggggagagcaagagcaccaggcttcttcctggctagctggattggtacattcactgctgccaggtacccagagagtgtcactcgtcgtctccaggtagagcagtcaccagctcctgtggcctggtagatgactctgtgagcctcagtgagagagtgcaggcaagtagagtgatggggtcagtgtccatccagtttacgctgagtcagtccatacagcgagacacctggctctgggcaggtagtcctggagtgttgatgagcccgggtgagcatcgggccggtcagctggcatgtggtcctcacagccttcatcccaggtctgcctacgtgggagatcgtcgatcagaaacaggaacggggatctgtcttg

SEQ ID NO: 692365 - DNA, 775 bp, Homo sapiens
  misc_feature (56)..(56): n is a, c, g, or t
  misc_feature (61)..(62): n is a, c, g, or t
  misc_feature (77)..(77): n is a, c, g, or t
  misc_feature (162)..(162): n is a, c, g, or t
  misc_feature (167)..(167): n is a, c, g, or t
  misc_feature (172)..(172): n is a, c, g, or t
  misc_feature (175)..(175): n is a, c, g, or t
  misc_feature (184)..(184): n is a, c, g, or t
  misc_feature (208)..(208): n is a, c, g, or t
  misc_feature (210)..(210): n is a, c, g, or t
  misc_feature (251)..(251): n is a, c, g, or t
  misc_feature (369)..(369): n is a, c, g, or t
  misc_feature (397)..(397): n is a, c, g, or t
  misc_feature (405)..(405): n is a, c, g, or t
  misc_feature (410)..(410): n is a, c, g, or t
  misc_feature (458)..(458): n is a, c, g, or t
  misc_feature (482)..(482): n is a, c, g, or t
  misc_feature (485)..(485): n is a, c, g, or t
  misc_feature (487)..(487): n is a, c, g, or t
  misc_feature (515)..(515): n is a, c, g, or t
  misc_feature (551)..(552): n is a, c, g, or t
  misc_feature (559)..(559): n is a, c, g, or t
  misc_feature (622)..(622): n is a, c, g, or t
  misc_feature (638)..(638): n is a, c, g, or t
  misc_feature (767)..(767): n is a, c, g, or t
ggggggtggttggaggtctctggacagttatggggagcatcagcagataccctggntttgnnggggctgtgggagtngcagccctggtccccgcgttgacaggtgccctccttaaacctctatgcaaggaaatgtcttgagccgggcagcccgctgggccanatctnccggnggntccttccgnttgtactgaagcagcctgcgtttntnctcaatagcttcgtcggccgccttgccccctggccgggaangaggccggggaccccagttggcctccgggttagcctggaagcgcttgagttctcgctgttgggagcgggggttggcatcttcccggatggtgaagttggcctgcagcctgggctccanactgagaatgcggaacgctgggctagtntctgaaantcgcncccgtttcaccggacattccttctcccagcaacgcatgaaagttccanagggcagaggcaggggcatccgtnttnanagcgttcttacaggcgtgggagagttanaaccggaagtcagcgtggaggagggccgaccgcaannacaggangcttggtgttttgaagtagatgatgctgctcagctggtccagggtgtagtacagaggcacgtncgggagctcctcagtnatgacgctcaggacccctcggatccgctccgaggtgtggaagcggccggggttagcgctcacagcctccaggacacggcccacaaaatccaggtcatggatgggctctgccacatggggccaccaagcnggtgtggt

SEQ ID NO: 692366 - DNA, 176 bp, Homo sapiens
ccccaatttgttttggttttaaagcccccttttttgaaaattgggctggaaaataaatttttaaaaacccgttggaaaggggggccccccaaagggtttgtttggttaacccggatgtccaaacccctttttttttttacctccaaagcttttaatttataaaaaggaatttttta

SEQ ID NO: 692367 - DNA, 310 bp, Homo sapiens
ccccccccccccccctttggggggggggggggggggggggcgggggggggtttttctacccccgtttttttttcttccccctcccgtgggccggcccccccccctttttttttttttctttctttaaaggggccggggcccccccccccctctggtttttgcccgggggggggggggggttttccttttccccccgggtcccccctttccccttttttttttttgggttcccccctggttgggttttttccccgggggggggcggggccgggtttcccttttttgggttttcccccccccccgggcccga

SEQ ID NO: 692368 - DNA, 483 bp, Homo sapiens
aagttgtccatctgaagctggagaactcctccatatgcagagggcttaaagaaagatacgaagaactctaagctgggtctgctaccatcactccagttttgattgatcttggctgacagacatgcttgttcctctggattggaaagatgatttactctcgggaatcttctctgtcagcctgtacatctaaaggctttaagcactcagttgggcattcacattagtgtttgttctctgatggtatctctgagaatactggttgtaggactggccagtatttccaacgggactgggttcaccccaggtctgcggcagttgtcacagcgccagcaccgctggcctccaaagcatgtgcaggagcaaatggcaccgagatattccttctgccactattctcctacgtggtatgtcttcccatcatcataacacgttgcctcatgagggtcacacttgaattctccttttccgttcccaagacatgtg

SEQ ID NO: 692369 - DNA, 525 bp, Homo sapiens
tctgtgtggaaagcggctgtgcagacattcaattcaaaaaaaaaaaaaaaaaaaaaaaaaaaaaattgggggggggctggggccttggaaaaggtttctagaagaacacttctcggtggggcggcgcgggggggccccaggtgaggcacagtgtgagacctggggcccaacagcggggtgcccaaaggggagaccccggggcacaagagaaaaggggcggggagtcttccccaccatataaaaaagcgcgccggggggggaacaccggagaagggcgtttcgtagaacaaaactcccagacgggagggatctcagaggaggagcccacaaagggggggcgtctcactcaaaacgagggggggcccaaagggggagagccggcgaaaatacacaaaaaattagcagcacccggggccgcggggcaaaacggaaagagcaaaaaagaagagaaggagaaaaagaaaagaaagaagagaacaaaaacgcagcagagcagacaaacgaaaaaagagaacaggcagaaag

SEQ ID NO: 692370 - DNA, 252 bp, Homo sapiens
  misc_feature (101)..(101): n is a, c, g, or t
tttttttcattttccagtacccgggagcgggaaacccgggcggacgggcccaaaggcgggggtctccggcctcaagcttcccggttaatttttccggggangggggggggcccccccactcctgttgtttttaggcgcacccgtttcaattcaggattccaacgtttttgggccgggtgccgcccccccgagcacccccccgccccgcctttggttttgtttcagcttcagcaaaatgtgggtacgttacta

SEQ ID NO: 692371 - DNA, 112 bp, Homo sapiens
caatcttaaccacaggtttcacatgtacacctgtaaacttacaaatttaacattatcaaagaaggacagcttctacactcttacaaagaccactagaaagaaacaacaatta

SEQ ID NO: 692372 - DNA, 275 bp, Homo sapiens
  misc_feature (16)..(16): n is a, c, g, or t
cctagaagagtgtgcntcaagcatataataaaatgagcttagcagcaagctgtcactcacacaggagaagctgagcagaaagcaagcaaagaggaatttattgcttctctggctgaggcctaaggcccctccctctagggagcagctgtcagcacggactacaataagggcctccaaagtactgagaggagccatctagaacatatccccctcatattgtgtctatcatgccttaaattttagagggaccccaatccaaatgcaataaccctaga

SEQ ID NO: 692373 - DNA, 1465 bp, Homo sapiens
  misc_feature (120)..(120): n is a, c, g, or t
  misc_feature (1366)..(1366): n is a, c, g, or t
gtgatgtatagcattggaacactagcgccacttagatgcgagtccgaatcaacggggcgattcccagcgttcatcggatccacctgacaaaggaccggggccgcaggcagcgggtgggantgtgatgcgaatccacgggagcctcggaagggacagtcgagcagctggcaggcgtgatctatactcgcgcgcctattgcgatcacacgcgggaacctaggggtcaatctaacatctcgaggtttggactcaccacggacctgcgctagttagcctcctgcttctggcatgtacagcgccgagaagccggggagggagttcaggcctcgcagagatgatgagactctccaccgcgacccccggcggtcaatttacgtctctctgcggttgtgcccatacagcctcgggataccgtcggtgggcctgagcgtcgtcaggcaccgtagaaacatctcgcactgcgagacatggatgcggaatcgcaagggatcctggagacagggcgcttcccgtgtttgacctcaagggaacccacctcgaggcgacgagaggcatgcgcaagtcgtagggggcctggagggaatttccctcggggaagacgtgcgggacgaagaacacaaccgaacaccgtaaggcgttgccatgtgcccgcaatatcatggtctttgcgctgggctccattgagtagggggccttcattgaaagggacctccgcgatggtcacggtgtgcgttcccacggggtgaccacacgaggcggcggcggagaaaacgcaattgagcgcgtgcgaatgaaaaattgccgcaatgtccccaagacatcacattccctgggttgcttggcttcccccctgtaaggagggggtacaccccgggtgggtacgcacgcgccaaacggaaaaagggttcgcgcgtaatggcatgcgtgtggggacctccgatgagaaccctttgagacgcagaagaccctcgatagactagttcctccggggacgctatggcaaaaggcccgagagactcccgacaaggagttgcggtggcgaaccacacgtcgcgaggaaaaagctttgaggtacgccctttcgtgaggccgttcggtgtgtggccccacctatttgacttggctcccgaacaccgtgaagcgctcgctattcgcccaagatatgtccttcgtgagcgaaaacattcgctttagtaggagggcgaacctagacatatcggcgcaagtggttttgcgtggctcgtgacggtgatggcctttcacatttgggtgaaaggtcccccaaaggatggaacaatccgagaccggtgggcgaagtgagaggccgaataacgctcacatggccagcgctgcgttagattccaatntttcggacgcaccgtgtatatagggaggatagcgccaaagatatgagacgctctcaataaaaccacgtggcccccctgtatgcttggttaagcgctcca

SEQ ID NO: 692374 - DNA, 502 bp, Homo sapiens
cggaggcaagccaagccggtaggaggcggcgcccggcacggggactgcttgcggctgccgaggctccgaaagcctttgtgggcgctggcgggcacccccgcgtctgtcaccggcccccgcgccgggatctggactctcgcccccctcgcggggcgctccctcgccgttgctggtgcacccgcgtccggctcgccgtggacgccgggcctggcgtttcctcccgggcccgtcctgcccactccatgtgggcctcgcggactcggggcaccgggaccccgagggcagggcggacgcagccgggccccggtttccgagtccgtccccaggacggccacccctcccgcctcgggacacccagcgctttcctcttcaaagctggtgtttggccgggcgcggtggctcacgcctgtaatcccagcactttgggagaccgaggcgggtggatcacgaggtcaggagatcgagaccatcctgactaacacggtgaaaccccgtctctact

SEQ ID NO: 692375 - DNA, 157 bp, Homo sapiens
gttgatactaccttttggtttggccacggcgctcatccggggtgacaagagcgagactccgggtattccactcccacttcgggggcactaaatttaatataaatgtggggtcaagaaatataatggctcggtggacttctttttttcccccaaccat

SEQ ID NO: 692376 - DNA, 136 bp, Homo sapiens
cagagaccagtgcagcaagcgctcttgtatgtacgtccacttaaccacttgacgtgagttagccctccccgacagccccagcaacttgctaagcttaacccaggaggtgcagaagcattacttgcaacagcggccg

SEQ ID NO: 692377 - DNA, 793 bp, Homo sapiens
aatgatatggagcctaacttagctgtgccacgtgaatgcctctaagcacgatggacctatgccaaaaccacacatggtgctcacttaatcgataccaggacaaggaaactaatggaggagtgtacaagacttcagggagaattgatgaagctatcaggagataactcaggctctgagagatgaacgtttaaggctcatataggttgcacgttctgatagacctggatcaacctcatctgcatccttcaaagataatgtcaccacccctgttccttcacttcttgttgtacttgcagccattttcatgggattctttctagggaaatacatcttgtaaagtgaaccatgcaaagggctggttctttatttttttgtctctttaccagacaaagatgcctttacctaccatttccttggtaggatgcgccactggaaccatttgtttcggggacaggacctataagcttcccctttaatcgttttttaccgtggaatacacaatctaggcaactgtctgggtctgtacagggtgaatataaccaaaaatcactggcattgtcaacttcacatggatcctttattgaattctaaaggaagaaaggtgtttccttgtggtacaaataggttcaaaaaccgtaagatcctttcaaagaaaattaaaacccttttaattttggtgtaggggtgcctctcaaataagactctggaaggctaaaacacccattctggaaggccattaggacctcctgggaaattgtcggtcttagcgaaattttgctgtttacttgggaat

SEQ ID NO: 692378 - DNA, 221 bp, Homo sapiens
tatggccatggaatttatttaaatccccttcgataattacacatacactggaactacttatctgataccacagagcacaatttggattatagcctgtcttagacattatcaaaaaaaaaaatttaatctgtgctgtggctgcagtggcatcattgcctgtatttccagcacttttagcgtatgtcaaggtttagaagattcacttgaagcctgtggagtta

SEQ ID NO: 692379 - DNA, 405 bp, Homo sapiens
  misc_feature (66)..(66): n is a, c, g, or t
gccaacgtcctccatcatacctacccatgctgaatgctgtatagagaggtatacattttataaggntaaaatgatgacagtggggatgaggatgattttgcttaaatgggaagaccttgtggtgagcataggaagtgttaggaattacttgcttatgtatctctcaggagaaagcaccgtttgggaacataaggaaggaacagattttcatgtttttttttcggggtgttttgggaacacctcatagttaaaacatgtttggggttgtttttttaggacatatttggggggaattttcaaagggaaacttggaattggggtctggaacttaccaatgggcttcggactaaggggggttctttgtgattaattagtgagccctggttgttatttaaagccttgtaa

SEQ ID NO: 692380 - DNA, 967 bp, Homo sapiens
cgacaaaggaaaaacccacacacagcaagggaagacaatacgtgtgtgcataacgccaggcacgtgcgtcaaccaacgatatgccgcgttggtggcaccaccattcggaacagggggacctacgaaaactgagagacgaaccccagacacccgtgaacgagccacaacacgttcgggcccgaccaatcaccagggcgccccctgtgacccttggcaaacggaccacactacgccagcgcgtgggcaaaaacaacaattcaggcgcgcgggagacgaacacactctctccgtgtgtcattagggaaccccctcaccgggtagcacaccagtgcggcccccccccggacgtgtggggtttttcccccgggaaagttaccccttttgtggagtggtaattccccaaagctcgcccgcctgtaaatttccgccccggtgcgccaccacccaccgggttttttgcgcccccaagagtaggctaggccccccaagcgaggtggtcttctcacccacgaatggcgcgctggtatcttataggatatattgcgcaccgtctcttgcatagaccgggggttaatcaacagggcaagtaatcaaatctaacccacatggcgccgaaagccgctccgtggcttgcccaatattcttcttgtgcaacgtagttctaatgggtcaatgcataatgcctgggcccccccaccattgacagcgccgccctttcttgatacccgtggccctccttcattggcagacgatcgcgtttatgagtcgcccttcatgaaagccctcctgacgttgcccccttcaagcaagagagggtgccgcctaggcgtgaattgtaagagaaggcggggcaccaatcttgcggtcagacgcccgcacgccacattcagcttggagggatgtcgccacccgaaacagccacctttggaacccacaaaaaaacataaaaaaacaacccaacaagaca

SEQ ID NO: 692381 - DNA, 373 bp, Homo sapiens
ttctatgaggatccccatacagatgaatgtcaggagaccttactctggacacagtcattatcatctctaatagacactccatagtttacgttagtgttcactcttggtgttgcacattctacaggcttctgacaaatgaactatgacatgtatctatcatttagtatcatcaagaatagtttcactgccctaaaaatcctgtgtgttctgcctgtttgttcctttctctcccctaacctctggcaacccgtaatctttttatggtttccaaggttttattttttctggagtgttctgtagttggaatcacacagtatatcaccttttcagtttggctcatttcccttagtagtgtgcattttttcccatgcgt

SEQ ID NO: 692382 - DNA, 453 bp, Homo sapiens
  misc_feature (10)..(10): n is a, c, g, or t
catgctgggngggagcctcgagcttttctgtttgtaacatgaaaccattctgtgggacagtaagaagagaaagcaagggggggcactgtacgcagatacccacagccgaaaatggcaacgcaagattcatcatcgactgtcacagtaagcagagggggcacaaaaatgcttgccaaaggcatgaaccagaaggctagtgaggctcgcaggatgccctagtgaatcgtacagtgtagagctgtgctgcccacgcccgccagacactttctgggacagcacagaaggagaacaggacgctttaaggtgacagtcatccgggttctggtgcagatcaactttccacgtgtgccatcttggacaagtcattatctagctgggcctcactcgaggtattatggcgactgacaggcttcacaaggcttaaaagaactagccatgtcttccatcttagct

SEQ ID NO: 692383 - DNA, 241 bp, Homo sapiens
aattctagagtagcgggatcagatggcaatcgcttattggcaaaatgacaattttgtcatttttctgtcaccggaaaatcagagcctggcgagtaaagttggcggcataaaatcaccagaaattatgagcctatgtctccttgtaaacttctgccattttgtgtggcccttgcgctaaccggttgttcactggcaccggattatcagcgtccggcaatgccgtgccgcagcagttctcact

SEQ ID NO: 692384 - DNA, 740 bp, Homo sapiens
ctgcatcatggaggtgtccgtgtgtgccaggcggacagcagtgagaacgcctcaatcgctgaggacatgatatccaaagattactactttgactcctacgcacactttggacatccaagcgagggaagatgctgaaggacgaggtgcgcacccttcacttaccgcaactccatgtttcataaccggcacctcttcaaggacaaggtggtgctggacgtcggctcgggcaccggcatcctctgcatgttgtgctgccaaggcccggggcccgaaaggttcatcggagatcgagtgttccagtatctctgattatgcggtgaagatcgtcaaaagccaacaagttagaccacgttgtgaccatcatcacgggggaaggtgcagcgacggtggagctcccagtggcgacggtggacattcatcatcagcgagtgcatgggctatgtgcctcttcatacgagtccatgttcaacaccggtgctctatgccgggacaagtggtggcgcccgatggcctcatttttcccagaacgggccacgctggtatgtgacggccactcgaggacccgggcagttacaacagactaacaagatccactggtgggaaagaacggtgtaatggctcgaccatgtcttggcttccacacgatgtggccataagggagccctagtgatgtcgggaccccaaagaggtgtccaccaaacgcttgctcataaaggagtggactttataccgtcagggga

SEQ ID NO: 692385 - DNA, 301 bp, Homo sapiens
  misc_feature (38)..(38): n is a, c, g, or t
  misc_feature (42)..(42): n is a, c, g, or t
  misc_feature (50)..(50): n is a, c, g, or t
  misc_feature (69)..(69): n is a, c, g, or t
  misc_feature (71)..(71): n is a, c, g, or t
  misc_feature (74)..(74): n is a, c, g, or t
  misc_feature (76)..(76): n is a, c, g, or t
  misc_feature (104)..(104): n is a, c, g, or t
  misc_feature (151)..(151): n is a, c, g, or t
  misc_feature (155)..(155): n is a, c, g, or t
  misc_feature (160)..(161): n is a, c, g, or t
  misc_feature (189)..(189): n is a, c, g, or t
  misc_feature (191)..(191): n is a, c, g, or t
  misc_feature (240)..(240): n is a, c, g, or t
  misc_feature (274)..(274): n is a, c, g, or t
ggttaatctacaccttaactctggctgctgcaattganaacnttctttcnaataaaataatatatatancnctnantctgatgtgcatgatgaacatttctggnaagtaaacactttctctcgactaagaaagtatttttccagtaatttnttgnttctnnattactacccacttaaaaaatcaattcncnggtaattattgactatgtttaacttttcttggtttacataatatatcantaaatataagttttagtttacaaatttaaggagnggatatgataagttataaaatagttat

SEQ ID NO: 692386 - DNA, 135 bp, Homo sapiens
aattgccaagacctctaatccttgtaattactgtagtcaagagacactctttgacataggaaaaaccttgtagagagataaaaatttacaccatgtggcctaaagcagccaccaatttaggaagggtttcaggtt

SEQ ID NO: 692387 - DNA, 809 bp, Homo sapiens
ccaggctcacagcagtggcttctaggaaactgggagttggagatcagtctttacagatacatcgatcagaggtctaaaatgaaacctcaacctaaaactcataggactgagtgccgtgggaggagggttaggtctgcttcttccacttatagcttagtctctgtgctccaagaggtcaaatttgtagcgtctctagaatttccattgcgggtctgtcagagagggtggggggaaccaaaagccccctatgcggactgttgtctgtgtagttctgtttgttattcgaagagcataggaagatagccgtcttatgctccaaccaggggctgtgaggtgccaacgagtcgactaacactggaggtgcaattgaaacactacccatcgttccggtggttcagagcgcaattctgccttagacatcctttctaacagttacgtcttgggtactctacaagaactacaaccctcaactctagtgctcggggacatatagatatgagtaaattttcatgtaacacgaccaggggtcattttcacctagtgttctaggaccacggccattggactcgtcagaaagtgatctgaagccttcagggtgactccacgccgccacttggtgctcttcacccgaagaaggtagtcgtggggactcacggggacgcgaaaacgctaccgaggccgcacattccatagacctacgttttagttgagccaaccaactctcgggggtgattgcagggcaccaactagtggacattgccccgtgacgacggattctcaagacttgggcagttccctaatcctaatag

SEQ ID NO: 692388 - DNA, 1313 bp, Homo sapiens
  misc_feature (318)..(318): n is a, c, g, or t
  misc_feature (327)..(327): n is a, c, g, or t
gtgcgtcgggctgccggaaaccatggcggtctctccacgggagtgtaatagtacctcgttcaatgttcctgctatgtttggaatgagaccttgcaagcaaggactacaatggcagtaggcgagggatacagattcagcatgtgggccattggatagaatgatgtagagatatgacgactctcactgagcatgtaagtacgttgacggaaggctcgtaaacaagctgagaggtgataagttgcactgtgtgcagaagttgagtccccatatatccggtacatgacgtggcgatagggatttaccagaatggtgactgantgcggtgantgggaggcatcgatttcacacgcattacggagatggatgcaagaagataggcttcgacatctggtctgccttaccctcactacccgttaaaaggcagtgatcctagcaggtagatcaagtgcattgagcctttcttggaacaagacaattacaatcgtataaatccatggaagactagtttattagactccgtgggaatggaacttgagccaaaatgggttcggaaacacgttttagaaaattacacgcagagatagccagcgtcccgtcacggaaatcccaggatttggagggacgtattgtggttgccaccaaagaaaagagattcttaaagtaatttcgcataggcaggggaaacacattattaacattatatgttcgtccggcacggattgggggaaccatgtgggggttgggagagttggcgcacacaggttgtaggacctaggataatctccatggatggtgttaaaagcctgggaggaagaatgtggaggtttccacagcatttcgaattaggttaaggccacactttaggaggaataggcttggggtgaccgtattccaacgaggaggcgcccttaaaataagatatggagagtcggttagatgtcggatctagatctctagggatggaaataaggcttattggaaacaggctgtatacacgaaacgaagggacaccatctccccacggtagggggcagcttttacattctgggttttcccaaggccacagagaattggaattgtcttacccgtgtggaacttctgggctaaaccaacctttgggggtctttcccatagatccataactaaataccccttttcattaacttactcaatgtggttgacacatcggatccccttgggaaggttcaccacttaattacaccaccaaggtggtcgtcaaaacatttaaccttcgctgtttcacagggctcacaaacacgcaaacttttctccccgcactagggcgttgaacg

SEQ ID NO: 692389 - DNA, 345 bp, Homo sapiens
aggcatgagccactgtgccaggccaaaaaaggctttttagggtatgacatcaaaagcattagtgccaaaagaaaaaaaacagataaattgaacttcatcaaaattaagatactttgtgcttcaaaagatgccatttaaaaaaaaaaagaccacctccagaatgggagaatatggttgcaaattatatatctgataaatgacttctatctagaatatataaagaatgcttacaacttcatactaagaaagcaaatacccaattaaaaaataggtgacggatctgattagctacttcttcaaacaagatgcccaaatggctaataagcacacgaaaaaatgctcacc

SEQ ID NO: 692390 - DNA, 1152 bp, Homo sapiens
agcgggggagtagccgatagcggctggagcgggcggccaaggcgaggcgaaagctgcacagggcccctacgcggccgccgtcagcatgtcgggacttcgacggagttcgagcggcagctcatacggagaattaaactaagagctgggacagaggtagaatccggcatcggaagcgcagagcagcaggcgtctctcggagccgtggaccgcacagacgccggagaccggagccgcgaccggcgcataccgggaacccagcggaagacgcgcttcccgggaacatggcgacaaacgcagctaaactccgtttgaactctagaggcgcatagagagaggagacacggtgtgactgattcgtgtccctcgccgctcacgaagtaagaagaagaaggtccgtaatatactgggacgtgcccaacccctctagggactattgtagacactacttcgaacactcgcaaatatgccaagtacagatggccaatgtccaaggtcgtggcggggtcgagagtgtgcgacgaccgacttgtctctttacgtgccacgcaggcagtgtacccgcgtgacagggtcctgggctgtggactctccgagacgggcacagaggtgaccccgatgagttcagtgagacgaccatggattgaacgcacgaccacatggccgctggacggctctccttacaggtggggactaacagtcaccccttgtttggggcaagttctacatgcagaggaagggccagtggactgtggagtatttggcttgtcaacggacacacaatgtaatgtctgccctggggcgtgtgggcttggatcccctaaagggcacccattgggacataacctccaacggtggcatttcggggcctgtggccacgactttaaacaccaagcggatcagacggaaaggttctcgggccgtcttgagtggggaagcttgcccgcttcaaggatgcggaacgcaggaacttaacgccaagggagtaattggggcctttacggaatggcacatcagatcatttcccacgggaaccaagatccacattaagacgattcccggccagaggcacctacaacgaacttacccaagccccggttttacctgggcatgtgttcacgaagaagaccccattacagacttatgatggctgtg

SEQ ID NO: 692391 - DNA, 450 bp, Homo sapiens
gtcgaggctcaaaattaactgataagaatcactgataaatattcacaaaaaataccaggttaaaataccatttgtgcggatgggtgcagtggctcatgcctgtaatcctagcactgtgggaggctaaggcagatggatcacctaaggtcaggagttcttggccagcctggccaacatggtgaaaccccatctctactaaaaaatacaaaaattagccgggtgttgtggcacatgcctataatcccagctacttgagaggctgaggcaggaaagtcacttgaacccaggagctggaggttgcaacgaggcgggaatcacaccactgcactccaacctgggcaacaaagtgagactccatctcaaaaaaaataaaaaaccacagaggcttcatgatttctagtttacttaaccaggctctgttatccttcatttatagtaacaggataaata

SEQ ID NO: 692392 - DNA, 226 bp, Homo sapiens
tcaacacgcgaggcacaaactgcacacgccgagtgaccatacagattgagatcccaatggacgaagttgttgcaggtcggaatggacgaagttgttgcaggtcggaatggacgaagttgttgctgcacacgccgaatcaccaaacatacatatcggtatggacgaagttgttgcgcaacaacttcgtccatagtgatttgctcagtttggacgctcggcgtgtgca

SEQ ID NO: 692393 - DNA, 371 bp, Homo sapiens
tatcaagatattcgtgcagccatcgatgctgcctttcatagagagattctgctgtcgcatctgatcctatttcgacagctctttatccacggcacttttttgcaaaattggaaacccttccaatgtcacatcaattcaatttatgtaacatttaaaatcctttgttgtaattacagcaatgttcacagcatcttcaccaggaatagaatgcatctcaagaaaatactctgctcatctataaaaagcaactcctcatctatttcagttttatcatgagattgaaacaattcagttaattcttcaggctccacttctagttctcttgctatttccaccacatctacggttacttcctcccctaagttaggtca

SEQ ID NO: 692394 - DNA, 81 bp, Homo sapiens
agagagatgatatacccgaagctgctggataattttatcccaggggtggctgaatcacggaatgcacacgacggttctgcc

SEQ ID NO: 692395 - DNA, 170 bp, Homo sapiens
gaggtgaaaaatagcagttctctaggaatgcataactaacccatagggtccatttaggtaaccaagtttaaaaaaatattaacaattcttggccgggattgttggctaacgcctgcaattctagcacttaggaaggccgagatcacaccactgcactccagcctgggctc

SEQ ID NO: 692396 - DNA, 129 bp, Homo sapiens
ccgtactaccttctgtgtttttttggggggataggggtggcggtgggggcgggtatagccctcctaactagtgtcatgtgacatttcattgtggttttcatttgcattttcctgatgattagtgatgtt

SEQ ID NO: 692397 - DNA, 742 bp, Homo sapiens
  misc_feature (639)..(639): n is a, c, g, or t
  misc_feature (731)..(731): n is a, c, g, or t
ctagaatccttagccaccaacggagatcaggcattaaagagaattcaagagttccccagactctggaaaatgtagttgttgataacagactagcattggattatttactaagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaaggcagggcctacgtccataaactcagcaggaagtagttacggaaaacagatctccgcccttctgcagcccccttaagattaaggaggagtatctaaactctgaagggggaatganggaagaggggggactcaaccctgggaagtggggctcaggcactcagaccaaactgggcactagctaagaataggtccaggggcaagatgctnagtttccaaaa

SEQ ID NO: 692398 - DNA, 378 bp, Homo sapiens
ctcttcaagattgtttttaaggtaattcagcttctccgtcgggctttccattttcaactttaggttagttttgttcaaagtcaactcatttaagacacttcgcaggcccttgctatcagcctcaacacagtgataaaggacaactttactttggcatttgaacaaagcccaattggaaaaatcaaaacagcttaaatggaggtctcctcatccagtggtaataaaacatcccccaaaggtggagcttaaagagcccagccctgggatgtgaaaacatgggttcaaattgcccctttgccatgttcagctgtccccttgggcaaattatttttttgaaccttagttttttcatcattaaaatgggaaaatttgttttta

SEQ ID NO: 692399 - DNA, 127 bp, Homo sapiens
ttcaagcttggaaatgagtttcgacgcctgcccgctgctcgtgccaagcctttgagcagcagctgaaaaactgcccgtatcaaggaccgcgacaaacatccgctcactatcaaggcgatccatcgat

SEQ ID NO: 692400 - DNA, 327 bp, Homo sapiens
  misc_feature (74)..(74): n is a, c, g, or t
taaaccagtaccccaaccccctttgtaaaaggtcttttccctcaaaaatgggaaaaccttggggggggttaggncccatatgggaatttttcctttcagggccgaaaggaaaaaaaggaaaaaatttgaaccctgttaaattttttttaaactgttttttaacggccccgtttatggaaaaaccaggccccgtttatttttggggttttgggaaaaaatatttttgttgggggaaaatttttggggggggggttaaattgggggtattttttaattttttttggccatttggaaaagggccaaaaaaaaaaaccccttttatctgta

SEQ ID NO: 692401 - DNA, 242 bp, Homo sapiens
  misc_feature (21)..(21): n is a, c, g, or t
  misc_feature (72)..(72): n is a, c, g, or t
  misc_feature (223)..(223): n is a, c, g, or t
gggctccggcaaccgctccgncaacgcaaccgctccgctgcgccaggctgggctgcaggctctcggctgcangctgggctggtgtgcagtggtgcgaccacggctcacggcagcctcagccacccagatgtaagcgatctggttcccacctcagcctcccgagtagtggatctaggatctggcttccaacatgtggcagctctgggcctccctctgctgcctncttgtgttggttaggccaa

SEQ ID NO: 692402 - DNA, 381 bp, Homo sapiens
  misc_feature (38)..(38): n is a, c, g, or t
  misc_feature (64)..(64): n is a, c, g, or t
  misc_feature (86)..(86): n is a, c, g, or t
  misc_feature (89)..(89): n is a, c, g, or t
  misc_feature (194)..(194): n is a, c, g, or t
  misc_feature (277)..(277): n is a, c, g, or t
  misc_feature (334)..(334): n is a, c, g, or t
tgcaaactatcaagaaggattctgttggccagggagtntccactgaaaaaaaaaaatggcagtnaaaagtcttgagtgtcctattncanaagcccagagtcctcatccgtcatccacgggagagtctttgagggaaaaatgaagtcaagctcatgcatctgcctatgggtaaatttattcggaaatccctgaanatcctgatatcttaattacccctgcggaccaccatagttcagggtgctttcccttttaatgacgtcgctgacatcattggcgnagaccacggactgtccattgatgctgattatgacgtagttttccttgagaaacaagnttatgatggggtaaaaaaattaaataaattatataagctcctgagat

SEQ ID NO: 692403 - DNA, 282 bp, Homo sapiens
  misc_feature (10)..(10): n is a, c, g, or t
caccctacanttcttattgggagggaggtctggagctgccaccaaactccatgtaactttttctgtgaagtggggtgctttgaatgtgtaattcctccctggttccatctggtggtcactgttgtctcttcacaggatcaggaaaagtctcagaaaagggtcagtcttgcagttcttgggtctgaggcaggagaatcgcttgagcacaggagtttgagaatacagtgagctacgatcacaccattgcactccagtttgggtgacacagcaagaccctgtctc

SEQ ID NO: 692404 - DNA, 272 bp, Homo sapiens
cgttgcttcactgtacacaagagtatttgtgtgtctaatacccccaacataaggccgggcacagtggctcatacctgtaatacctgcacttagagaggccgaggtcggtgggtcacctaaggtcaggagcttgagactagcctggccaacatggtgaaaccccaactccactacaaatacaaaaaattagctgagcatggtggcaggcgcctgtaatcctagctactggggaggctgaggcgggagaatccgcttgaaaccaggaggcggag

SEQ ID NO: 692405 - DNA, 1699 bp, Homo sapiens
  misc_feature (250)..(250): n is a, c, g, or t
  misc_feature (512)..(512): n is a, c, g, or t
gtccaaaatgactgagggccatgtatgttcttgtgccgtggtgggatacatgtgcctgtattatctcgtgacaggatcaatgaagggatcaagcacgcgtcctcaatgcaataggcgtgtcgcttcgtagactttcggagatgattcatggtccacaaagtatctagtgcgttccatactcggagacggacagtacagccactgcctaggatagatgtcgcacgagagacgcgatgcaccaacgatgcanagcacttctgagtcgaaatgtgtggagatgacgactctcatgaggacgctcgcatggggataattagacagcatcgcgtacgatcttggcgtggaggaatgtgtcgtgcacctagggagttaagtcgacccgaagcgcacgttgccatacaatacacacgctataacgtctggggggtatgtcggatgtgacgcgacggtcccacatgggcatacattcaacgccatatggtgattattcctggtcactgaatcgaacgttnccaaacttcgttttcgaaccatacttgggtaccttggatagggcggagatagaagtaactcataatactcaaatatcgcatacgtctctcaaagaatacgacacttggaccaccatacatttcgcgttggccccctttctcctttctccaggcttgagaagttggccaaggcatctccacgtatgcaacctcctcgcaactttgagagctagtaagaacgccttggaggccctaactccaaatgaccaggcaaatgggggtccccatcgagcccttggggagttgcaatccggggaacaacatcagatagtacagattcggtcgcgttcgtgtggcccgaatctaggtcaccttggggggcccccagcggaatatcttgattacgttaactcatgccacgccttgaaaggcacacctacaaggggtatttcccccttggcataatctggataagaagcggctgcgaacaggaacttgggcgggatttgtggcggggtggagtacggagtgtgccagagatttaaagccgcgaggcaatctcggacaatagaacctttgtaattggcttttttctaacctttagctttaagagacaccccatggcaaaaatatttcccactgggttaaacattccaaacgggaaagattacatagtaccaccccggttgcgcgtgggtgcgcccaatttatggggaagcagtcatctacgcctttggagaagttaggggtcccccacatgtgctattcacagacgggttccacccttagtaggacttccttcctttggccaaagacagcgtgtggtaccccaaacatgctataaggcaaacggaacatatataagggcaaaggccatgtagcacactggcctgttttgtcacacactgtttcgataaagtgccaagatgtgtgctaaacggggaatcgctttgtgagaggggaacctggtaccacccgaggtgggcgggtgcaccctatatgttggcacaaaccatctccataccgagaagattaaaaggcccgtgaggggggtagaatcagacacacccctaatgatggatataatcctgggtgtcacaccaccgaaggctaatatcatagcctgctgtacaagcaactggagccgcagtgagcgacttagcagttcacattttcggtcgacgcgttgcactaaagatacgagcgta

SEQ ID NO: 692406 - DNA, 194 bp, Homo sapiens
tccattttttgggccccaatttttagggccccgccccgtttttaaaaaaaagggggccccaggcccttatgggccttttcttttggaaaccccacccttaatttggttggggagccccgggtttggagggggccctgggggaggccaaggctggccccctggtggctccccccttataaagtggggttttggga

SEQ ID NO: 692407 - DNA, 326 bp, Homo sapiens
catcccctttcttcctgacgactagcattaattgacagctgacccaggtgctacacagaattggattcaatgaatctaggaatactgcaactctcacgtttccaggaaccattgtttgatgaacctaggactcaagaccaagcaaacgggcaacacctcatggtggatatccgattttagggctcaccccagtgcgatttggtgaaggaagctaggaagaaggaaggagcgctaacgatttggtggtgaagctaggaaaaaggattccaggaaggagcgagtgcaatttggtgatgaaggtagcaggcggcttggcttgcaaccac

SEQ ID NO: 692408 - DNA, 104 bp, Homo sapiens
ggatcctttattttcagcacgctggagtggggcacaggaagggaagaggaggcaaaggagagtcgcccaggcaggtgcaatggctcacgcctgtaatcccagca

SEQ ID NO: 692409 - DNA, 209 bp, Homo sapiens
gtgaacactcctaccagatgaccctcaggctggaggaaaacaggtgtttgatttgtcaccgatggagctagtatatgtgcgtagagtgtttgtgtatgtgagagtgtgaatacacaggtggatatttaatctgtattatgccccgctcttggaattttcttccccatggggctggggtactttacatacaataaatactgtttggccca

SEQ ID NO: 692410 - DNA, 1122 bp, Homo sapiens
aaaaagactatttcgttggcctcgtgccagatgtcaccaggaggctgtggagcagaccattcatggcttcttcagagtggaccgtgagcgagcgatgtcaagtattttgcaaggctatccagcctgccagtaccaaaatctccgaagatgccatagagcacagggtcctcaaccgtactagaaggcttgaatctcggtgtctttcctgcttccatgagagccgaggttcagtgggcattcgcacacgctatgtgaccttgggatagctttcgggggaggagagaccttcctctcctgcggacttcattgcaggtgctaaggttgcctacacccaaataccagggattttcaatgagtcaagagaaagtacagtaaacactattatcttatcttgactttatacggggaaataagtttctcagaggattataattgtgaccagaaagggcttaaatccttctgtcttcctgagtgaatgaaacttgaattggcatgagcattttccgttatggaagggatgagattcccagagaactgcattgctttgctcctggttttattgaagaatcgacggaatgagattcttacgaggctgaaggcagacgtgtgccagatgtgaaagagaacttcagtatcagccgtaaatcttctctcccaggaagggactgccggggtctgtggcaagtgtcagcccagcctgtgtgtgtaaccggtgtgaacttgtgcccatcgggcacgcacggggggccacaactccctaaagggcccgtgttcccacccagtgggacagcgctggaaaccctcaaatgcagcacatatgtggtgcaccattaacacaacggcgcgcacgacacggacgagacatacacagcagagcaccacccgaaaaaatatgcgcacaactgacatagctgcgcacccagaccaccaaccaacagggaggcgcaccccatacgacacgtgccacccgagggcggggcacaccaccaagcgcggagccccgccccacaccaaacactcaaaaaaaggcggcactacgccccaccacccaacgcccgaatactcgcgctggatgacagcttcgtacacgactagataagcaacacgactactcaccaccga

SEQ ID NO: 692411 - DNA, 210 bp, Homo sapiens
  misc_feature (11)..(11): n is a, c, g, or t
  misc_feature (165)..(165): n is a, c, g, or t
  misc_feature (167)..(167): n is a, c, g, or t
  misc_feature (207)..(207): n is a, c, g, or t
gggcaagtcanacaagacccagacctcggacagcctcggcaatttctccttctcgccgccgctcggcaccaagctggtcaacatccaggcgaatggctattacgtggatgagatcaccggccgcctgtcgacctcggtgatcaatctgcaggcaaccgtcgatcngngcgagatgccgacccccaccgtcaatgtcttgacctcacngca

SEQ ID NO: 692412 - DNA, 454 bp, Homo sapiens
ggattgttgaaagagacacttggataaataaatgatcaggatgaggcgtgagggcagaatcagatggtaggcacaagtgcttatcaaactagggaaggtgctcttatttacagctgctggctcaagaatcatgtgctgggctgggcgcagtggctcatgcctgtaatctcaacacttggggaggctaaggtgggagaatcacttgaccccaggagctcgagaccagcctaggcaacgtgcctgagaccatgtctataccatataatttaaacattagctgggcatggctgcgtgcatacttgtggacccagctacttggaaggctgagcgccggggggactcacttgaggccaggaggtcgaggctacagtgagccatgttcatgccactgtacttcagcctgggcaacagagtacggccctgtctacaaccactgatactacttaatttccaa

SEQ ID NO: 692413 - DNA, 417 bp, Homo sapiens
tctcgaggatcttcgagcgactctgaggatcatctgtgcagatggcgcacacgcagcttccttggtagtgtacgcgccggttggttgtattggttgctctcagggaccttggagactggcctttcaggtagatcttcatgtttctgaccttgcactacccctatgtaggctccagactggcattcaaggtgcctttggaatgcccccgggcactgtggccagggttcacatcggccaagttatcatgtccatccgcaccacgctgcagaacatggagcatgtcattaaggccctgcgcagggccaagttcacgtttcctggccgccataaggtatgtagtgctgcagcccccgttctcccacctttgccccaagcctcctgactcaggttctttgccattgagccttcatagtcgat

SEQ ID NO: 692414 - DNA, 123 bp, Homo sapiens
ggcaacgccgagcggaaggagtgcagtgaacctgagcgcgagcagatcgctgtggtgggctccattggcttgggatcaccaccatcgtaggcggtgaagctgcaaatgatccaggttactgct

SEQ ID NO: 692415 - DNA, 189 bp, Homo sapiens
  misc_feature (97)..(97): n is a, c, g, or t
tgctctgaggatccccccttagtttataagggcatcgtagtttctggggtagaaaatgtaggccatttcttgccacctcatgggctacaccttgganctaaacgtctttacgtgggtacttgcgcttactttgtagccttcatcaagggttgctgaagatggcgggatataggctgaaggagggatgag

SEQ ID NO: 692416 - DNA, 402 bp, Homo sapiens
  misc_feature (137)..(137): n is a, c, g, or t
acctgatgagcgctaacgatagatgtacgaattatctgaacaccctaaggaaaaccgcgtatcaatggcgggaatggagaaacgcaacgacgcaaggaagctcatgacaggtgaaaaccaaagggcgcctaagcttntggatcgaacagcgtattacgcttcatcctccccgagaaccggcagttcctcgcagtacagcggcggcgtacgcgagtttgcgaacagcgtccttgtaaagcccttctcagacggctcctcaacgccattcaccatcgcacagtattgaatggtgactgagttgcgcccggcaggcctgatgacggtggtgtaaggctcaatcgtcaggaagaaaccatttgaaaccatatccggtgtcaacgggtccgagtcgaacggtacagg

SEQ ID NO: 692417 - DNA, 1439 bp, Homo sapiens
  misc_feature (495)..(495): n is a, c, g, or t
  misc_feature (721)..(721): n is a, c, g, or t
  misc_feature (1174)..(1174): n is a, c, g, or t
  misc_feature (1189)..(1190): n is a, c, g, or t
  misc_feature (1230)..(1230): n is a, c, g, or t
  misc_feature (1243)..(1244): n is a, c, g, or t
  misc_feature (1253)..(1254): n is a, c, g, or t
  misc_feature (1290)..(1290): n is a, c, g, or t
  misc_feature (1304)..(1305): n is a, c, g, or t
  misc_feature (1308)..(1309): n is a, c, g, or t
  misc_feature (1317)..(1317): n is a, c, g, or t
  misc_feature (1319)..(1319): n is a, c, g, or t
  misc_feature (1331)..(1331): n is a, c, g, or t
  misc_feature (1422)..(1422): n is a, c, g, or t
gctcacatgtcaagcattaatgcagtcttgtgttgctctttcccactatgtccggtgttgttgtttctcgtctgctcgttttgggttgttgtccggcgctcgtcgcgcgagcttgtggttgtcgtatgtcccccagcgactatgtctcccttcggtagtcctcggtctcgtctaatggactccctacctctgttttcgagcggggagtcccccccaaataatgggggcagttgctgcgccgtagttctcttgttggagtaccaccttcggttttgtccaccccccctggggatggccgtggcgtatattttcaacaggggggacccacaaagggttcataatttggcgccccctgttgttaagtgcccccagtgttgctgctatgggggtgaccccctgggggaatgttgtgcccatccagccctctcttggttttctttcctgccatggcgcttcccttgcgcgcacaacacaaactggcttttagcaccccgntggccaccagtgttcaactcccctggacccaagcctgtgtggggaattctgtgggaaacggagctcccattggccccccacggtccccctgtgcccaatctacaggctcccccccccgggaaggacttgtgtgatgggccccccctccgggggaacctttgttggccgtgtatgggcccccgggcggcgttttccccaggacgcgtctaatcccgccggccgtgtnttacatgggcgcgcgtgcccaaggccttgttggcgccaagaggtccatccctgaggctttacaccgggaagacgtctacatggccataggccattcccgtggtctccccacatgcccaacagggtccacatggctggcacacatgacacctgcccgttttagaaaacactttcgcccaatattcgagtgagcacttcacacgaaagtgttggtgaaacccaggccccttcggagagggccccccctctccaagggcacttcctggggcgtacacattgaggcaccacacggtgggttctctcttctgaactttcacacgcaagcgagcaacccacctcctccaccctcttgaaccctggggcttggcacttgccctcacacgagccacctttgtcacaggctcactttcctggtatgagccaccgagaatttggctaccacagccaacacagnggtggtggaccctcnntggcccacacatggcctcccaaggagtaagacccctgganccacccagccccnngccagagcnnccagaggaagaagagagaccctccctgctggggagntccctgccacacanncanntccccccncncaccactgaatntcccctcctcaccgattgccctgtagaccccttgtaagaggggaggggcctagggaacccccccttgtcaagtacccatccaattaagtancctgtgctccaacccca

SEQ ID NO: 692418 - DNA, 494 bp, Homo sapiens
gcagttgactttgtcttctccgggacgactgttacagaggtctccagaagccttctctctcctgtgcaacaaatggcaactcgttacaggacacaaactccatgtgcactcgagttagtccggaagacacgatggcaactatgcttccgaatacagattgatagatctatctggtagggtagaggatgtttgggacgagaaagtttagggtaaatagagcgagataggttgcattaaatccaaaggcgcaattcataagggcgcacaagaagattcatacatgggggctctcggcaagtcgggaaaccttttgtcattcatcttgggttgccgcacgatttggccttttatagtgggggcccaaagccaattaacaagctctttcttccacgacgagacggcccaagggcacaacatctgacaattgcggccaattcctttgcgccacagtccccaaacttggggcgggccaagacctctccttcaattgtcca

SEQ ID NO: 692419 - DNA, 223 bp, Homo sapiens
  misc_feature (3)..(3): n is a, c, g, or t
  misc_feature (5)..(5): n is a, c, g, or t
  misc_feature (88)..(88): n is a, c, g, or t
cgngngtcgcgtcttgcccaagtctccgcggtccccagcgctcgctcgcgcggtcctgccacggccttcctgctgcccgcgccatggnctcagctccaactccgctgtggagttgagtggatcgcggccgtcacctttgctgctggcacagcgctctcggttacctggcttacaagaagttctacgctaaagagaatcgcaccaaagctatgggtgaatcttc

SEQ ID NO: 692420 - DNA, 320 bp, Homo sapiens
  misc_feature (19)..(19): n is a, c, g, or t
  misc_feature (72)..(72): n is a, c, g, or t
  misc_feature (185)..(185): n is a, c, g, or t
  misc_feature (233)..(233): n is a, c, g, or t
aagagccacctggcctgtntccaagatgtggaaaaggaaaatattgggctaaggaatgtctttctaaatttnatgaaattggacagccattgtcgggaaatggaaagaggggccagccccaggccccgcaacaaagtggggcattcccgattcagccatttgttcctcagggttttcagggacancaacccccacagtaaataccaccatttcaggaaatcagccatttacancaatacagcaactatcccctgccacagcaggcagcgctgcagtagatttatgttctgctcaaatgatttctttaatccctgggagag

SEQ ID NO: 692421 - DNA, 129 bp, Homo sapiens
ccttctcaccgatcgctgttgctccttgcagcctgcgggtcctcttcagccgccctctccattaaccttttaacatgcctgatcctcatctgtcttcaccattgtgtgctcttaccagacttctccagt

SEQ ID NO: 692422 - DNA, 559 bp, Homo sapiens
ttggcgagactatcatccaggggtttggatggctgtctgagcgctgtgcccagtactacgaaggacggtatgctgacttcacgagtggcgttgtgtgctgaaaattggggaacacaccccctcagtccctcgccatcatggtagaatgccattgttcttggctcgtatgcctgtatttgccagtataatggtattgtgcccatcgtggtagcctgcatgatcctccctgatggggaccatgacttgaagcgctgccagtatgtgaccgacgagaggtgctggctgctgtctactaggctctgattgaccaccacttctacctggaaggcaccttgtttaaacccaacatggtcaccccaggccatgcttgcactcagaagttttctcattaggagattggcatggcgacggtcacagcgctgcgccgcacagtgccccccgctgtcactgggatcaccttcctgtctggaggccagagtgaggaggaggcgtccatcaacctcaatgccattaacaagtgccccctgctgaagccctgtggcctgaacttctcctacgg

SEQ ID NO: 692423 - DNA, 157 bp, Homo sapiens
gtagagtattatccccacttttgtaaatggtggggggaggcaaggcttcgagatcattattacttgccttacgctggtgcttctcagttactggggactcttgtttcacatggcgattttgattcagttaggtctacctgggggtaccgagctcgca

SEQ ID NO: 692424 - DNA, 160 bp, Homo sapiens
cccccggccttttccccaaaaggggggttttttgggggggggcccgtggaaaagggcccccccccccccaaccccctggggggggttttttggggtttgccctccttggggttttttttttttcccccaaaggattaaaggaaaagggggggggggggga

SEQ ID NO: 692425 - DNA, 136 bp, Homo sapiens
  misc_feature (94)..(94): n is a, c, g, or t
  misc_feature (132)..(132): n is a, c, g, or t
gcagatccagcgccagagagacaccagagaacccaccaagacctacactgttggctgtgaggaatgcacagacccagtgacatttccctcaatnggaggggctgtcctgaggtgtttccctgtttatccatnccct

SEQ ID NO: 692426 - DNA, 1285 bp, Homo sapiens
  misc_feature (394)..(394): n is a, c, g, or t
  misc_feature (431)..(431): n is a, c, g, or t
  misc_feature (1117)..(1117): n is a, c, g, or t
cgccatgcatgctctggcatactagatagctggcgcacgtgacatgtgtcacatgcgcacttggttaatggtgcccagcttattgctacttgggagcgctggtgcccactatggcataatcatgtgccgacactgaccagtctatctcatggagctatgactagttgtgtctgtggatgccagtagggatgcttgctagatgacgggactatcgcatcgtgtgccggaaatcacattgcgctgagaaaaagaccagagcgtttgagtcgtcagcaactagtagagacgaaagcttcagtaggacgcagctgactagcagcgtcagctagcgctataagatgtagcctaccattagggcaacgatacgtagagcttacagctgacgtgtgcactngacgtcgctgttgtggtatattgcgccaagtccaaangacttggaattggtagggatttggcttagccatgatcatccaagtaggcgattttccattgcatgatccaggagcgtcggatatataccaagcgatttttcacgaccgaacaatagctttgaatggagcgtattggcttcagagtcacgtgtggttctagatcgacctttggagctagctctacaagcttaatttgtgggcccagacgcctcacggtgcacatatactcgtcgtgtcggaactgcatcatgcttgccatgtttgggtctattggcaagagaaccaactactgtagaaggatgcttcatgcaatctggcggagccgttatcattcccagggtgtctttgtttcacgacagatagcgtaccgtgtatcagccacaggtgttgcagctgatgtaggtagctgtcatggcttattcctttaagttgaacgtggccgagcaagggtgaccggcatctgaggctagttccccagctttatggccgtaccgacgggtccgtttcctggtactgcgtggagcacttggcacaaaggggctggggcacatggcttcttcgtggattcgcccgggattttggatccttcaggcgcccgcagccgttccccttgggatccctcgcacctggttttggtctcttgcccccggggtcccccatgaaatttccccttgggtccccccttnttgaccgggctgggcctgtgagccttcttcccaagggggtttccattccctttccctttttgtttgggaagacggataccccaggggggacaaggtttctcacgcggagccctagggccggagggctccaggagcaggggccacggcgggcccgcggaaacccagacg

SEQ ID NO: 692427 - DNA, 353 bp, Homo sapiens
gacgcaacgcaggcacattgtagccgctgtcgtggccatgacccgcggtaaccagcgtgagctctcccgccagaagaatatgagcagagcgactcggttaaggggcgccgagatgacaggctttctgttgtcgcccgcaagcagagggacttggagatcatgcagcagaagcagaacccttttggccttcgcctgtgtgcctggagccagtgccacacacgctctgcgtttcctcctgtagtgctcacaggttccagaaccgatggcattccctctgccctgagtctgccgggtcccttttgtgctctctttcctcagagagcctctcttcccctgtgccacttccggggtgg

SEQ ID NO: 692428 - DNA, 220 bp, Homo sapiens
  misc_feature (81)..(82): n is a, c, g, or t
actacagatttggagaaatgcagtttggattttcgtacacccccaggttttgaccgaacacgtaagtgctgagattggaanncgacattaattcaacattggaagagctttacatcagaacactggcttgttaggatatataaagtaaaagcacctgataacgggagacattagatcacaaacctcgagtcaccaactttcccaaacgagtatttgtcaa

SEQ ID NO: 692429 - DNA, 117 bp, Homo sapiens
agacattaaaccagataacttcctaatgggtatttgggcgtcactgtaataaggtattccttattgattttggtttggccaaaaagtacagagacaacaaggacaaggcaacacata

SEQ ID NO: 692430 - DNA, 333 bp, Homo sapiens
cccgcgcggtgttccgcattctgcaagcctccgcagcgcacgtgggcagtcggctccctcgttgaccgaatcaccgacctctctgtccagatgtgtttcctgtgggtttctaacaagctgacgctggacacagctggacgttaaagggaagcgggtcggtatgagaggcgacttcaatgtgtcctatggagaacaacccggttacaaacaaccagaggattaagggtggtgtgccaagcatccgcgctgatggtgtgcccatgcctgacaaggactccttagagccagatgctgtggaactctctctgctgtgcaaggtggtctgtgtttggg

SEQ ID NO: 692431 - DNA, 400 bp, Homo sapiens
  misc_feature (6)..(6): n is a, c, g, or t
ccgctncccgcaggtatgcctttgctataaggaggtgaaggcgacatacaaggatggtcagtttgagctcatcccagcaccccagttccagcagccccactcaatgatcttgggccagtcccctcccctctgggagcgtactgtctccatgtgtgaaatgggaggatcatcctgggcctgctgttgcttcccaaggctggacagttaagattcacaacatgatcagaaaccaggctggttgagtgcagccctcacacctgtaatccaaggagtttgaaaccagcctgggcaacttggcaagaccccgtctctacaaataataataaaaggaaaaaaacagaaaccaggctgcagagtctgacagcccagaatcatcttcccaaatctctgcatcatctgg

SEQ ID NO: 692432 - DNA, 452 bp, Homo sapiens
accaaaaaaaaaaaaaaaaaaggtgtttgtctggagctgaaagccattatcctaactgaactaacacaggaactgaaaacgaaatactgcatcttgtcacttacaagtgggagctaaacactgagtacacatggatgcaaagaaaggaacaacagaccttggggcctacttgacgatggatggtgggaggagggtgagaatcaaaaaattgcctaccagatactgtgcttattacccaagtgacaaaatatctgtacacacgcaacccctgtgacacacaatttacctgtttaacaaagctgcacatgcactcctgaacctaaaataagagttaaaaagaaataaaaaccaaataccccaggagaattgcttgaacccaggggacagaggttgcagtgagccaagattgtgccactgcactccagccagggtgacagcataggactccatac

SEQ ID NO: 692433 - DNA, 369 bp, Homo sapiens
gaaaaaaggaaccatggatttattcaaattattttacaacatcgccttttttgacagttgtcagcttaacacttaatatagttaaaaaagtcaacaattacctgcaaaattatatatattttaatgtctaaaaatatgttgcttatataaagcaagaaaatccctcctttccacaagggaaagttttcttgtttttcccagagctgtgattattgacagactgttacacgcatttccaaagctttaaaaatctaaatggattatcttttccctgcttgtacatgcctgtaaagaaacatgtccaacgctttgctttttcatagagtaaggacataaacaaccctgtttccttttaagttattagcattt

SEQ ID NO: 692434 - DNA, 428 bp, Homo sapiens
cttaccagagaccctcatccaggcagtcatatttccatccttttgtgaaaggaaactaggcaatgtgagaactgtgcccagtggttttcaggctgactctgctggttgctgcctgcaggacacactggactattactgtagtaatgcagacaaaagatgatgagggcctgacatagggcatgtgtaacaggctgtagagacaaaaatctgggagagcttttggaggttgaatagactggaaaagctaccaataagctgcagctattgagtgaagtatcaacccacatgttagaaaagatttttttttgaggccgggcatggtggctcctgcctgttatcccagcactttgggaggctgatgcaggtggatcatgaggtcaggagatcgagaccagcctggttgacacggtgaaatcccatctctacta

SEQ ID NO: 692435 - DNA, 487 bp, Homo sapiens
  misc_feature (107)..(107): n is a, c, g, or t
  misc_feature (113)..(113): n is a, c, g, or t
tgcaagaaggaaggcatactacatattcttttttttgttttgagatggaatctcactctgtggcccaggctggagtgtagcagcacgatcttggctcactgcaaccncctccncctgggttcaagcgattctcctgtctcagcctcccgagtactgagattacaggcatgcatcactgcgcccggctaatttttgcatttttaatagagacggagtttcaccatgttggccaggctagtctcgaactcttggcctcaagtgatccagcccgccttggcctcccaaagtgctgggattacaggcatgaggcaccacgcctggcctcaaaagaatttttactatgtatagtaaatatacatagtaaaatatgtatagaatagtttactatgtataactattaaagaacataactcagggaagaaaaatccaattaatggggtggtattgaaaggaaaatggattgctgttacgttctgtatctgccctt

SEQ ID NO: 692436 - DNA, 111 bp, Homo sapiens
tcgagctcggcctggttacggttgcttgcgtgaggaaatacttgatggcagttctgtggaacgagggtttatttttttgcagagtcttggtgaggtagggtcttggtgagg

SEQ ID NO: 692437 - DNA, 690 bp, Homo sapiens
  misc_feature (5)..(5): n is a, c, g, or t
  misc_feature (525)..(525): n is a, c, g, or t
  misc_feature (536)..(536): n is a, c, g, or t
ttctncttttttttacagtgaatttaattttattagcaaaataataaaacaaagcatattctggacaataatcaatactctgaaattatattactttagttagttttcccttttaaattattttttccacttcaatttaaaaaatgtctccaagtaattcatgcgcataatttaaaaagtcaaatagaaccacaaggcttacaagcaaacaaacaaacaaaaagggctgtaatcttttggccttctttttgctacctccagaatagctgatatgaaaactttttccacaactacgggggtggagggtagaggctcctgagctggtctgaatttgttcaagtgccctttcctgagcagatcactgaagtcagggggatgataacagttatgagcttttgccagttggagcccctggaactggagaaaagtcagtctctatcacacctcacagctgctaccaacgatctcaccaatgatagtggtggaaggggcgctggacagactactgtgttcctggaaacactntccccagcccncttcactttctcccagtggtagactaataatggtctccaaagatatccagatcctaatctctggaaactgcggatgttatatggtaaaagtgattaaattaaaaattcttgagatgggagtattctggatcacctaggtgtccttataagagtg

SEQ ID NO: 692438 - DNA, 1009 bp, Homo sapiens
  misc_feature (1009)..(1009): n is a, c, g, or t
gagtttgtgacgctgctgatcgtctagaggctggcagattcaacgatctgggtgccatcattttctggcttctgttgatgaccctcttccagctttttcttataaggctaaaaattcacaaagcatatatcaatgaactcaggaggactctagatccggcactagtactacagactgtgcggccgactgttaccaaactactgccacgacagacacttatcacgacgacatgtgaccgcacacctgtgcgacacgatactggcaagacactgtcacgcaactaaccttacctcaccttacttggaactgaacacactcaccgacttcaaaatgctcagctactcacttgttaacttatgcacagctaacaatgctttaacccgcctgaacctcagctcaccctgcgccacgaacacaccacaccaccctggaacacaaacttccccttgcacctgaacgaaccgttcctccatacacaactctacgggacacaacgcaacgacgctccccacacaacgcctgccacgcacccaaactgactcatttgcaacatcgggtaaccctgatacccacttaacaggcgacgcttccaacgagccacattgccacccccgcctccaaccacgcgcacacgcaccttaccacccaccgcgcgcgcacaccatacccggctgccgctcgcgccacttgacacccactggccaaatccactgcattaacctggggacattccttccctttaaactgggcttacctgaaccaaccacgcttggcacaccttctggaagcctacctactaaccggcgctcggtaaaaaacccattattccccttgggaaaccttccacagcgaaccctccctcctaacacctggaacaccacgtaaccacaccctacacaacctcggcccataaacacttacctacaccacaggcaacacttactaacgccgcgacgacaacaacccctcccatcggcaccactaacccccctgcggagaccgcgaaacn

SEQ ID NO: 692439 - DNA, 584 bp, Homo sapiens
  misc_feature (419)..(419): n is a, c, g, or t
gggtccgaggcggccgcaatggaacctgtgggatccggtactctcagtagcgcggggagtcctggcgggtggaccttgaaccacttgtctggcccgggtggtctgattagacgtgacctgaccttgatcgacgctgtgctctgccttcgcttgtcgaaggtgagtatggacctgtcgcactggagtgtcattagacttcgtcgacctgcttgaaaggcagtgtgtgactcatatgccctatcgcagggacgtggatcactaaaagctctcgcgaattcccgagtatacgactatggcaaggtacacgtcaccgcattgaccaggggtattgcctcgagaggcgtgatgaataagcctggggattcctagaggcattcacgcaagggtccaaaactctaggacaaagttctaatacgtcnctaaagatcagggggtttcgatcgaccgatgctcctcgacccggaccacccgcgcaaccttgcgcgcgaaccctggtcaaggctctccctacgttttgcatgagttgtactcgtagaggttgtctcatccaccttgtgaatttcacctatgaacaaaggttggag

SEQ ID NO: 692440 - DNA, 278 bp, Homo sapiens
ttgttgacgtggcttctgcaacctccgcctcccaggttcaagtgattctcctccctcagcctcccaagtcctgagactacaggcgtgcaccaccacgcccagctaatttttgcatttttagtagagacgggatttcaccacgtagggcaggatggtctcgaactcctgacctcatgatccacctgcttcggcgtcccaaagtgctgggattacaggcattagccactgtgcctggcccaattccttgatatttaatccaatctttaaaacatattcac

SEQ ID NO: 692441 - DNA, 143 bp, Homo sapiens
gcaaggttttcattcgtgcacttcctcgtgcattttggccatgtggcagcacactccgtcatccagggcagcagttccaagccgatgtgggcagtcgcacaccaatatccattccccagcagtccagcaggcagcaagcagca

SEQ ID NO: 692442 - DNA, 1030 bp, Homo sapiens
ggaacaatgcgccttatcgaaaggcggctaaacagggagccaatgaacaaagtggttgatccactttactatgaacagattggtatgatgtgaaagcccctgctatgtccaatataagacatattggaatgacgctcgtcaccaggacccaaggagaccaaagattgcatctgatggtactcaacgggtctgtgtgttgtgaagtgagtctatgctgatttcgcatgaatgatgaaggttgcactttaggaacagattcacagctgattactggaagatgtatcaagggtaaaagactcgcctgaactacacttccatggcattggatcttacccgtgaccaaatgtgttccatgtgtcgaaaacaatgtgcagacaatgattggaacgctcacgtatgatgttcagaggactaccgatgcgtgactatgactatcggtctagtactgagttggggttctaccttaaaaaatatcggcagactaatcctgagtactggaagaccgtgcttatgctcaagtaccaatcatggtcacgcctaatagtcctggagagaacgatggattgggatcatcattgatccctggagaggatttcccaggacagtcgattgggcaacaatgacagtagaaaacatggcttggccaactctactttattcgctcctccatgaggtgtctttcgtttagacaaggtaagtagatgcttgatacgaagccccaagttttgcctcttggtgacacagctccatgggagcttctatgggtggacaaggcagctagtttctggaaaaaggccactgggtggaccgagacagggtggcctacaggttgaaccgagcctgatgcgagttattgaaaacccacccagttccacgcacatcctggtgtaaaaggttcccagactctccaaattaggtggggcacgtttaaacaacggtggccacaatgtggggcgcaaagagacaaaccagaggaaaaaacgggacacaacatatagcgggaggaacccgcaacgacacaccagccgct

SEQ ID NO: 692443 - DNA, 411 bp, Homo sapiens
tcaaaaaatgttgccacgataattgttttcagaagatagagcatgtctttttagacatactgactttaaggtgctggtaaaactttcttatgagtctgacgagcagaagaggaatggagcagactatacactcaagagataactccccatcaaaataagaatcaaagccacactttgattaggaagagagtatagagggagaagataattaaaagacaaccatgtgaaaggctgcacaaaatgggcaaaaagaggaaataagtgtcataaaaggagatctggctgggcacggtagctcacgcctgtaatcctagcactttgggaggccgaggcaggaggatcacttgaggtcaggagttcaaaaccagcctgaccaacgtggtgaaacgccatctctactaaaaatacaaa

SEQ ID NO: 692444 - DNA, 369 bp, Homo sapiens
  misc_feature (216)..(216): n is a, c, g, or t
  misc_feature (298)..(298): n is a, c, g, or t
  misc_feature (330)..(330): n is a, c, g, or t
ctggcccaaagaccatttaggtccacctcctcttttttgctcttttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtattttnaatagagatggggtttcaccatattggccaggctgatctctaactcctggcctcaagtgatctatctgcctccctcagcctnccaaagtctgggattgcagacaagtcatcgtncccggccttctttttgcccttaaaagtaagggatgtggg

SEQ ID NO: 692445 - DNA, 467 bp, Homo sapiens
ttgtgtttttttttattggtttttttgggcatgccccctcctttaaaggagcttaaagtttactggtgtgttaggggatgggtgggttaaaataaaataggggaaagaaaacaggcaatggccctactgggatttgtgttacaattggaacatcctgggtccagggtgcatagggggggccggaaagacccccttagaaagacctctttgagggagacttttagagcagggttaaaacaaaagcttttcaagcctttgctaaatgatttgtttgaacaaagcccttctttaggtcctggggatccaaacattaataaagcccgacagagtttttttttacaccatgggagggtaaagagacaattatcaattctgcaatttaagggtgcaactgagagttgggccccccacaagggggaagttcttaatgcaaagagatgcaatgggatggaaactggccaagacag

SEQ ID NO: 692446 - DNA, 227 bp, Homo sapiens
gttagacgctcttaccgaagagcggtctccacctacacaccagtctgagctactgtggtcggattcttaacccactgggccacagtgggaactctgtatattacccagattaaaacaaaaaaaaattaaaaaaccagaacttaatgtagctagttctagtggagaagaatgttattaaagctactttaagaatctttggaagggcctgaaaatcagacacagtgacc

SEQ ID NO: 692447 - DNA, 241 bp, Homo sapiens
gcaacctcccacctaagccttcccagtagctggcacgtgcaccgtgctcggttaatttttgtgtttttttgtagagatggggtctcgctatgttgctcatgctggtctcaaactccaaggctcaagtggtcctcccaccttggcctcccaaagtactggggttgtaggtgtgagccactgtgcactgtgcccagcctgacatttttttttctttggcggtggttgtcgggggctgtaattc

SEQ ID NO: 692448 - DNA, 144 bp, Homo sapiens
ctcccttatcagtcatgctgtgtgtgcaattcactcacaaccacatcatgccatgcatcagctgtgaattctgcactactttttttttcttttttccccccaagaatatctctggggaaaagtttttagtacgtcacttagaca

SEQ ID NO: 692449 - DNA, 129 bp, Homo sapiens
cccactcaagccgaatgatatttcctattcgcctacccaattctccggatcgtccctaacaaactagtagtcttccttgccctattactatccatcctcatcctatcaataatcgccggtccacgagat

SEQ ID NO: 692450 - DNA, 582 bp, Homo sapiens
  misc_feature (582)..(582): n is a, c, g, or t
agccactcgaagtccctgaggagacgtggagaggaggagggacacgggcatggtggggagtccgggaagggagacgagcgtctgaagacgtcctcccgagggcgaagtgccggggagctgggcagtctctactagcgctgcaggctctgggcgattgtagcgggacgtcacaaaatggacccaggcagggtcagagctaattctgctgaggagcggttatgtggcatcgttctaaaaagttaaggcacatttatttattttattttttgagacaagatctgctctgtgccagctgagtgagtgggagatctcagtcatgacctgtgctccggttcaaggatctcagctcagctccgagtagtggattgaggcgcccgcacagccggtattttttaacttaggttggtgagatcatctcgttgtgccaggtgagtgagtgggggtctggtcatgacttgctccagtcaacgatctctgcctagctccgatagtgggatacaggagcgtgcacaatcgggatattcaggttaacgtaagatggggttcccatgtggacaggcgattcgaatcctgcctcagtgn

SEQ ID NO: 692451 - DNA, 717 bp, Homo sapiens
agcggatcgatgcttgctaggggaggtgagtccggtcgcggcggcaaccgacggcgtgagtgaggcggcggctgaggagaacggcggccagcgcgccggcatgcagggagcaaagacggccgcgtgggacggaagcacggtgtgggtggggaggggggggagaaggcgcacactgtgccagctcctgctggtggtcggagcgccaggggcgctcatcgggcaggccagcccagggacacctgacgacgggcacgagcgcgagtcaccggcgtccggcggagcgaagatgcagtgagtccccgcgggactgctgcgcggggcccgtctgggccagcgcggaagacctcagcatcctgaccgggactttgtggcgagctgctgacttgagaccagctccaaacggggtggctttccatctccagacacccctcggaggtgtggggagcaccgggccctatggcacactcgctgtagagttgccgcgggttttggtcccagtcctgagggttgtgtgtgttaggggacccagcatcacgttgcgccgaggagttcctgcatattcttgcaccatcccgggtgctgttgctggggctctctttatttgcacgcgcgcttctagcttttttcctgacattttccactctacgctcgttctttctcccttgcatcttgttgctttgcctgagactctttgctctcgcccttgcccaggctggg

SEQ ID NO: 692452 - DNA, 665 bp, Homo sapiens
ggatcccacaaagaccgatcggaactgtgcgcactgtacgcaccgggacgcacggtgtacgcacgtgtacgcacgtgtacgaacgtgtacgcacgtgtacgcacgtgtacgcacgtgtacgaacgtgtacgcagtgtacgcacgtgtacgcacgttatgtcctgtaaccattgactgaatagcaccttgtttggattgtcgtgccggatcatgagttccatgaagtccagctacaattgatttgactgtgttagggcctttgacggccatggctgagtccaagcatccccaaaaattaaaaaataccaaatgtatgaaacctcagttatgtgtgagcatgggctgattagtcattagtccatcgagatgtcttatttaaggggaaagagtgggcgattttaggtgagatggtcctgaagtaagaaccagatgcctgttaaagttcatcaatagaaacccccacgatttatgggcccggagcgagaagagggatccctgccaagcgggttgctggtttcacgcggcatggtaattaagctcgtgatctaatggtggtgatacgcatgttgactggagttatttgacatgatgtgaagatatgtgacgtgtataacgctgtcatggacgtggttaaaaagcagaagccagtactactgaggtgtaag

SEQ ID NO: 692453 - DNA, 777 bp, Homo sapiens
  misc_feature (710)..(710): n is a, c, g, or t
  misc_feature (713)..(713): n is a, c, g, or t
  misc_feature (722)..(722): n is a, c, g, or t
  misc_feature (728)..(728): n is a, c, g, or t
ggatcccacaaagaccgatcggaactgtgcgcactgtacgcaccgggacgcacggtgtacgcacgtgtacgcacgtgtacgaacgtgtacgcacgtgtacgcacgtgtacgcacgtgtacgaacgtgtacgcagtgtacgcacgtgtacgcacgttatgtcctgtaaccattgactgaatagcaccttgtttggattgtcgtgccggatcatgagttccatgaagtccagctacaattgatttgactgtgttagggcctttgacggccatggctgagtccaagcatccccaaaaattaaaaaataccaaatgtatgaaacctcagttatgtgtgagcatgggctgattagtcattagtccatcgagatgtcttatttaaggggaaagagtgggcgattttaggtgagatggtcctgaagtaagaaccagatgcctgttaaagttcatcaatagaaacccccacgatttatgggcccggagcgagaagagggatccctgccaagcgggttgctggtttcacgcggcatggtaattaagctcgtgatctaatggtggtgatacgcatgttgactggagttatttgacatgatatgtgctatgtacgatcaataatgatatgtactatgtaatattaataataatatgtacatgcttatatgcatggggactagcagttaatgcacgacgtacatagggctataatatattanatnttttgtttntaatgnttaatttttgcgctcgcatatttgtatgtctgtgcgcattataacggcc

SEQ ID NO: 692454 - DNA, 1264 bp, Homo sapiens
  misc_feature (533)..(533): n is a, c, g, or t
  misc_feature (1015)..(1015): n is a, c, g, or t
gggtgccttccttctgctgcgagtctagcctgttgtttcgtgtctctgttccctcctgctcggttgttgggtttcgccgcttgtttgtctctgccctctccgtccctccctctccgcggcgtgttggatgtttgcttttatcagcacatgtttgcgggcgggtcgccctgccgcccccttgtttgggtttttcccccgcggggttcttctttctccccacctggggtattcccccccgccttttgtaatccctttgtcctggcccccctgtatttccggggctatctagcccctgttttggcctttccaggaaggcacccgagcgatcggggagacggcctgttccgccccgcgtctttctggggccagacccaatggcccgatgtgtgtacccgtaatccacgggtccctgtttggctggggttatcacgctgctggtgcatcctaggtcatcccagagtgagcccccagtcctgagaaggggccccaggactccctggagggtggagatggagcccctgcccgcccctggnccgggtaccactcttccgcccccgcctgtcgctgccccaccccttcccgctggggaacttctcgcggaatttatagccacctcgcttcttcttctgggaggccccatcgagccccaccgtgccactttatatatggcaccactgctcctctcactgtttcctaaggtgcacctccgcccctctgtgggtgttaccacagcttcctctgcctccctcccctctgcgccaccaccgcctctggtgttacaccacattgccactgcaccgcttcccacgcgcccaccctcggcccacaagtgtcccacaggtgtgtacgccaagccaccgccttatacttgtctcgtggtctctcgccgctggagaatttcttctcctctctgtgtcccctccgccacgttcctccgtccacttcggaggtcgaccctcggaaaggtgttggcctttcctcccacactttttgtctccacgtatttactcttgcncttagttgttccccacacgacgggaaaggctggaaacttttaacttctgtatcccctctgaatagcttaatttaaattctgttttctcctaagtggttcaccacacattgaaactgaaattgagaatggtcgctccgggtggctcaaggagacacctcccctctccttcccccttgtgccccccttatccattgcctgttttgttttgtttgttttttaactttcccataataaaatggagttctcctt

SEQ ID NO: 692455 - DNA, 1023 bp, Homo sapiens
gcgggaggatcctttaagctcaagggtaagcagctgtagtgagctttgattgtgccactgcactccagcctgggcgaccgtgagacttcatctctttgcgttgtttttaaaagtcctgtcaattactatttgacctcccaaggctgatatttcaaccgttagccattcacccttattccagaaatactaaaactttagaattattttctgaggcaatcatcttgattatacctctcctacaaggtaaatactttctcagtgtcaagttttggagcttatattcatgactattgagcaaggactcttatacccctccgactccatttcatgcaaacaattgaagtggctagcttttctcctctcctggaataaaggaagtgaattagacactatgaatatataacctaggacttctctcaaattaggcacctgtggagtacccttagggtccatatgcttaccaatatgacgttctatccaccataataacctagagcaaagacagggccatgacggcaaacgccctaaacaacgaatactcagacaggagcgacctacaaagccaaaatcaacaacaataggacactgcttcacaacacgccatcacactaagcgcaccgtaagtggaccaccatgcaaaaacaaagcgacaagaaacgaccccacgaaggaaacaaacgcgaagactaagcgagcaaacgcccgtcggaacgaaaacaaacgatgccacgacaggcacgaggtaagagcagcacacagtgggacacccacgacagaagacatgccgcagagggtagcagccaagagatccacaacagcacagacaacaagagctgaacagaaaccaaaaataagagaacaacgcgccaagaatgcagaggacaccaaggagcggaagaacacagccaacaacgcgaaaataaaagagagcaacaagaacaacacagcaaaacaacacacagaaagcagcatacgcgcaacacaaacacagggacaacacaagggaacaaaaacagcagaaaa

SEQ ID NO: 692456 - DNA, 182 bp, Homo sapiens
cgacatagaggcaggtcgtggatggcagagaaggttacaggaatgtgggcagtcctggccaggctgtatctttctacaaacctcaccacagctatgtggaatatcatttctgctccactcaggattcttgtacctcgcccacaggaaatcaagtgtagggtattacggaacatgtagcagaa

SEQ ID NO: 692457 - DNA, 334 bp, Homo sapiens
  misc_feature (264)..(264): n is a, c, g, or t
  misc_feature (274)..(274): n is a, c, g, or t
  misc_feature (289)..(289): n is a, c, g, or t
tcatatccgccttcatgtgtcattccaaggtgtcttcaagagtcattccaggtttgctagtccatgccacagtgccttgcaaaagcaccacatgaataaagcaataaaatttgattattaagttccagtagtagaccatacttattcagtacagaatgagttttatatggttattaaaacatgactaattagattaaatctgtgtagacagggtatagattttgttaaccctaatgtgtaaatgcaattagcttaaattttggnatcttatggntttctatagctatgncctttttactcttgaattggaaagcacactccattatagggacaa

SEQ ID NO: 692458 - DNA, 1105 bp, Homo sapiens
gttcgagctctatagcctatctcgctccgattgcccgaaaaggaaacatgtcctctaaggcagagcataccggcctggaggctttgcctggactaaccaaggtagcccagtgacccatagtcagcaggaaggtttgtcgaatataaacgattcagtcgtcgtccgagtcgatccgagttccatcagcaatttacatgatgaatgcataggattgagttcgatcttctctctaacaaccgcccccgcggtattgcccaatcatagtcaagctggagaggtcagaatctcgaaggtgaggcagcacacaacatgttatgtatcccccacaggttgccgcaaggatagaaggtgcgatactggattgagatccgagacttgagcatcagcatgtggtagtccaagtgcccatcccaccaagataaatgtcattggttcgcacatgtcagtgatgcgcttagcatgtacttacgggccagagattcaaggggacggcaatgaacctgattgagaagttacgcagaaagcaaatgactgggtagttccctagtctccggtcactccccagacgaagaccgcgtctggtaggctagtgtgatgagaacactcaaatgcacactctagctacgacggctggaaaatccctggaataaacgccaaagaaatacaacggcgcctaccagggtctcgtatgaccgatagaccctaagaaccatgcctatatggcccacaaacagtgctttgacagttcctcgacgcatctggttgcccccaccagcggtccctggtccaaagggtgagcccaccgtgtctgcttgcaagcacctagcagaacttctgtgggaggtctgtcggtgtacctgtagctaagtcgtcgtggcacgccttcccgtgtgcctgttttgacgtcgggagaccccgtcactggatgagtcccggtttaatgaagcccggggacacgcttttccgtggcactagccctaggggtaccttgggccggggaggccaacacacgctgggtcacctgtgccgggggactcgggcttcgcccgcgtgttgtgtccccactctcgcccgccgggatgtggctctcggcggatttgtcccc

SEQ ID NO: 692459 - DNA, 1083 bp, Homo sapiens
  misc_feature (910)..(910): n is a, c, g, or t
  misc_feature (981)..(981): n is a, c, g, or t
gcgggacctggtggaggccgtggcacacattctgggcatccgcgacttggctgctgtcaacctggacagaatcactggacggaccatggagaactggaatcgactcatgaacgtggaggtgcgccagacgctggagcgtgagctcaacctggtgctgtccgtgcgcgaggtgcggcaactcacgctccggaaactgcaggagcatgtccatcaaaggcggatgaggccagcgagctggcatgcaccacgcaccaaggaggatggatctggacaaacagaagaatcagatgaacctgcgcatcccatgatggtgaacccggagggccccaccctgatgcggatcaactccgtgcagagctcggagcggccccatgttcctggatgcaaccaatagagggatccaccaacgtgttccacagcctggcctcccggctcagcatccccacctatggcctgcatgtgcacccgagacatgagccacacatatgaaagaaatcacacagaacatggactgactaaatacatcgaaatgaataaaggaaagtgcagacacagagggacaaataacgagatgagaggaataatcataaggggaaagagtggactttgaaatgtgctccagctgcaggccagcagagcccagccccacccacagaggctcttgctgattcgaaggatagaaaacataagttaatggcaataaaaaaaggaataaagggaaaagatgaaaaaagaaatgtgaagatgaagatgaaaaggcggaattgataatagagaagaagctcaagaaaatggaggaaaaaaggatgaatcgcagcaatcgatgagagtaaggggatagaagaagcagtatgaaaaagagaaggaaatgtataatcaagcagacaagacagtggaagaaagaagaagnattggagaagactttaaccgtgatgagtctaggaaaaaggagagaaaggatagagagaaagaagagagggngaaagagagaggagaaaaggtctgcgcgatcgaaggagaaaaagaagaaaagaaagagaaaaaaaagaaagagaagagaagggaaaaaaaagcgacaggggg

SEQ ID NO: 692460 - DNA, 222 bp, Homo sapiens
tctggctactgtatcctaacaactatttacatagtatttacattatattagccattgtaagtaatctagagatgatttaaagtatgtggaaggatgtgtgtaaattgtatgtgaatacaaacattttatataagggacttgagtatctgtggatcttgatggggtagggggtgtcctgaaaccaatccccctaggatacagtagggagagggtaccgagctc

SEQ ID NO: 692461 - DNA, 149 bp, Homo sapiens
gactaggacagcagtgaaaggggtcagtggtactcactgcttggcgataggtgatagtctcaccgctcagcgataggcagtggtctcaccgcttggcgataggtaatagtcccatctgggtcaccaagaatgtatctcggaatttggtg

SEQ ID NO: 692462 - DNA, 278 bp, Homo sapiens
aagcataatgccccatttttctgcagtctcttctaggcctctttatggtgaagtgcatactcccttctgagaattgtctggctctaatcgtgttgctctacattgacgtccggtttctatggattgtttgtaaccagcttttgctgcaactgttactctgattaatatcttgctaatcataggttatggaaagactgtgtctctgttttaaggctctgttagaaattactgatgcacacactgtattgtaaattcttatctctgtatactatacttct

SEQ ID NO: 692463 - DNA, 784 bp, Homo sapiens
cagcaagcatttgagatatttgtcaacaaattattaattctcaaggacaaggtatgcagaactttaaaactttaactttttaaaagacaaagaagggaaattatccccatgcatattatttagtgcattcccatgcacattatttaaatcatacttttattttagaattttgaaattggatgtcaaagaacttaataaatgccttatagtatcttaaaaggatctacttataggcatatggcttgattctgaacagctaccttattagggaaaggaaaaacatatgatctctccacagaacgctgcagaagcatgatggctaatttgtgtgacaagctggcaggtgagttggctcagtgccctgactaatgtgacaaggaagctaaattgggtacatgttttcgacccatccttgtttaccatttatttcagtttggactagtgaagctgccttgcttcaagctttttaactttatggcaaaaagaacatcagagactgcaaattctgacttagaaagatcagtcctataatatagtcataatgatttttctcttttctccattgtgaccatttattctaactcaatcttagactggtctagtaataattccaatattagagattcatattgaagatagctaaaattcttaattatctagaaaagttaattcggaggctcagactccaattccagagaatctctggctttctgctaattctcaagtcagtcctcaaactgggggtcaaagctgagcttgggtgtgcaatttgcctgaggggtcg

SEQ ID NO: 692464 - DNA, 126 bp, Homo sapiens
cttcccagcaaagacaagttaagtcaactgttaccgctgtggcgagtcaggacaccttgcacgggaatgcactaattgagtgctacagcctaattattttcctttgctcgcccctctctttttctg

SEQ ID NO: 692465 - DNA, 702 bp, Homo sapiens
  misc_feature (271)..(272): n is a, c, g, or t
ttaacctctttctgatctgcgtcttggagtgtactgtaccctgaaggttaagggctctgtcccttcttgactttgcccctactttctgattactagccggtacatgggttacccaggcttacccactactcactcttgtacaactgctagatttggggaactttacatcccctcagattctactagtacacctcccagggctcaggaaagtgctttacgtacaatcatgcttattatgaaggaaacccatgaactagctcagtgaagaganntggggaggtgggcactgatctctgagcaccgtgggggctccccagcctgggggctccccaaccctgatgcccaaaaagtttttatctaggcctcattacacaggtatgattgattaagtcattggtcattggtgattgaacacaaactcaatctctggcccctcccaggagtgggggcggtgaggggggctggaagttcctctctaattacatggttggttcctctggcaacaagctcccaccctaaagctaccttggggtcccccaagagtcacctcattagggtaaacaaatgtggtgaaaaagagttgttatgaaatcagacacccctatcaggaaattccaaagatttaaggagttctgtccctggaacaggggacaaagaccagatgtattttttattataccacaatacaaatctcttaattta

SEQ ID NO: 692466 - DNA, 252 bp, Homo sapiens
tttgataaagaatcagcagcctcaggttacaaaagcaatgtacacaaattggtagcacgtgggacacaccgccaccaacaacaaccaagctaagaatcaaatcaagaactcaatcccttttacaatagctacaacaaaagtaataaaatacctagaagtgtacttacacaaggaggtaaaagatctttacaagaagaactacaaaacactgctgaaaaaaatcatagatgacacaaacaaatggaaacatcc

SEQ ID NO: 692467 - DNA, 200 bp, Homo sapiens
ccgtccgagaacatcgcacggccggagaccccgacgccattggcgagagactgtttgacgttgacgccgacgcccacctttgtatgcggacgtcgcacccagcatgcatcgggcgccgtgaagttgcccgagccgtagttgtaggcagtgcacgacgcggcgttcttcgtcgggtcgcgctccagcgccaccacggcgta

SEQ ID NO: 692468 - DNA, 124 bp, Homo sapiens
ttttggaaaatttacgccaaaccccgggtttggttttttttttttcccgggggccccgggggtgtggcccggtcccggtccccccgccggttattgaaaggtataatttgtttttttggaaaga

SEQ ID NO: 692469 - DNA, 160 bp, Homo sapiens
aatgagacagaatacacgaaatgttctggagctagtatgtctcacaattttgtagaatcttacagcatctttgataaacttctccagaaaattgtgggctaggccaagttcagttaaaatatagtagaaatgtttatcctggctatctctaaggtatacc

SEQ ID NO: 692470 - DNA, 808 bp, Homo sapiens
gctttaaaaaacaaaaaaaagtgccgtgatgtagtggctgtggttagttaaccgtactgagttatccatctagcatctgtggcttgctggaagggtaatataaactatttaacattgtacatggtggtacttcactacttaacctagcacgctgtcattctcaattggctatatggaggggaggcgagggtactctcctgctgggcactggtctaacttggcttaacctggcagactttggcagtatatggctattgtgctaatgcaccaattctatgtggtagggtgcatattacagggaaaggcattaaagtgtgcatgggatgggtgaattgtggagttcaaaacaaataaaacaaatgtgcaattatgttgcacaaactcaatgggtgatgagagagcgagatgaggtggtcccataacgatatacacaccttgcacacagaaagaaacagatcaagagtgcacgccaccggatgacagcgaacagtggggacctactaaggagaactatctaacgcgtcacacaaagacacgccgtgagacaactgaggacagacgcgcccaaggaaaccccggggcaacagcagagagaggcgtcgcaccgaccaaggagggcgcgccaaggggacaccaccggagggcccgcacgagtaacaacccccataaaagacgccgcgagacgaagccacagccccatgccaaaaacgggaaacagaaaagagaccaccacaggcgggagaaccgcaggagccgcaccagcgaaagccccagcagcaggcccccccacagaaggagcgcaccgcaa

SEQ ID NO: 692471 - DNA, 209 bp, Homo sapiens
ctgtaccttgagtagctgagtttaatcaggtgtccaacatgtgagttacacattaccttatatttacactgttagctttttattgttttagatttattatgcttcttctggaagtattagtgatgctactttgaaaagatcccaaacttgtaactaaattctgacatatctgttactgctgacatcttaatctggggcccaagcctgct

SEQ ID NO: 692472 - DNA, 1255 bp, Homo sapiens
aatgtcgagtgttgttgtgttgttttgggggtactgtgtatcattgtgtgtgtagagggtgtggtggggagtattggggtgggtataaagtcttttgtttaatctatgagtgtgtattgagtgaggtaggtgttgtgggtatagtggagagaaatgtgaagttaggaagatggtgtgctgtcgatggtggtgaagttccgagtatggtatgtagaagttgtaccaagtgtgtgtgactgttgttattttattggttggcgtttgttttgatgtgagggaatgtttagtggagattggttttttaatagaggtagaatgatgattagtgttatgtctaggggaaattggtaggggctgttgtgtggttaggtatctgcgttctgggtagcttgcccagaagatcctgttgccgttccaggcttcaagttggatgtaatatctgttataacgggtgttgttggtccgctcatggtcagagggccgctgtcgttgctttcatgcatgacagccagagtacgatccgttgaggctttgttgcggatgatgtcgtatgatgatatctgagcctgagatgatcagcggggcgatgcgagtgcacccgttgggtgcgttgaatgtttgcgctcgctgtcttggttcgcgtgcgcggatgcactagggcgggcgtgttctgttcccggcgtgtgcggatgtgcttgtgagactatgagtcgaggtttgttgctatagggatgtggattgtgtgctggattacggtaatgtggagagatgccgtcttgtgaaggtacgcgtgcgctgttaatgataggattgttgctgaatacctttatgagtgtagtggtggatcatgagctttgtgcaaatggcatagtctcacacccatgaaccgtgtgctgcttgtgattcctgtgtgctctcgagctgagcgatgttgagtgagaatagtggcatgttcgtagtgcctatgatcgatgtaaacttggtactacataatgacttgctccacacatgcacgtaaactatcataatcgatgtactggtaaacctagaaacaaagaatgcagcaggatctgtctagcatattaaagatgaaactgaattggaaaaatagctccattttgttggtgcattgggaagcacagtgaccaaaaatagttgtatggctgcttagtcacttagtctttccatactgatgtcaatttccacggatccatgatgtatatgtggcttgtttgtgtggtgttgtgttggtggg

SEQ ID NO: 692473 - DNA, 765 bp, Homo sapiens
  misc_feature (503)..(503): n is a, c, g, or t
  misc_feature (535)..(535): n is a, c, g, or t
  misc_feature (559)..(559): n is a, c, g, or t
ggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggcaccgggacccccgagcccaatggcgggggcggcggcaaaatcgacaacactgtagagatcacccccacctccaacggacagcgtcgggaccgctcgcgacgatgcagtgtgccacactgtgagccagcggtgcaggcgtgatgcggtgagctgctgagcgcggacgggggcacgggacgactgctgggctgtgcgacgcgactggggcaggaaggcctggtcggctgggccgtgcccccaggccccactccagcttggaggcgctgatcgcccaggtgggggcgctgggcgggtgcagcagctgcagctcggcctctgctgcctgccggtgctcttcgtggctctgggcatggnctcggaccccatcttcacgctggcgcccccgntgcaattgccactacggggccttnccccctaatgcctctggctgggagcagcctcccaatgccagacggcgtcagcgtcgccagctgctgccctagcagccagctgcctgacagccgtgtcgccaccagtaccgaccccatcgtgcagacggtttcgcccctgccgtacttcaaccattgcctcaagggattgggacctataactggcctaccttgtgctcaacggacga

SEQ ID NO: 692474 - DNA, 400 bp, Homo sapiens
atacggtcgccagattagatctaagcgacgatggtagagggcaactcaagcagtcactcacaatcgtgattaagattccagctacaatttcttgtggcacttatttattcttaattacttaggaattacccaggaaagagggcacaaatcaatctgcctctttaccttaaattaatgctcaagcaggatactgtgaatcactaaaaaactctccccaaaattatgttcttcacttcaaatcctttaagcgcaattctcatttttcacacaattcttcaatttctcatgcctcaggattattagcagctaagcagagttagaaaagattaataactgatacaaaaggctattcatttgattctagtgtttactgctgaattatactgtgttctaatctgag

SEQ ID NO: 692475 - DNA, 951 bp, Homo sapiens
ttcttcgtgcggtactataattcccgatctgtcttcggtggaagttacccccgtccgccggtccttccacgtgtgtcccgcagcttgttctcgaaaccatcttcccgggggacacctggaggcgctgggtttcccctgtacgcgccgccctgtgtaaattctcgcccccaccaggggtgttccaccctcccgccccggggtctcgaactctaatgccccccggccttatcggaattgttggcccccacaggccggcaaactcagaagcttggccagacgaatcaccctctaggtcccagtattgtaggaggctccaacccaagtctggggcctcgccgacaaaatgcatgtgcagccatgggcggaccaaccaccaacgctgtgggggaaccagtcggcctcacgttcagagtcgagttatgagccccacaccattcacggagacaaaggatcaattgtccctagccccacctccctcagtatcccaggttccctcgtggcggcccccaacccgcgccgccagcaaattgttccacgagtgttcaagaatcaagaagaggggcggtactaccacccagggtcacgaaaaagggtgcgctacgttcaaactcccaggtccaccaccgggaggacggaggaccacccacccacgcctcgcaccacagggcccagagaaataaccaaggggtgtcactccccccgcgccccccgccccccctggtcgttgtaggcgagcgcccccgcgcgcccccactgtacttgggcggcccgcgaaatacaattcctgccaccattgctggccagtaggaaacccacccccctcgcagtcatgcctgacccaaacaggggggcccacaccccgaagggagacgcaggcccccggacagagaaaactggaaaaccccgggggacccaacccaaaaacaaccacttttttctacaacaataaca

SEQ ID NO: 692476 - DNA, 327 bp, Homo sapiens
aacctcagctgcttccatccagctgacatgtttggtactagtgaccctggtggactggccagctggacccacaactattctggctgtagctgcacatcacgcgtaccggatgagaatgccaacctggatgccagctgcttcctaaatggcggccttgaagggtcaagggaaggcaggctttctggcacctcaccgccacccagcatggacgctggccggagtagctcaggggatctcagctggacttctagtgactgctttgagtcactccatgctctgccagactatagtttggggcctcactacacatcacaagagggttcttgc

SEQ ID NO: 692477 - DNA, 279 bp, Homo sapiens
ctgagagaaaatattggctgacattatgagttatatacacactataagttgtacacatgccagtaaaagcacccgacaggtagacacatatcaaaaatatttcacaaaatagaaagttgcttggaaataaaccataggacatgttattttgatagttcaaaaaaatgaaaatttaatttttaaatttccttattataaccatttcctatctattgctgagaggccctacagcattgatactcaggtagcactaaccatgtctggtatccagatgttgaa

SEQ ID NO: 692478 - DNA, 138 bp, Homo sapiens
atctagaggaccccggtcactttctacagtacagactagacaaaaaataattcacggttatgaatcccagtgcttggcacatagaatgtgctccataaatgtcagtcattattactattccctgataaatgacgtagt

SEQ ID NO: 692479 - DNA, 447 bp, Homo sapiens
ccccatccagtttgttgtgtactgggaagcactgggtgtgctgaagaaacgacaaacagcaggggtttgattcttaaaacgttcctgtactctaggtttttgtgtcattgttgttgtgttccttatttcctttttgccatcaatggtggcagttattggataggccttggccagcgctccagggctgctgctttgcccagtgactgtatctttcctgttagcatgctgatcatacttggaaactatgagtcagtgaaatgcagccgctagcagtgggggtgggtagattactagggaaagtgcagccaagacttcctgtaccaactcagggccattatctttgggggaaggtaggaactcactatggcaataggaacacctacattcacctggcatttgctgtgtactacattgatttagggagggtataaaagcacaaattaaaaa

SEQ ID NO: 692480 - DNA, 154 bp, Homo sapiens
ttggggctctattcagggggggacccctcttctccaaccactcaggaaacctcctgggcataatcaccagcaacacccgggacaataatacggggggccacctacccccaccttgaactttcagcattcccattgacgggtgctccagctgggc

SEQ ID NO: 692481 - DNA, 354 bp, Homo sapiens
cgtccagaaccaagtctcaacgtgtgtgccagtggccccgggtggcgatgaattagtccttctgtcggtagccgtctataaaggatgcgttgatgtagtctgtgtactcttgaccccgtatatcatggaaaggatcactcggttgaagtcatacgggatgatctggatgaccctggccttgttcatgtatgccggcaagttgcccgtacctcatgttctccttcatgatccggacatttgtcaactttcctgaaactacttcctccaggcccgaatcttggcccgaaatgggtagtggtgccgtgctgtaagtctgctagcagcttcagcagacaagagtaaacgaacatattc

SEQ ID NO: 692482 - DNA, 118 bp, Homo sapiens
atcatgcaccgtacagatggcccatgaaactgtggtttgctccacagatttacagagcattgaccgtagtatacccccggatcgtgtagacggtgaaagtggtttaggtttacgacgt

SEQ ID NO: 692483 - DNA, 245 bp, Homo sapiens
attttttcaacctccctggccccccccacttattccagaaacaacaccctgtggtttggagggtcccgccccccccctaaaaagggtttcccttagaactccccccaacttggggggcccagggcaggggctgggggtggttcccttttccgcccccctttttttctgcaattgggttgggccccctggggtgggctttcccccgttttccccatggatgggaaaaaagggcccttttctcctta

SEQ ID NO: 692484 - DNA, 689 bp, Homo sapiens
acgctagaaaggctgtgccctccctggtagagcggggaaatgaggtctactttattagttcccttaagagcaggttgttaaaaagaggctagcacctccctcccatctctctggttggctctcttgccatacggtctctgcacacactggctccccctcacctccaccatgagtggaagcagcctgaggccctcaccagcagcagatgcaggccccgtgcttcctgtacaggaagcagaaccatgaaccaaataaacctcttttctttataaattacccagtctcaggtgtgcctttatagtaacacaagtggactgagaaaattggtactgagagtggggtgttgctataaagatacctgaaaatgtggaagtggcttaggaactgagtaatgggcagaggttgaatgagtttggagggctcagaagaagacaagaagatgagggaaagttttaaacttcttggagactagttaagtggttgtgactaaaatgctgatagacatgcaggcaatagaggccatgctgatgaggtctctgatagaaatgaggaacttactggggactggagcgaagatcaccctggttaacccctagcaaaggtggcactgcattgtgtcgtgctttaggcttgtagaaggtaccttagagtgatgaccagatgtttgtggcgaattctaagctcagcgt

SEQ ID NO: 692485 - DNA, 151 bp, Homo sapiens
ctcgtggcttgctcaccgtcctccccaacgctactacgtgggcgtcgacgtttgcctgtccttgcgacgacgcgacttctgactgcgacctgtgcgtgcgttcgtcgtcttgcgtttgctacgtgccgacctacgtaccttgcgtgctgta

SEQ ID NO: 692486 - DNA, 638 bp, Homo sapiens
gcgggggtgttggggttttagacggagtcttgctctgttgcctaggctggagtgccatggcgcgatcttggccccctgcaacctccgcctcccgggttcgagccatttctcctgcctcagcctcccgagtatgctgggaattacaaggcgtgtgtcaaccaacgcctggctaaatttttttgtaatttttaagtagagacggggtttcaccataattggccacggctggtctcaaaactcctgagccttgtgagtccacccacacctcggcctccccaaggtgctggagaattacacggcactgaggccaccgcgcccggcgcccatcatgtgtttttgttgaaatgatcctacccgtgattagtggctattgagagttttacagggttatacattgttaaggggcccagaatcaagtaccaaaaattaaaaagggactgtaaaatccccttggtcattcataaataaatatctaaattaggaatactaattaattgagattttcactcatgagtatgttctgaatatttaatatttatttctattattttcatatgttaagatattcccttaatcttacttaaaagaattgtatgtataaattggcattaggataccaaagtaatgtttttaatgga

SEQ ID NO: 692487 - DNA, 212 bp, Homo sapiens
gctggacccatcactcaacttgctgccacaagagaaagctgcacacacatgatacactctgactttggtcacaaactctgctataaacaattctctacgttcactgttcccgagggtcattctaatacagtgtgtggtcaccacccctttagaagcaagcagaaaaagagaaagggcaaataagatgcagaaggcagtgaggttgagtgaat

SEQ ID NO: 692488 - DNA, 838 bp, Homo sapiens
  misc_feature (181)..(181): n is a, c, g, or t
gattgtgacccgggcctgtctctctccgggcgctcttggcgctttcgtatggcgctcgggcctctgatagggtttcattcgtccgttgctagcgggtcctcgtgcatggcgcttgctggccgcgacagcccctggcccgattccgcattgggggcgccgcatgtcacccgggggcgcaacnatttccgcaggccccccggaagccccaccgtgtcccagaaaagccccttttcatttcgggggttatccatgatgttgtttgccctccaagaggttttttctttcgcgcagaattttcttgaggcccctgttgccccctccagcggtagggccctctccccccactttggagggcactggccccccacaggcgatttaccccctgtgaatctccctatgagaggtctccactgctcgttggacacactccggtgttatctctgcactccggggtattccatcaccctggggtcacgcatatgtttataatatggcacccccccgtggaccccattaattccagcccttcttatatacaaatttactgggtctctattttaccctcctatcaatacctcacgagtacttcgagtctcccctcacacatttccgacggcatctacggctcaacacatttttgtaaaccacaaaggcttcccccaaacttcacgtcattattggctcaactttcctcacctatactgcttcatccccccactaagatttcacctttaccaacccaaaaacactttggtttgaaacccccccctgatactggccttttttaaatatggtttgactaattttgtatagtttccattttttgatgagggtttta

SEQ ID NO: 692489 - DNA, 237 bp, Homo sapiens
gggtgtctagaggatcccatctcaggcaggacgacagagcgagactgtatctcaaaaaagaaaagaaaagaaaaagaaaaaggcagtttctaggacacgtttatgacagtttaaaaacctggccctgcccactaaatgcttatggtgccttcaaccccttgtgaccaccaaataacaccctctgaaatcccgagtcgccccccaggtaggcaattccaccactccctaagcttgccc

SEQ ID NO: 692490 - DNA, 305 bp, Homo sapiens
tccctcagcggggtgtgtggaaccagtgtttatattccccgtcactttgaaggatattttcactggatacactgttctagggtaaatgttttttttcttcagcactttcaatatgtcatgccactctctccgggcctgaaacgtttctactaaagagtgtgctgccagatatattgtagctccattgtatattatgggtttcttttctctggctgcttttaagatcctttctttatccttgatcttagggactgtgattattaaatcccttgaggtagtcttctttgagtacaacctgccggtgg

SEQ ID NO: 692491 - DNA, 731 bp, Homo sapiens
  misc_feature (40)..(40): n is a, c, g, or t
  misc_feature (238)..(239): n is a, c, g, or t
  misc_feature (249)..(249): n is a, c, g, or t
  misc_feature (300)..(300): n is a, c, g, or t
  misc_feature (581)..(581): n is a, c, g, or t
  misc_feature (591)..(591): n is a, c, g, or t
  misc_feature (632)..(632): n is a, c, g, or t
  misc_feature (645)..(645): n is a, c, g, or t
  misc_feature (721)..(722): n is a, c, g, or t
ttttacccacagattaggcgcgccctaattaatcaaactnacccttacatagccatagataattattcatcagtccgatagatacagcttaatacaactgcataaaaaatgtgcacagtaggctactcagatcacgcttagctgtaagtttttaaccgaatttttttctgctgggggagaccaacagaaaacatcatctacttagcaagagtacgcatgaggttacgaaaggatacgnnggcccctaanatcatgacggacgtttgagataatacttctccatggactcaaaactgtttntcaaacataatagatactccggcctacagaaccttgaattaataccaatttaagggaaaggcttttagtttaaaaggaaggtgacttaagcagcgtaacaccaagtacaaaaatctgctgatatgtatattatggtgaggccctcttccaaaaaaagattaatccgctggcgatcaataaaccttcataatcaatgcgctaggacatttacgtcctttaaaggctaattacccacttactcaacgcgagcaagatggagaagttcatagagagatgcccgncaaacacttncaaaacatagacttttgactataaactgaagccacaattcngtaagttttaaanccataatgccaacaacctaatccccaagccacactaagttgacctggaagtctcactttttgtgcctatccaattnnacacccgtt

SEQ ID NO: 692492 - DNA, 216 bp, Homo sapiens
gggggggtttccccccccccttccaaacaaaaaccggccatttttacccggggatgggggcggtgggtccaaattaaagtaaaaaacacccctgatttttgccctggccctggggggggccccaaatctttttattccaaaatccctttttcccttccctcttttggttcctcaagtaaggggggaaaagatggggtcttttgggattaaaagcca

SEQ ID NO: 692493 - DNA, 264 bp, Homo sapiens
gaacagtttggtaattaaaactgggttacacaaaggccttctgtgttgtgtgtgtgcacatgtattatgtgtatatttcttcttatctatgatttatgacttttcttatataatagaaatgctcccttcaaaaatatttgaaaagtatgaatggacaggctactatgtgcaattgctatgttatatggtcatttacacaccacacaccctatccttcataggaagtaaatttcttaaggatgggatccacacttcacacttaat

SEQ ID NO: 692494 - DNA, 1019 bp, Homo sapiens
agacgttcaggctcatgacttaggaaaagttggagaggtcatagtggaccaagagacgatgccatgctcttaagaaggaaagaggtgagcaaggatcaagattgaaaagacggtattcaacgaaatcattgagcaggttagagtgtcacaagctacgtgactatgaacgaggaaaaacctgatatgaatcggcattgcaaatactttcacgatggagatggctgtggctgaacggttggtcgggacacagtgatgttgacagtgaagtgaagaagaaaggacacgagttagcgagatacccttaagtgctagctaagagctgctgttgaaggaaggcgatgttatagggagggggttcgtgccctccttcgatggcattccagccgttggactcgattgagctccgagctaatcgaagatcgaaaaagattggtatagaagattcattaaagagaacactcaaagattccagctaatgaccattgctaagaatgcaggtgtcgaaggatctgggatagttggagaaaattatgcaaagttcctcaagaagttggttatgatgctatggctggagattaggtgaatatggtggacacaggaatcattgacccaacaaaggtagtgagaaactggtttataggatgctgctggtgtggcctctctgggtaactacaggagaagtggtagtcacagagatgcctaaagaagagaagggaccctgggatgggtgcaagggtggaatggcgacagggatgggacgtggcctgttctaactcctaggactagtggcttgacgtatccccgaatgaacaggcgacacggaaaccccaagggcactggtgtcgcgcacccacgtaacctgtcgacaaaggctcagaggggacaaccgcaccaacaaccgggaggcaagcaacactgccacaaacccggcatcagcagagggggtcaacgcgggagacagcaaccaaacaggaggacaacagacatgacatcagaacatacggagcacacacacagca

SEQ ID NO: 692495 - DNA, 1360 bp, Homo sapiens
  misc_feature (799)..(799): n is a, c, g, or t
  misc_feature (869)..(869): n is a, c, g, or t
agcggattcgcggtcctggccggatgaacctgagccggggatgagctcagtgtcggagtctcgggacggtagaaggcggctggggcggaagcaagcgagagccggggcagcggggcgtcagccgatcgtagcgacgtccacggtacgcgtgaagtgcgcgtaacggcggcgaggtcacgagagcgtgaggcgcgcgcaggtggaccgatcagcttccaagagcgaccgtgatgcgatggaggtgacggcgcagcacgtctgtggaagcacctgtgaccccagaatattgaccggttgagaaaattgtactagaccattgttgcaacgcatcgggcgtgctatacggcagggaccaattcccgcccaggtcggaacacacgacgtgtacggcaggaatgccatcctaaccatggggacgcttgctcgtagcgctgtataaggccgtttccccttgcgcggaagtcttatcagatcacacgcgctgaggaccccacgggacaaaccattctccgctcactactgtgggaaggcacccaattcgtctttggcaaggaattccgtcgcacggcacagatgcccctggtatctcctcatcgtggcaaactaattcggggtaagagtttcgtaactcacccacgaagagggctcggataaggtggacttgcaaacgaatcctgacgtcggaagggagggcactgagacacgtgtgtgagacaactctacacaggcgtggggtgcggcaggatattgtgcacggcattatgtttgggagacaaaacggaaaaaaggaataaggaanatacgggaaggaagttaaatttcatcttgtgttccagaaaacctgttcaatgtatggttgaacaagtganggaacttcgattgtctaacacaaggttttggtgggggatcacaacacggcaatcccaggaccatgggatactggggtgccttgcgagaaccgaaaagaggagggggaagggggaaattagcaacggggaaaggcgtaccacgggggttataggaagtagggttccgtaattagagtaacaaagagaaccaacaaacgatttctcgtctcttacacgcggggggtataattttcttgcacaattgcggaaaaaaggggggtgcggcgaacagaggaggcaaaaaagaggcgtcagtttcaaattccttaaagcttcaattgtgtggaaatttttggaacacgtgcgtgcattgtgcatggagaaatacccctttggtgttaaccgttgaaggtgtgcgtgggaagtggaatgtttagagtgtgacagtttgtttggaacgagcgattgtctggtttgttggtcattggaaggctgggtgcgtaaatttaaga

SEQ ID NO: 692496 - DNA, 243 bp, Homo sapiens
acaagaatatatttagaggttttcaacattctcgcaatataaaagacatttaaaggatacataactctgttctctgaaaactggagcagctaattcagtcccgcaaggtactgaacggggactcaagaagcctgttgtacttctatttatgcaaacatagaagagcaagccgagaattgtagccctggtgtaatcacgaggagtggacactggttaaccctccagatgtacagtggaccgtgg

SEQ ID NO: 692497 - DNA, 204 bp, Homo sapiens
  misc_feature (145)..(145): n is a, c, g, or t
ccagtgcaaagctctacaactcaacaatacaacaaaataacaattactaactcaaagtgagaaaaggacttgaatgaacatttctctaaagaagatatacaggctcggtggggtggctcatgcctgttatcccccccaattttgnaaaggctgagtgtggatgggtcacttagagctcagtgagttcaagggccagcctatggc

SEQ ID NO: 692498 - DNA, 84 bp, Homo sapiens
atgattttcccttctttttttctaagaaaaaaatattttcaggagaatattcttctgatagctttcatcattgaacttaataaa

SEQ ID NO: 692499 - DNA, 108 bp, Homo sapiens
gtaatgggtcaggctgagctcactgccgtgtgtctttggaattgaggaggaggagactgccattgagatgcctgccatcaccttttccattccggctgcattctgccc

SEQ ID NO: 692500 - DNA, 1274 bp, Homo sapiens
  misc_feature (416)..(416): n is a, c, g, or t
ggagagcgcctgcctgtccctgtcgcgccgagccagctgccagaatgccgaactggtggaggagtgccagaaatgtggggtgtgtcagaagacgtgtttactttgccgaagaggttcagtgcgaaggcgaactagcttccataaatcctgcttcctgtgcatggtctgcacagaagaatctggacagtaccactgtggactgtgcatggtgagtgaagatctactgcaagtcgctgctacaggctaagaaagtatgtggcccagaaggctatgggtactgggcgagggcagcagtgcacccttcagatacctgacgaagtggggagtcgcgtgggtatcaaagcacgtaggaagccgccgtgggcctacaggtccagatgcagtcgaatcacctaatgcatccgaaatttgcccangaagatctgagtggctccagagcgctgccccccgtatgcagaccaggcaagtcatattgctgctggagaaggtgattggtcgctgggaacgtcctgggcataaggcctgttttcgatagtgaccaacgtgtgggaaatggccttgacgttcaagcaccctggcaataaaggatggggaaggcatcaactggcaccaagggatgtcgatgcttaaaaagacgttcgtgagccaaggggcgtagacgagtgagtgggggcaaaggagctgtgctgcctttggtacaactcttgagtgaggacaacatcgagccaacgagacccatggcctatctacctgcgctctagcaatcgcccatgccgattccaccagcaagttctgtgagaaccctccgaggcactaatctctcttgtgcagaccctgccacagtacttcattacattgacttgaaaccttgcggcaatatgggcttcccttattgagtatgggcgaggtacttgcttggaaggtcccgagcacagaataaaaagagctaccacacgatgctggggatgattgacaccaatccaacaagaaacgaagaccaacagagagttaacgggggtaccaaggagtgaagacagcacaagccccagtaatacaccagaacgagttgaaacccgacaaagcaggcacctgtaacataagacgatacactgtgagtggagatgacacacacaacacagacgagccaaggaaaccagagaggagacaaaaacttcgagaaccccacaaggaagaaagacaacaggtgcaacggaacagggacacacaacccacatcagaaagggggaaagatgaagaagcgcagcaagagacta

SEQ ID NO: 692501 - DNA, 148 bp, Homo sapiens
ctcggcctccgccgggttcacgggcgcgacggtgtgcgcgaagacggtgtcgcccgccccgaccgcgagggcgtcggcctcggcgcgggtcagctgcgcggcgaaccgctcgcccgtgtcggcacgcaggtccacccgcacctcgaag

SEQ ID NO: 692502 - DNA, 449 bp, Homo sapiens
cctctagcaccttcctgtatgtttgcttggtcacttcgtggctcaggtataacgtgcttttggaagacaagtctgtggcttgagtagtctgtgtggctgcagcctctgatctgtgcagggtattcacgtgtctgggctgaatgtccttgtgatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgta

SEQ ID NO: 692503 - DNA, 164 bp, Homo sapiens
ctggctgggctgggctgagccggaatcctggctgggaagacctgcaatcgggcgcgctggaaaccgccatggacgactggcagatcgacccgatcgcgctgcacattgtcacgccgccgggccgccggcggccggcgcgggtgcaggcgctgatcgaatacctg

SEQ ID NO: 692504 - DNA, 146 bp, Homo sapiens
tggggttcccgccagtcgcctccaccctgcccaacggcgtcgtctggtgctggtggctccccgctcccccgaactgttggacgatactgcccgtgcgaacatcgtgcttgacagccagacgactgtcgccaggctgaatgcagttc

SEQ ID NO: 692505 - DNA, 349 bp, Homo sapiens
gcagaggcctggtcacacagggccttgtgggttttttttttttggcaaatcggatcttattggttcctcaaaaaaatcttatttcggacgggttccaaactaaaaaggggaacctcgcagaggggacagcctgggtcttttcgcaattggcccagggggcttcttaccctccttaattctctgggccaaaggttcagcatattctgcaccctctctttaatttttctaaaaaggcggctgctacaaaccaatcccccattgtttgccctgcaggacttgtggggtgacaggcccccaaatctggggtgctttgacccaaggttatttacctatttggttaaagggcttt

SEQ ID NO: 692506 - DNA, 361 bp, Homo sapiens
ttaaaggatccctcgtaatttgatcaccagcgatgcagcttcgctgggtaagagtcccagaaaagaagaggtcacatggtataatcataaagcagggttctccaaacatttacattgataatggggattgttgacattagcagagatagacgttgtgattacacatgtatgtgataagtgcataaagggtgatttagtatttactacaaagtaagatttgttgcaaagcacccaactttaaactattcttttaggtgctgatgtatctcttatagatattttggaagttgtccagtgatataaacaggaagaccatttaagtaaaagatgttttgaatattttaagacacggatatcaaca

SEQ ID NO: 692507 - DNA, 145 bp, Homo sapiens
tacttccacaggggaaaaaactaatgggaaagaaaaatcctcttttctttttcacactatgtttttctttcctacctcattctcccttctcctctactgtctccagtacctaatttttttaaagtgttaccttatccagaaatca

SEQ ID NO: 692508 - DNA, 100 bp, Homo sapiens
gtcactcatcaaacatccatctatctaatcattatccatccatcctatctatattagcatctatatctataggacgtcctcatcccagagacgtcctcat

SEQ ID NO: 692509 - DNA, 405 bp, Homo sapiens
taccccgctgggcaatggaggggtcgtgtctgaatgacagatgctggaggagcaggtgctgctggtgtcccaccagaggggaatagggtcgaatgtcaggcggaggtcgaggtactcctcagagacgtgcagcaggaccttgtccagcgcctccagcagctgcttgaaggtaggcctctgcgagggcgctgtgtgccagcactcacgcatcagcgcgtacagctctggggggcagtgtgggggtcggtccatcggatgtccctcccgcagcagggagaacagttcctccacgtggattgcaggatacggggaagcccccaagggtgaaagattttcccatagcaggatcccaaaagaccacacgtcactcttgtgtgtgttaccacccggtcaaacaaggccttc

SEQ ID NO: 692510 - DNA, 587 bp, Homo sapiens
cacgtgccagactctgattactggcgggctgtacatgagtccctgggcgttggaggggcagtggacagaccacttccatctgcttgtggttcatcttcactctcacatggtaacatattctttacttctagctccttgcggggaagaattcatttgaagaattctctttatattaaccttctcgggagttttcacataaatactcagtcctacttatttcattgtcggttgtggcggcatttcattcactttcctcttccagtatccatttttcactgcacttttcccatcatctgcacatcattgatggttctgcactcattatgggttccagtgggtctcacaggcgcccaaggatatcaacacggccatgcatcactcaaatagacgttgcttcccacctctgcctttctgcctctgaagctttaactccccagcacagattttaattcttggagcaccctcttggattctacatgctcacgcttctgtctctctttgtcttcttgagaccagtaataccatcatcctttctgcaatcactatcaatatctatatcatctacataagcttctcatttctgctcc

SEQ ID NO: 692511 - DNA, 370 bp, Homo sapiens
gccattctcatccaccttataatatctcagcacagccagcttacccttctttctcttgcgcttattcttcttgggagtggtgtaagacttcttcttccttttcttagccccaccacgaagtctcaccacaagatgaagagtacactccttttgaatatgtgtagtcagacaaagtacgtctatcttccagctgcttgccaacaaagatcagtctctgctgatcagaagaaatctccttccttatcgtggatcttggcctttacattttctatggtatcagagggttcaccctagagggtgatggtcttccccgtaagggttctcacgaaaatgtgcattgtggtggcgggctccaccacagcggcacgag

SEQ ID NO: 692512 - DNA, 941 bp, Homo sapiens
  misc_feature (47)..(47): n is a, c, g, or t
  misc_feature (71)..(72): n is a, c, g, or t
  misc_feature (90)..(90): n is a, c, g, or t
  misc_feature (98)..(98): n is a, c, g, or t
  misc_feature (125)..(125): n is a, c, g, or t
  misc_feature (132)..(132): n is a, c, g, or t
  misc_feature (139)..(139): n is a, c, g, or t
  misc_feature (146)..(146): n is a, c, g, or t
  misc_feature (159)..(159): n is a, c, g, or t
  misc_feature (179)..(179): n is a, c, g, or t
  misc_feature (184)..(184): n is a, c, g, or t
  misc_feature (220)..(220): n is a, c, g, or t
  misc_feature (223)..(223): n is a, c, g, or t
  misc_feature (236)..(236): n is a, c, g, or t
  misc_feature (241)..(241): n is a, c, g, or t
  misc_feature (257)..(258): n is a, c, g, or t
  misc_feature (300)..(300): n is a, c, g, or t
  misc_feature (314)..(314): n is a, c, g, or t
  misc_feature (317)..(317): n is a, c, g, or t
  misc_feature (342)..(342): n is a, c, g, or t
  misc_feature (346)..(346): n is a, c, g, or t
  misc_feature (375)..(375): n is a, c, g, or t
  misc_feature (404)..(404): n is a, c, g, or t
  misc_feature (433)..(433): n is a, c, g, or t
  misc_feature (443)..(443): n is a, c, g, or t
  misc_feature (485)..(485): n is a, c, g, or t
  misc_feature (502)..(502): n is a, c, g, or t
  misc_feature (553)..(553): n is a, c, g, or t
  misc_feature (566)..(566): n is a, c, g, or t
  misc_feature (591)..(591): n is a, c, g, or t
  misc_feature (606)..(606): n is a, c, g, or t
  misc_feature (681)..(681): n is a, c, g, or t
  misc_feature (824)..(824): n is a, c, g, or t
  misc_feature (849)..(849): n is a, c, g, or t
  misc_feature (879)..(880): n is a, c, g, or t
  misc_feature (894)..(894): n is a, c, g, or t
  misc_feature (897)..(897): n is a, c, g, or t
  misc_feature (906)..(906): n is a, c, g, or t
  misc_feature (911)..(911): n is a, c, g, or t
  misc_feature (920)..(920): n is a, c, g, or t
  misc_feature (936)..(936): n is a, c, g, or t
ttttgaaaaaggggggtaataagaggggaatggattttaggaatatnaaggtattggggaaaatagaaaanngtttgaaaatgtatgggnaagggttngttttaaaatgtagaaaaggttaaaantattatngaagaantggtgtnggggggaatggtnttggagaaaaatatgaatgngattntaaaaaaattgttgaaaaaaataagatggaaaaatntgnggatggattaganggggntaaagaaagtgatgtnnaagatgtaaagaatatgaatataaatgagaaaaaaagaaatnttaacattggtganatnagtataaaagtgccacccccgcccncctntaaataaaaatgtaaaaaggccccccccnggtaaaaccccgggggaagggtcctccangtttcccatgcagttgtttccccaaaatngggggggggngtcttaacttttgcccttggatttaagtcaaggtactgtatngaagtgggggaaaaccngtaggaaagtccaatgttgctgttcctgcccagtgattttaaagaaattgngtagtccctatgngatttttttttttcttttctaaacngcattcctgtgcccncctacggcatgcctctatgtattggctactacagtgtttaaaaagtgtttcagatatttctctaattatgtacancctaaaatgttggtgttttgtatggatcacaagtgcagcattccttaattccttctgctatatgtcacacagttgttatttggagaaccaagtatgtattgcatgaaaacattatgacttttttctcttagtttaaataaacnccaaggtaactggacttctaaagcncctttctgtttgcctgatatctactttagnnataattttttttanaancctctgacncaacnaagtaaatnaaagtatattttatcnctatt

SEQ ID NO: 692513 - DNA, 313 bp, Homo sapiens
gccattttccaagtcattagtggcattatgctccgctaagtcccactactgtagcacctgactgcagcatcaattgaacatacatttgccagtagagaaagagaaacaagaaatgaagtatggtctctgacttcaagggactctcaggccagtgacaagatatatttaattttaggccaagtgcagtggctcacgcctgtaatcccagcactttgggaggctgaagctggtggatcacttgaggtcaggagttggagacaagcctggccaacatggtgaaaccctgtctactaaaaatggtgggacatgcccg

SEQ ID NO: 692514 - DNA, 166 bp, Homo sapiens
gtcagggtcataacccatgttttgagaactactgctctaatactttgaagacaccatgggcacccctggtgatggaaagagttactcagaaagagctacacaaaagaagtggcggcctgattgtttgacatcttcttcccagagtgagctgaccatgagaggaaag

SEQ ID NO: 692515 - DNA, 105 bp, Homo sapiens
aggctccagcttaacgatatatggaggtcagcaacggtgctcacgtgtcgacggaacttgtaacagggaggcatgcaccgaagaggtgaatacacgtcgaccagg

SEQ ID NO: 692516 - DNA, 411 bp, Homo sapiens
tcagcccacctgcacccaggtgaaataaacagccatgttgctcacacaaagcctgtttggtggtctcttcacacagatgtgcatgaaatttggtgtggtgactcggatcgggggacctgcctcaggaaatcaatcccctgtcctcctgctcttgctccgtgggaaagatccactacgacctcaggtcctcagacgactagcccagaaacatctcaccaatttcaaatctgaccttgcaagagggtccgagacatttgcatcatcattcagtgagactgtaaacacagcatctgcttgacacatccatctggaaaactggagatatccattatgaatttcctacctgaaggagatgtctattgagcctggaggtaggatccttgaaggacctattgcactgatctgtatgag

SEQ ID NO: 692517 - DNA, 483 bp, Homo sapiens
tgttggggggggggggggagggggtcaaaaaagggggaaaaaggggggggggggaggggggagggataaaaaaacgaaaaaaaaaaatggggcagaaacgaatccgttcgagaagggagagctacgcggagggccagaaacagcgcgccggggtgccgcaccacacaacgagagggcgccgggcgggcgcctcccccccagcggtggatgcacacccccgcgcggggggggacaaacaccctggttggctgtctcgcgccaacacacaaatattaatagaaaccatcgaacctctacccggcatgcggagcgacggacgccacccgatagaccaccaacaacggggcgcagcaagagaagacacacaaacaactaccactcacaaagagcatgctggccccacacccccacaccacccaacgacaaccaccaccacacagcgccccgacggccgacacgcaccaccaacgaaggtgcgctcgc

SEQ ID NO: 692518 - DNA, 392 bp, Homo sapiens
cacgaggtggatctcaacagtgaaatggtgtaccagttgggacaggatcatgatttgaaagcaatcttgcatgagacagagttacggcctgtaaagacatttgatagttatattctgcaggcacacatccaggattcagttggcattagtagaggggctactgcgctgtgggaaaaccacacatgttctccagttcaatctatataactttatccagattgaccgatgagcatggtgtacaatcgtctaaactcagacgagaagaatcagtgcggtttctgtggcaaaacgagttgcatttggaagaggagactcgtctgccaaatgctgtggttacagggttcgatttgagactatacttcctcgtccgcatgccaatacacagttttgtc

SEQ ID NO: 692519 - DNA, 839 bp, Homo sapiens
  misc_feature (9)..(9): n is a, c, g, or t
  misc_feature (67)..(67): n is a, c, g, or t
  misc_feature (76)..(76): n is a, c, g, or t
  misc_feature (175)..(175): n is a, c, g, or t
  misc_feature (181)..(181): n is a, c, g, or t
  misc_feature (189)..(189): n is a, c, g, or t
  misc_feature (205)..(205): n is a, c, g, or t
  misc_feature (209)..(209): n is a, c, g, or t
  misc_feature (215)..(215): n is a, c, g, or t
  misc_feature (217)..(217): n is a, c, g, or t
  misc_feature (221)..(221): n is a, c, g, or t
  misc_feature (234)..(234): n is a, c, g, or t
  misc_feature (249)..(249): n is a, c, g, or t
  misc_feature (257)..(257): n is a, c, g, or t
  misc_feature (320)..(320): n is a, c, g, or t
  misc_feature (322)..(322): n is a, c, g, or t
  misc_feature (337)..(337): n is a, c, g, or t
  misc_feature (343)..(343): n is a, c, g, or t
  misc_feature (361)..(361): n is a, c, g, or t
  misc_feature (366)..(366): n is a, c, g, or t
  misc_feature (368)..(368): n is a, c, g, or t
  misc_feature (374)..(374): n is a, c, g, or t
  misc_feature (393)..(393): n is a, c, g, or t
  misc_feature (396)..(396): n is a, c, g, or t
  misc_feature (441)..(441): n is a, c, g, or t
  misc_feature (464)..(464): n is a, c, g, or t
  misc_feature (467)..(467): n is a, c, g, or t
  misc_feature (509)..(509): n is a, c, g, or t
  misc_feature (520)..(520): n is a, c, g, or t
  misc_feature (524)..(524): n is a, c, g, or t
  misc_feature (552)..(552): n is a, c, g, or t
  misc_feature (564)..(564): n is a, c, g, or t
  misc_feature (581)..(581): n is a, c, g, or t
  misc_feature (598)..(598): n is a, c, g, or t
  misc_feature (609)..(609): n is a, c, g, or t
  misc_feature (626)..(626): n is a, c, g, or t
  misc_feature (653)..(653): n is a, c, g, or t
  misc_feature (665)..(665): n is a, c, g, or t
  misc_feature (741)..(741): n is a, c, g, or t
  misc_feature (799)..(799): n is a, c, g, or t
aagcatagngaaggaagggaaaccctgaggccttgtttgggcctttggggtcctggcctcctcccangggccaaangtgggcacctggcctcccttcactttggccgtcctccaaaacacacgcggcccacctcctttgcctgaacctccgcccctcttctccaatggagggaangcactntgaaagantcctcacctcaaacangcangcacgngntcantccttgtggtcangcaccccttcacggnttcccggngggtcccctgccaacctgggtcccaagcgcaaagcaccccttcccctcaagaattttcaatgntnttaaataagtttcantcatantgtgggtccctgaagcantgcangntaatgntgataagaagcccttttgntcntaaagcgcaagaaaaaaaaatacctttttttcccactcctctcanggtctttaaaaaacctatgaagngantttccctttgccgcctgagttttttcctttccctcctacaantgaaaaattanaatntgggcctcgggcctccctgcaccgggcntgcgactcctgntaccttttcccctgccntgggtgtgaatttttcnttccttcctcnttccttttcctcaaacntaaattttttttccaatagggggctcnttgataaagccnccttttaaaagataggtaaaattcaataatggtttgaataacccttttgaaaacatctcaatgggatggcctgccnataggtggtgaagaagttttttctccccaaaaaaatggaagccagaagtgggctctgngttatggttgtctagccatggtgtagcaaaagaagattgc

SEQ ID NO: 692520 - DNA, 151 bp, Homo sapiens
  misc_feature (103)..(103): n is a, c, g, or t
agtactggaggatctctagtcaccaggctccagctataaccgatatttgggatggtcacacacggttgctcatctgtgtctgacgagaatcttgtacaagggnaggcattgcaaccggctaggtgagatgaaatactacctggtctggacc

SEQ ID NO: 692521 - DNA, 487 bp, Homo sapiens
  misc_feature (66)..(66): n is a, c, g, or t
ccctcggctgggttcgagttcagtgaggcacagtgttggactatgtctcatttagttggagtcggngggaggtcatgaatatgttcagataatggattttactcccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggcttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggct

SEQ ID NO: 692522 - DNA, 104 bp, Homo sapiens
  misc_feature (43)..(43): n is a, c, g, or t
  misc_feature (89)..(89): n is a, c, g, or t
atccagacagagccaatactgcaggaagacaaaatacgggagnggtgactagaggtgggacaattgctcgaggagagtaagcgcagtcnctagtccgagactac

SEQ ID NO: 692523 - DNA, 178 bp, Homo sapiens
ggctgatctagaggatcccatctcgacgggtaacgaattgggagaacgggcatatgcaggctttgggaacaaatagggcagatgaaaccatttgggagtctcaggcatgggcttgctcttcccatgagggctcgtattctccactaggaacagattctggcgtgggtatggctcaggg

SEQ ID NO: 692524 - DNA, 307 bp, Homo sapiens
  misc_feature (44)..(44): n is a, c, g, or t
  misc_feature (261)..(261): n is a, c, g, or t
  misc_feature (272)..(272): n is a, c, g, or t
  misc_feature (278)..(278): n is a, c, g, or t
atattcataacatgacacacaaagacataaacataatggttcgnatagtaatgcaaattacgtgtatcaacgaagtatacggacataaaaatgacacctcatattgtattccccccattttgtaaggtacaatagacatataaaaaatcgataattactctcaatacttaccgattaaaataaaagttatgtattaatgacataactggttatttcgaaaggtttttctttgcaagtgatgtggcagcgaaaacttttttnctttatttaancaaatnaaggtaggagtaccactatatatattgct

SEQ ID NO: 692525 - DNA, 344 bp, Homo sapiens
tagtatatatactccaaatagactgcagaatgcaagaatggaggagaagagacagagactatgcccagcaaaagatatagccaagagaggagtcagaccagcttggcagactactacctttcccccagaggctccattagaaagccttaaagcagcctactggaacccttgtctgcgattcaacaataagaacagtctattacacattttcactagctcctacctacatgaaacagatagagaggtctaactaaacaatgtacatcagtttggtcataactgctaggaactcttctgtagtaaactggctgcacttcaaaaacatcccatcttacctccaagtc

SEQ ID NO: 692526 - DNA, 1536 bp, Homo sapiens
cgcgtgcgtagcactcttaccgcgcgtcgtttctgttggccgcctctccatggtgtgtcggcccgctgtgcgtgcgccccgccgtcgatcacccgcgcgtggtggttgtgagcgccccccctactagctggtgagagactacccccggggggtcgtatgatagttccccagtcctgcttctcgcggcgtcgtttcttttagctcctctttggtagacccccgctggcgggaccggcgtataatctaaccactgttttttccagtcaaccactgggtggtggatcccacctcctgttttgttgcgccccccttttgtgggctccacattttttgtagggggggggccaccccattagtttgtgtgagaccacaacgggtgtgtgtgtgccgccgaaaagagctcgccagcgggtgggtgtgtatccccgcgtgttccccgtgggattttttcccccccggggggtatttttcgttgctgcgggcgccccacaccgggtggttttcggcgcccccgcgggtgtttttttccgtcgcacagggtggttctctccgcgtggtcgacgctcatacctctctgagtagcgcccccaacatatatgtagggggtgctacatgtggccgccgtagacccgttacccccgcgagaagagagattgttttgagagaacccgcgggtgtataccacacagccgcggcgggctctgttaaaaaagaaattttgtaccccggcgcgagagtgttcctcctggggcacacacccacgcgagagacacacgctctctcacagcactggtgcgcacacgcgctgtgctcgcgcgggggtgttttttggagcacactctccgcggggcgcacccacacactttctcaaaggtgtgtcttgtgtagagaagtttgagtgcccccgcgcacgtgctcatcacacactctcgagcgcgacattgtagagacacactctctcctctgtggagagacacacacccacttgtcgcgccagagacaaccgcgaggggcgcgcgcgcgcttttgtgggagcgccacacacctctgtggggcgcataaatactctcacgcggcgctgtgtagatctcacacggggggtatttgtgtatacacgcacacacgcgtgtgtggcgcagagattttgtgcgagagcctgtagatatatgtgagcgcgcgcgcgcgagatttcacagcgagagtattcacacacgcgcgtgtgtctcttggagacactctcactacttctccgcggcttggaggcacaagcgagagagtgttccaccctctctccccacagccctctctctctcgagaggaggacacagcgagaaatactccactataccacacacaccttgttttgcctccaacggtccttctgagaggcacccacacgctttgggggttttgtctgtcctttgtgaggggggttttttgggtaagaagggagatgggagaagagagaagggaacccctataccccccggtttttttcctgacccccccacattaaaatttttgggccacaaggga

SEQ ID NO: 692527 - DNA, 581 bp, Homo sapiens
aacggctgatgcgtttgggcatggtacaggctgtgcttggcctgagcccaggatggacatctgcagacatggtgtccatgaagctcacccagttatccttccacagcagcccccccgagtcaccttccagtgctggcctccaggatgccctggaaatgagggccgtagtcgtagccacgcagacgcagctccttgtaaacttcagcctgggccagtgaagaggggctcctgtggtgttgggggtggtgctttcctgtgtggtcgaagagcctggggtcagggtcatcccactggtacaacttcccactcactaccagtgttgccgttctctgacacctcgaagtgcactggagtgcctccaggagcctgtacctccagtgaacactgtcccagtcttgggcaggatggtggcctggtgcagcaacacatcctcaaaacatcacagtgcatgtgctcgacgcccaggcccaggtctgcgggccaagtgtctttcacacactaatgtcagtgtcgcatgtggtggggaacgcggacgcgatcggtcggagggtgtggatcaacagtgtagtggtcaggcgatc

SEQ ID NO: 692528 - DNA, 794 bp, Homo sapiens
tgccctcataacttagatagatcgtagcattaaccatctcacgtctaggaatattagtgtatcgtacaaaacttcagtatcctccctagtatgcgtagacagcactaatactatcggtgtgcaggatagcgtactgtcataacactctaacagatgagtccctcggtagaagtcatatactgtgcctatagccagtaacgttagtcttggccgcctgcagtacaactaggcgccgctaggcctactagtctcaatctccaacacatatggctagatacgtaacaactaaactactccaatgctaaaactaatcgtcccaacaattatattactaccagtgacatgatttccaaaaaacacataatggtgaatcaacaaaacacccacaagcctaaattattaagcatcatccctctactatttttaaccaaatcaacaacaaacctatttagttgttccccaaactttttcctccgaccccctaaaaagcccctccttaatattaaatacctgatcctaccctcaaatcatggaagccaacgcatttaatccagtgaaccacttatcacgaaaaaaaaagtcctacctctttataataaattccctaagaatctcttaattataacattcacagccaaagaactaatccatattaatatctctgaaaacagattatcccactgggtatcatcaccggtgggaacagcagagtgaaggggcatatctattaaccaatggcctcctatatggagttacacaaacgagcaaaattaatccgggcagattgcggcact

SEQ ID NO: 692529 - DNA, 329 bp, Homo sapiens
  misc_feature (67)..(67): n is a, c, g, or t
  misc_feature (138)..(138): n is a, c, g, or t
aagaaatcttaatgttatggggtattgtctaagaagctttattttaaaaccatctcattaaattttnttgcattttagataatcgtccccagatgccatgttaccctagtgcagagtttggggctggataagtttttnttgtaggtggctatcctgtgttttgtagggtatttagcagcatcctggccttaaaacaaaaatgttttcagacattgccaaatgtcccccgagcggtaaagtcacccccaagttgagaaccgctctatacaaagagctgttattagagctagacatttctgaattggcatcaatttctatattgtatccat

SEQ ID NO: 692530 - DNA, 116 bp, Homo sapiens
tttccacactagaaatcagtccctggcgagatatgatagaaagatctactcatcgtacgtagggttttagtttgaggatgaactactcgtaggcaacccgatattgaaccttttgt

SEQ ID NO: 692531 - DNA, 477 bp, Homo sapiens
  misc_feature (29)..(29): n is a, c, g, or t
  misc_feature (81)..(81): n is a, c, g, or t
  misc_feature (91)..(91): n is a, c, g, or t
  misc_feature (108)..(108): n is a, c, g, or t
  misc_feature (114)..(114): n is a, c, g, or t
  misc_feature (156)..(156): n is a, c, g, or t
  misc_feature (183)..(183): n is a, c, g, or t
  misc_feature (472)..(472): n is a, c, g, or t
gaagattgccctcaggtaaaaggggaaanttgaagtgaaatttaatgaaatggatccagcaaaacctaggtaagatttaanaattttatgntccccacactttggttnccttanccccctcattgaagtgcctttttaaaaataccatatatcctnaaaggtacctaaagagacaatgggcanaccctataatccccagcactttgggaggctaatgagggaggagggaggatttcttgagccccaggagttcgagacccaggctgggcaacacagtgaaacaccgcccccgcccccgcccatctctacaaaaaatacaaaaattagctggcgtggttttgcacgcctctaatcccagctcctcaggaggctgaggtgggaggatcacttgaacctgggagatggaggttgcatgagcaatgatcaagccactgcattccagcccggctgatagagcaagaccctgtctaanggtaa

SEQ ID NO: 692532 - DNA, 397 bp, Homo sapiens
gacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctgccccagccgggccgcccagaccctcgcccctgggggttggccctcctccccccccctcccccgggcccccccccccttgcccccccccctcctctgaggggaaagggtggggtgttctttgtgtaaaatagaaacatggttttgtacagaaataaacagccttgtatagag

SEQ ID NO: 692533 - DNA, 173 bp, Homo sapiens
gggccctgtggcctgctgtgagccacggcggcaatgtactctgctgggagaagaaccagaccaagccgtccccgaaacgcgagtccggagaggagatcctgcatggagaatgttgaaccagctgtgtggagaaggcccagctgcactgcatcttcctccctgtgaggctgtgc

SEQ ID NO: 692534 - DNA, 887 bp, Homo sapiens
  misc_feature (24)..(24): n is a, c, g, or t
  misc_feature (66)..(66): n is a, c, g, or t
  misc_feature (87)..(87): n is a, c, g, or t
  misc_feature (98)..(98): n is a, c, g, or t
  misc_feature (127)..(127): n is a, c, g, or t
  misc_feature (130)..(130): n is a, c, g, or t
  misc_feature (133)..(133): n is a, c, g, or t
  misc_feature (179)..(179): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (206)..(206): n is a, c, g, or t
  misc_feature (214)..(215): n is a, c, g, or t
  misc_feature (239)..(240): n is a, c, g, or t
  misc_feature (244)..(244): n is a, c, g, or t
  misc_feature (248)..(249): n is a, c, g, or t
  misc_feature (251)..(251): n is a, c, g, or t
  misc_feature (257)..(258): n is a, c, g, or t
  misc_feature (260)..(261): n is a, c, g, or t
  misc_feature (264)..(264): n is a, c, g, or t
  misc_feature (272)..(272): n is a, c, g, or t
  misc_feature (281)..(281): n is a, c, g, or t
  misc_feature (283)..(283): n is a, c, g, or t
  misc_feature (290)..(290): n is a, c, g, or t
  misc_feature (293)..(293): n is a, c, g, or t
  misc_feature (299)..(299): n is a, c, g, or t
  misc_feature (301)..(301): n is a, c, g, or t
  misc_feature (308)..(308): n is a, c, g, or t
  misc_feature (312)..(312): n is a, c, g, or t
  misc_feature (317)..(317): n is a, c, g, or t
  misc_feature (324)..(324): n is a, c, g, or t
  misc_feature (327)..(327): n is a, c, g, or t
  misc_feature (338)..(338): n is a, c, g, or t
  misc_feature (340)..(340): n is a, c, g, or t
  misc_feature (347)..(347): n is a, c, g, or t
  misc_feature (407)..(407): n is a, c, g, or t
  misc_feature (413)..(413): n is a, c, g, or t
  misc_feature (418)..(419): n is a, c, g, or t
  misc_feature (442)..(442): n is a, c, g, or t
  misc_feature (453)..(453): n is a, c, g, or t
  misc_feature (469)..(469): n is a, c, g, or t
  misc_feature (474)..(474): n is a, c, g, or t
  misc_feature (497)..(497): n is a, c, g, or t
  misc_feature (527)..(527): n is a, c, g, or t
  misc_feature (733)..(733): n is a, c, g, or t
  misc_feature (758)..(758): n is a, c, g, or t
  misc_feature (866)..(866): n is a, c, g, or t
tgactcttttctctcggcctcgtngtgaagacacatcgcatctccccgctgtaagcttcctcccanaaaacccgtttcgggcctcanagcgtctggtnaaaagctgttgcctgctgctgctgctgcnaancangtgctgggccgtggaggtcaaaaagccccggggtgtctccctcaanaaaaaaaaantcnaanaanagtccaancctttcanntgcctggacggttcggccaccaanncaantgannangtcaannannaanaatgcgantgcaaaaantnctctgangantcaggnanggctgcntgtnctaanggcagcntcnaatgcaacaanantggctanaagcacctgtatatcccctccaaccgggtcaacgatggtgtttgtgactgctgcgatggnacagangagtnnaacagcggcgtcatctgtgagancacctgctaanagaagggccgttaggngaganagtccctgcagcagatggccgangtcacccgcgaagggttccgtctgaagaanatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcnggagctggcggctgatgccttcaangagctggatgatgacatggacgggacggtctcggtgactgagctgcagactcacccggagctggacacagatggggatggggccgttgtcagaagcggaactcaggcnctcctcagtgggggacacaca

SEQ ID NO: 692535 - DNA, 177 bp, Homo sapiens
tgaagccgaccacagtggctatgcaggagagctgggctttcgcgctaactctggatctggcactagactggatggaaagaagaaaggggtacagcccatccggtccgcaatcaagcctggagatattaaaagaggaattcccaattatgaatttaaacttggaaagataactttcat

SEQ ID NO: 692536 - DNA, 341 bp, Homo sapiens
  misc_feature (187)..(187): n is a, c, g, or t
ttttattggatttttctaacccgggttaacccccttgaatggggatttcttaagaaaaaacccccctcttgggcccttaaaagcattactttaactggtaggggacgccagaaacttttcaggccagctattccttagataggaattgaagatatggataaatattccaaagaataaaaatatattnctgtctctttaggatgggtttcagggccattaaaccgagagatgtcttggttttttaaaaagaataggatttaatagggttctgacttttgggggtccttttgcccaaagctttatcaacttttaaacattaataaactggtttttttaaagga

SEQ ID NO: 692537 - DNA, 279 bp, Homo sapiens
taccaggcagaccctgtccagagcatttgatgtccctatcatctctgaccctatgctgggacaagctttgatggggggcccagcttcaaggctgtggtgggaacagcacccccaaatgccagcctctcctttattaccatccaccagtatactgcggggccatttctggtctcttgtcaacaggaaacccatttctggtgggatatgcctatcagtgccacagggccaactcaccccatgcatactctgtacctgccccgtcagtgcctgggcacggga

SEQ ID NO: 692538 - DNA, 407 bp, Homo sapiens
  misc_feature (356)..(356): n is a, c, g, or t
  misc_feature (390)..(390): n is a, c, g, or t
gaactttttcatcctcccaaactgaaactctacccaataagcaataactccccactgccccttccacccagctcgtggtaactccaacttcctgtctctatgttttgggctactctagacaccgcctataaatagaattacgtgatatttgtctttttgtgcctggcttctttcacttagcataatgtcttccaggttcatccatgtcgtgccatgtgtaattcctttctatgggcggaatagtattctaatatgtgggatatcccatattttgttcatccattcatttgttgataggacacttggggttgttcctacctcttggactattgtggaataatcttgctagggtacangggtgggacaaaatattctgtctggactccccgntttcaactctaggaaag

SEQ ID NO: 692539 - DNA, 338 bp, Homo sapiens
aatacttacaatttgtagcatgagtttgagaactagctagtgttagaactaaccagtggaccgggcaaggtggctcaagcctataatcccagccctttgggaggccaaggcaggaggatcacctgaggtcaggagttcgagacaagcctggccaacatggcaaatccccatctctactaaaaatacaaaaattagccgggcatggtggcaggtacctgtaatcccagttactcaggaagctaaggcaggagaatcactcgaacctgggaggcagaggttgcagtgagccaagatcgtgccactgcaccccggccaggtgacaagacagactctgtctc

SEQ ID NO: 692540 - DNA, 529 bp, Homo sapiens
  misc_feature (139)..(139): n is a, c, g, or t
ggcagttttctttgcccaagcatttggtgctagttagaggctgttcactctctcctgctcctcttcggagtagaaataaaggctgtgacacaaggaagccagtggggtgggagggaggcaccataatccctccctaaanaccaagaagaataactgatactctttgtgacccaactgcatcaacactaaacagctgcagaccccctgaatctttcacacatgccaagtgaacattctgtgatgatttctcttttgtgaccggaacacctgaaaaccagaacgatctagaatttccttccccgcccccttttgtgtttagtttctaatctctgtgttatgaggtgtggggtcaataagggactgaatcacactgacttgttcccaacaacaagaacaaacaaaaacaaaaaaaaatgccttttctcagggccagttgacgtttgcaaaataattttcaaagaaaagcctataattacatcatctcaataacatttttacaacacaaaaaccaccccacaacaacacacaa

SEQ ID NO: 692541 - DNA, 563 bp, Homo sapiens
cgcggtggctcacgcctgtaatcccagctctccaggtaggctaacaaggcgggaggataggcttgatcccagaagagttcgaaacctgcctgggcattatagcgagagcccgtgctccagacgaagtaagggtgacctgacattaagcaacataatgatcacttacgaggacgagcaggccaagcttatgatagacacacttagccggggcgatgggtgggccgcgcgcctgtagtcccagctagctcggggaggctgaccgtgggaaaaatcgcgttgagcccaaggagttggaggtctccacgagagcataataaatccactaggccaggtgcaacgtccaagccttgtggaaaacaagaagcgatgaggcgcaagtcgtcggcgagagcacaaaacagggggcccttactacaaacaacagagagactcccataggcggggccgcgagaatatgtccacattaaaagccccccggcggtggggggaacaacgtgggggacacgaggggccgcccaaagggaaagaaaaaaaggggcaaagctgcccaaggaaacacccgc

SEQ ID NO: 692542 - DNA, 419 bp, Homo sapiens
cagctttggaccaagcgaccatgagagggccagagctcgggcccgaaaccagcatggaaggggacgttctggacaccttggaggcgctggggtataaggggccactgttagaggaacaggcactctccaaggcagcagagggtggactgtcttcacctgagttttcagagctctgcatttggttaggctcccagataaagtccttatgcaacctggaagaaagcatcacttcagctgggagagatgacctagagagcttccagcttgagataagtgggtttttaaaagagatggcctgtccatactcggtactcgtctcaggagacattaaagagcgcctcacaaagaaggatgactgcttgaaacttctgttgtttttaagtacagaacttcaagctttacaaatattacagaaaaaa

SEQ ID NO: 692543 - DNA, 556 bp, Homo sapiens
  misc_feature (73)..(73): n is a, c, g, or t
  misc_feature (100)..(100): n is a, c, g, or t
  misc_feature (132)..(132): n is a, c, g, or t
  misc_feature (186)..(186): n is a, c, g, or t
  misc_feature (212)..(212): n is a, c, g, or t
  misc_feature (219)..(219): n is a, c, g, or t
  misc_feature (253)..(253): n is a, c, g, or t
cggccattattttgagcggctgaggcgggggtattgcaaaggaccttagacattttttgtgttcaaggtgctnaaaatgagcacatgaagaggccgctgngaacctccaagtggccctactgcgcgggggcntacggcacgcacattcttttatgacagggccccacactgtcccccaactcgctnattctgccctcacatcccttcctttncctcttnctgctcatctgccttccctgaattactcttcccntcagcggcttgtctcatctctgaagtttggattatttttctgttcccttacgcccacccccctcttctctagttcccccaccctactttttcctcgcctacctcgttcgcctcccggccttccccccccccctctcctctcctcctctctctttctctcttcctctcctctactacactttggtcctccctctctccctcctccctccttctttgtctccactattctctatcttttctccccttcctcctccctctcttccctccctctctccccgcttcttccatcttacacatacataca

SEQ ID NO: 692544 - DNA, 546 bp, Homo sapiens
caaacacattgtttatttttaacaaaaggcatatttttggggccttactacaaaatctagctgtcaaaaaataccacaaaaattgcctaggttgggcgaacctggtaacttggggacagtgtcttcgtttgattactgccagtttatttcaggatgctaaatccctacccacgtcccaccctttaggggagtaagggcgtaattttgtcttccgcccaattaattatttctaatcactccctcaatccaagaaacaaaccttgaaacacgaacatagaccccaggcttattggggcgtgcacagccaaaaccccaagaaggtgactccttgtaaaaatgttttttgtccttctcgaagcaaaaccaaaggcccttccattgtccctctggaaacttgtaagtggccttcggccaaaatgcccaacacaaaagttcggtggaatggactttttccattcagaaactcatagcgattgcccactttatttttcaatcacggggagcttggcttccttgaaaagggccactctcaaaagaaccctgggg

SEQ ID NO: 692545 - DNA, 1054 bp, Homo sapiens
  misc_feature (98)..(98): n is a, c, g, or t
  misc_feature (172)..(172): n is a, c, g, or t
  misc_feature (271)..(271): n is a, c, g, or t
  misc_feature (274)..(274): n is a, c, g, or t
  misc_feature (409)..(409): n is a, c, g, or t
  misc_feature (435)..(435): n is a, c, g, or t
  misc_feature (457)..(457): n is a, c, g, or t
  misc_feature (487)..(487): n is a, c, g, or t
  misc_feature (493)..(493): n is a, c, g, or t
  misc_feature (505)..(505): n is a, c, g, or t
  misc_feature (509)..(509): n is a, c, g, or t
  misc_feature (511)..(511): n is a, c, g, or t
  misc_feature (518)..(519): n is a, c, g, or t
  misc_feature (528)..(528): n is a, c, g, or t
  misc_feature (549)..(549): n is a, c, g, or t
  misc_feature (552)..(552): n is a, c, g, or t
  misc_feature (555)..(555): n is a, c, g, or t
  misc_feature (557)..(558): n is a, c, g, or t
  misc_feature (570)..(570): n is a, c, g, or t
  misc_feature (572)..(572): n is a, c, g, or t
  misc_feature (577)..(577): n is a, c, g, or t
  misc_feature (587)..(587): n is a, c, g, or t
  misc_feature (593)..(593): n is a, c, g, or t
  misc_feature (633)..(633): n is a, c, g, or t
  misc_feature (639)..(639): n is a, c, g, or t
  misc_feature (675)..(675): n is a, c, g, or t
  misc_feature (677)..(677): n is a, c, g, or t
  misc_feature (703)..(703): n is a, c, g, or t
  misc_feature (728)..(729): n is a, c, g, or t
  misc_feature (731)..(731): n is a, c, g, or t
  misc_feature (740)..(740): n is a, c, g, or t
  misc_feature (746)..(746): n is a, c, g, or t
  misc_feature (749)..(749): n is a, c, g, or t
  misc_feature (768)..(768): n is a, c, g, or t
  misc_feature (770)..(770): n is a, c, g, or t
  misc_feature (772)..(772): n is a, c, g, or t
  misc_feature (782)..(782): n is a, c, g, or t
  misc_feature (793)..(794): n is a, c, g, or t
  misc_feature (797)..(797): n is a, c, g, or t
  misc_feature (800)..(800): n is a, c, g, or t
  misc_feature (805)..(805): n is a, c, g, or t
  misc_feature (812)..(812): n is a, c, g, or t
  misc_feature (819)..(821): n is a, c, g, or t
  misc_feature (829)..(829): n is a, c, g, or t
  misc_feature (834)..(835): n is a, c, g, or t
  misc_feature (837)..(837): n is a, c, g, or t
  misc_feature (861)..(861): n is a, c, g, or t
  misc_feature (869)..(869): n is a, c, g, or t
  misc_feature (913)..(913): n is a, c, g, or t
  misc_feature (944)..(944): n is a, c, g, or t
  misc_feature (988)..(988): n is a, c, g, or t
  misc_feature (1030)..(1030): n is a, c, g, or t
tcacgggccgttccccctcacgggagtcctccgcccgggcgtccggaacagtcgacggcagactccggcccgctgagccacccgaggggtcccgtggnctccgcggacccggaatctgggccctcgcggacccgcgccccgcccagtcgccccagggcttccccacacccanggagtaagtcagccgcggccctgcctgggaggaacttaccgtctacagggaaaggtggccagcagatgtgtcgggcctggtgagagggtgaggcgaganggnccgatcgcccagggccccggaagctgcggaggtcacccccgcctggccttagctcagggacaccctggattcacgtgggagcccctgctcctgcctcccccgtcccaccactgaggctgttgggccaggccagtnatgctagaacggcctcctgcactggncatgcccatgcccacggagggnaccccgccacctctgagtggcacccccatnccagtnccagcctaattncgcnangcagaanntggattctncctcaagaggccagggggtcngcnggngnntcccaactccgncnctgcnaagggcagcnttcccntcagccgcctcttccctcctcggaccccaggctggcaccngctgcngccccggcgggtgtcattccggggcgaggcctcagngnctctgcagagccctgggtatgacccnagccggccagagtccttcttccagnngngcttccagnggctcngcngcctgggccatggctcctncngngaggtcttcnaggtgcgcccnnggnggncggcnggctctntgcggtnnngcgttccntgtcnncnttccggggccccaaggaccgggcncgcaagtnggccgaggtgggcagccacgagaaggtggggcagcacccatgcntgcgtgcggctggagaggcctgggaggaggnggcatcctgtacctgcagacggagctgtgtgagccagcgtgcanaacactgtgaggcatggggtgcaccctgcctgaggccaggtntggggtacatgcgggagagctgct

SEQ ID NO: 692546 - DNA, 217 bp, Homo sapiens
taacgtattttagtcatcaaatttctaagacaataacactttagtgtctgtcttagaaatttgatgagtaaaatacattaccaaaagtaattaaagcaacatgaaggaatcaactttccttgcttaatttattccaagcaaagagaaaatcttaggatgaaatttagtgttggaaccttttaaataagtttgcctttcttgaactggagctaatttg

SEQ ID NO: 692547 - DNA, 245 bp, Homo sapiens
cccaggcctgggggccccctgggggcccgtggggtgcaaagcccccccactttgcactcatgcagcagtccttcaaccccttcaagtactactcccccttttttttcaaagtggtggcccagctggtgaaccccggctaccccccccccctggaggacttttttttgggcctcaacttccaccactacttcccggacgcctgaggctgctttgcggggggcgggccccataaaggggttttcgga

SEQ ID NO: 692548 - DNA, 133 bp, Homo sapiens
ttgtaaaggttcaaacacgtggaattacaagcacactgcgccttggctcatctatgagggagtttgaggacagtgacagtacatcctgcgcaaaaaaacaaagcagagctgataccgcaactggtacggcggg

SEQ ID NO: 692549 - DNA, 405 bp, Homo sapiens
tcctgccaggcgcagtaagattgaggagctaaaaacagacttgggtggatgtctgcagctgcaagaagatgtgtgggaacagacacagaaactctccctcccagataagcaagacaaagaaacacagaataagagtccatctatgtggtcagagaatgggataagagctgatttaaaaaaactctgctctatatagaaggcacacctggtcccaaccaaaccactggaccctaggaggataagacctcctctgctcatgagccccctcctcagtagcccatttataaaaaccctgacaattttactaccacttggcaacccgctcgggacccctttctgtgatggagagctgttcttttcttttgcctattaaactcctgctccaaaaaccaaaaaaaagcaaaa

SEQ ID NO: 692550 - DNA, 168 bp, Homo sapiens
gctcgtaccaaatgccgacatacacctaacagtgttgaaagaatttcatttctttccattaagaaaacctaactagctgggcgtggtggctcatgcctgtaatctcagcactttgggaggccgcggccgggcagttcacctgaggtcaggagttcgagaccagcctag

SEQ ID NO: 692551 - DNA, 434 bp, Homo sapiens
  misc_feature (6)..(6): n is a, c, g, or t
  misc_feature (26)..(26): n is a, c, g, or t
  misc_feature (135)..(135): n is a, c, g, or t
  misc_feature (429)..(429): n is a, c, g, or t
  misc_feature (431)..(431): n is a, c, g, or t
  misc_feature (434)..(434): n is a, c, g, or t
agacgnggaatatggaaaaggtgggnagggacccctgccctccgtgattgttttccattttccatagcccaagtgtattagtcccattcctcgcactgcctataaacaacctaccctgaggcccgggcgcggtgnccgacgccctgtaatcctcagcagtttgggagacccgaggcgggtggagcaccctgaggtcaggagtttgacacccagccctggccaacatggtgaaaccccgtctctgttgaaaatacaaaaattaacccaggcgtggtggtgggcgcctgtaatcccagctactcgggaggctgaagcagaagaattgcttgaacctgggagatggaggttgcagcgagccgagattgcgctactgcactccagcctgggtgacagaaaaaaaaaagaactacatgagactgggtaatttantnaan

SEQ ID NO: 692552 - DNA, 213 bp, Homo sapiens
acacactgcatatcctttttgctttgttggtttgtaatttgtaaacgactggggactttcgccacgaatgcccaggctggtctcgaactcctgagctcaagcgattctcccacctacagcctgccaaggtagctgggattacatggcatgtgccacttgtgcccaggccaagtgcagtgatcttcatcgcaccgtttacaaagcattcaataa

SEQ ID NO: 692553 - DNA, 239 bp, Homo sapiens
gtaggcgtatggtctcgctactaactagtatggggatcatgaggtgtaggtagtgccttgttgttaggacgtgggcgagggcatttttaatacttagagcgcaagccgataatcactgcgcccgctcataaggggatggccatggctaggttcatagatagttgggtggttggtgctaactgagtgagtgcaggcagtccgagggaggttcagttgtggccatccaaaatgcttaagga

SEQ ID NO: 692554 - DNA, 694 bp, Homo sapiens
agcgggatcggggctcggcgcgcgacgcgggcggcgactgatggaacgagagtagcggccggcgtgtgagtgtgtgggagtgctaatagtggcctgagctgtgcataggcccgccacgcgtgcagtctgcagggcacccacgtcactcggctgcgaacgcgagacaatggaaggtcggcgtacagtataatcgccgtacgcctggtatcgcctctttctacaaatttggaaatctgccgttctactccatctgtgggactcaggcagccttggtgctcgaggtgccatgatgcgaaagacaagcgatgtacactacatcgaagatctaaccgttggatcccatgcaaatgtggccattccctcttcgtacgcgtgccccagagccatgcctaggccctgctgcaggactgtggacgatcgtctaatgttcgaagatgagacgcaaaagatctggcttcttggcgagctggtcagctgacggactccatctagttaaccgcagcatctaccatggccagttgtcagcgtctaaggtggctttggcccttccgcttggcatcccgaagaagcactcagctgcccattacgtgctcgtgctcagcaagggaggagactgtgctggcaacagtccaggctctgcagacagcatcccagctgtcccagcaggctgacctgaggagcatcgtggaggaga

SEQ ID NO: 692555 - DNA, 1632 bp, Homo sapiens
  misc_feature (315)..(315): n is a, c, g, or t
  misc_feature (330)..(330): n is a, c, g, or t
  misc_feature (383)..(383): n is a, c, g, or t
  misc_feature (434)..(434): n is a, c, g, or t
  misc_feature (446)..(446): n is a, c, g, or t
  misc_feature (1331)..(1331): n is a, c, g, or t
atgacagctgtaagtgtaatggctggaaacataccccgaagcccgctcattggacctcgcgcattggatctgcgagtgagccgagctgccaaccatgagtgagactgtgcccgtcatcttgttgagccaacacgcacttggtctggaccgagcagtatctccgacttgcgagcaattgttgtcaggaaggatgatgatatacagcgtagtagctgggtgatggctggtggattgtggatgcaatctcttcatcgtctcgttcatcggacggcacagcaggacgcacaagacaaccggaacgctacggtcgtattngcttaccgtccttcnatacgcctcacatgcggcaagagtgcgatccttggtccacgtatcgtagccgngggctagatggttggcacgagggttcccttgcgggcctaactctcgtcccnattttctgcagncacacactctaacattatggacagtctcagagggtgatgacagtgtacacatgtctggtgactcagttcacttagagtgtgtgtgacgtctgaccactgagagctcaccacgcgggaagaccgtggcgaagggggctgaacttgtttgcgtgagggctacattcccatagagggacttgctctgcagtattgggcttcgctggtgccctgttgacagcctgaaagttgtggcacacgtcccttggacatgtaccgatcgcttggcccccgaagttgtgtactgtgtccaggcacggaggtaacatcacacgaggccttggaggggaagcgggtgaggcgttaagcgctgtaacaagatgcgatcggacaaatataagcaagggccaggggaaatgggtgcctccgtaggtgtagtcaccctgtggcgcaaacaaggtttgggcccctctgaaggaagacattggctttgcattcacggcccgtttcccccgccacgggcggttaatgccacaggaggccgaacctttcgattagttccactttggagcgtggacagagaaaggtccctttccattcacgcgggggtgcgcgactacttttattaccaactggtttaaaacccgcgggtccgggtgccattgaactttggccttgggcaattagatgagtttccacagaacaggctgtggcgcaaggaagaggggggaacatgagcaacatctccggggtgaggccccccggaagaaaaagaaagcggcagaccccctttcagtatcggctcagagaagccacgcgtgttccacacaacacagaggacaggaagcccccgtataactggggcgcgctatgaaccagggagcagtgggggggcgccgcaaagaatcncacacttatgcgaccaaccccgcaggtttgtgtgcgacccccgcccattagatcagcacagcgacagaagcgttcctcgggggacaatggagagggacgccgaccaacaataacgatcacacaggagggaccacatgggaagaatcagcgggcgggacacaaaacacgccgcggaagcagaaaacaaggagggacgaacaacaaaaacacacacgtcagcgagacaacacacacaggggaggaacgagaaaccagaagagagaaagcacagagaggaagaagcaaatatgagagcagaacc

SEQ ID NO: 692556 - DNA, 119 bp, Homo sapiens
cacatatctcaaggctggactctctactggcttcctcttagcagtccctgaggtaccaccatgaaagggtctctggaaagaacggtggcaacagactaacaaagaatggttatcctctc

SEQ ID NO: 692557 - DNA, 188 bp, Homo sapiens
tagcggaccgtcagacgtggagagctggaccacactttgaatatattgactgaaaacgccttcgtgacacgggactgtggctcctccgctgttgcacttgttaggaattgccgactgtgtgcctgcagcgctcgcagtggagcctgttggcagtctttaaacggcatgggtctcgtggctgtcaggga

SEQ ID NO: 692558 - DNA, 113 bp, Homo sapiens
gagaggatccccagatcgaagtgtccactgagctgggagggcctctcttcctccaccattaccaacaataccgactccaacagaccactcggcttactgtcccgggcttacca

SEQ ID NO: 692559 - DNA, 3463 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaatccaacctcccttataatacatactgaaaggaatgtctcaggctggaatgaacaggacactaggtggtaggatacgtgaagaaataaaagaacaacggtgaagacagctacatatgtcaacgttaaaagacaatgtacaagtcacagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 692560 - DNA, 99 bp, Homo sapiens
tttgaagattcatcaaagaactaaaaaaagaaataccctttgactcaataatctcattactagttatacccccaaaaggaaatacattgttttccctta

SEQ ID NO: 692561 - DNA, 194 bp, Homo sapiens
tgtgaacttcgtccccgaataggggtagcacccttcagcaggaccctataaaactttcctccagcccttgcctctttgcaggtagccccttctctgctgagctgcccactgcaacatattgtcacaatttctctagtaaatctgcccttctttacctactactatcttggtaaatggctgtaccacctgcaaac

SEQ ID NO: 692562 - DNA, 3454 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgcccaccccgaggcaccgcttccctgtgcggcgctgcagaggggccctcagtgtggcactcctcgtcaaagaaaaataaaggctagaactgca

SEQ ID NO: 692563 - DNA, 754 bp, Homo sapiens
gagcgggtcctcagatggatccagcgaggggcgccaacaagaggcgaagaggtggttccaggtcggcggcaggaagaggagcgggagcatgagcgcggagcggagtcgtcccgacccgccgtgctgtctttcttggagggcaaaggcggcggcgggaaagtcgcgcccctggagggacagcgcccggtggcgagggggcttagccaagttccggccggcggcgcccactccctcgcgttccaccgcagaggacacacgcttgtgcttgtttcttccaggacgcttccgccggttcgtgccctcccggtgccaagcctaccccgaggcacttccaggatgacagggcagcctgttcccatgctaccaggctatctcggggggaacatctgcagacgcactgtagatgcccttgggagcgagtagctacacaggtggtgtcaccacgcacggacagagggacaggggcagtctttgcgtgagcataggcagctgactatgccagctgggataaatcccattggggcatggagggttcatatcaaacacgtatgtttattcctacaaacccttccattcagaggcaattcccttccgctttcttccgctcacttctgagtcagaccagagctccctttggactcaacccggctccggctgtaccaggcctcaatccaccaacgtttaagcccagtgaaccaatgtttgacacacgacgtcatataatgcaattgtgctaccagcaagggcacgcagc

SEQ ID NO: 692564 - DNA, 337 bp, Homo sapiens
ctcgtgctcgcactcacatcctgccttggtttatacttgagggacgagactggctggatcagcgtgctcgaggtctcttaccgtggtctatgccctttaatactgggctgatactggctaatgagctggacaggtgcaatggcaatgactgtgtgggaataacgcgactgactgtggccctgcgccatcatgtgagtgttatagccatatgctgagatctgctgtgcttgccaatcgcgtagaaggagctataccagtgcgactggcgcctgaggatcgaagatacattattatgcatcgcctagtctttaggattcctgataggcgaggactattc

SEQ ID NO: 692565 - DNA, 2683 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgatcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 692566 - DNA, 245 bp, Homo sapiens
caatttttgcaaaggccctgccggatggttccataactgtaaagtttaattgctatcccttacagaaatttatcggtcagtttaaaaaaggactgatggcttttccaaacaaatgaacccccgtagctgacaaagaaccggattgtaaaggtttgtagttagggcttatttttgcatgttgatgttgactagctaataaactgttaatgttaaccctgcgaattaaatggttttttttttttcca

SEQ ID NO: 692567 - DNA, 3222 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 692568 - DNA, 164 bp, Homo sapiens
gtgataaggcggttgagagtataaagcgttgagaagtataaagcgtgagaagtataaagcgttgaggaagtataaagcgttgaggaagtataaagcgttgaggaagtataaagcgttgagaagtataaagcgttgagaagtataaagcgttgggtaccgagctc

SEQ ID NO: 692569 - DNA, 141 bp, Homo sapiens
tagtatatttttaaattggttctgacatagtatattgtttgtatacccgcacaaatgttactagtcattaaactaatgatcctacttttcttacttctcacaaactagatttctagtgacttttttctgggtaccgatgct

SEQ ID NO: 692570 - DNA, 3355 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaggcccaggtcaggccctcaggaaatggtggaacacactggagttgctctttattctggcacaatgtacgtggtgagatgcgtagctctttagtgcagttcagtcagttttgacagatgttgtttaaccaccaccctgtcaatacatggttgcctcccagcctccccgcagctggccaccgtggagcatcatccctagtgcagttcagtcagttgtgacagatgttgtgtgcctgtttaaccaccaccctgtcaatacatggttgcatcccagcctccccacagctggacaccatggagcatcgtcccaccatggagcagcctggccctgggcggtggctctcccagctgtatctctctgtcaccgcgttgttccttctcaccacgtcccgttctggcgacggacacctgtctccgtttcacttgggta

SEQ ID NO: 692571 - DNA, 738 bp, Homo sapiens
gttccaccaggaaatgccttggccagcatcccagagccctgaagggaagataaaaatgtgactatagcatgctcagcacctttcacagaccagcacttgggacctggcttcccaggccttaggccatttagttcccatgagaccctatgaggtcatctccctgcgtttaccaaggaccaaccggctccgagggcttcggtggacctcctcgagacacagctagtcggagaccagtcacccctgtgagttggaggggatggacattcacctggtaaaccagttcctccctgaagtctggcacggtgataaagtccccggaggggccccaaccggtggcataggaggagatggttctaccccagaaaggctggaacccgggccttcacccgtttctcccccgtacctatctggaatgttcgcaccccgtaagtctcctcattttcatactggggtgaccaggagagacatgtccttgaccacaccctgagaccccccgaggattgggatctggagctcaccccaggaatcccccaccccttggagacttgtggatgtggaggacctgggttcccctggtggaaaaggttttagactttaaaatttgacataagagtggagaatagggcgtggtggctcacgcccgtggtccccgccctttgggaggctgaggcgggcggatcacgagatccggagtttgaggcccgcgtggcccatatggtgaaaccctgtctctactga

SEQ ID NO: 692572 - DNA, 2872 bp, Homo sapiens
  misc_feature (2843)..(2843): n is a, c, g, or t
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtaagagccgcctgtgcgccccgggccaaggggtgtgtgggcgcctgagctgtgtgcctgggctccatgactgtgcctccgtgtccttcctgaggggacccggggcgtgcgggtgctcacggtgcatggatgcggcctgagctattgctgcccccggctctgcagagcgcaggaaacaaggggaggcggagccctgggctccgggacggcaggtggcagctcccacatggngccttgctaggatctttctgggcaccatg

SEQ ID NO: 692573 - DNA, 465 bp, Homo sapiens
  misc_feature (9)..(9): n is a, c, g, or t
gggaataanggggaaagttaatgtttaaagggtaacagggtttccagtttgggaaagatgaaaacagttcctagagatggatggtgcccaaaggttccccaatagtgtgaatgtaccctaatgcccactgaactgtacgttaatcatggcctaaaatggtcaatgttggctgggtgcggtggctcacacctgtaatcccagcactttgggaggcagaggcggggagatcacatgaggtcaggagttcgaggccagccttgccaacatggcaaaaccccgtctccactaaaaatacaaaaattagccaggtgtggtggtgcacatttgtgctcctagctatttgggaggctgagacacaagaatcgtgtaaacccgggagccagagtttgcagtgagccgagattgtagcactgcactccagcctgggtaacagagtaagactccatctcaaaaaataaaaaaaaa

SEQ ID NO: 692574 - DNA, 208 bp, Homo sapiens
cggcacgaggcatttgtaatattaattgggcctctgcatagccaaatggtgaaattattgctacaatacaaacaggcccaaaagagaaaaacagcccaaaatagcacagatattccaaatcaggacagaggtaatttctctatacataaaaaaccaccaattgaatgccttcaccaactcgcttgagttaaatgagttaaaaaaaaaa

SEQ ID NO: 692575 - DNA, 960 bp, Homo sapiens
tcgtgtcttctcgtgcttttcttttggtgtctctcttcttgctcgtcgcgttctgctctgctgttgtccgttttttatattatatgttggtgagtcgggtcagattacatgctcatgtggatcctcttcgtctgctcgctgcttattttttattttctctcatcgttctctctatcgccgtttactctcgtgtgggctcgcagtgcgtgttctccgtggcccgatgtcggcgttattgtcgcctctgtgctgttcgctagtggttgcagctctggtttatttttttcttggcgtcttccgtgttgctgcacacgtgatggcttatattgcatggttttcctgctatcttgatctgttggttttctaagccggctgtactttcttgggctgcttgtttccttgttgtggcagccgatgttcagatttttcggtggtcgttgcctcgtggggtcttggttgccactggggttacgcttctctgcctttggtatccgtcctggctttggttcgtgcctctgacagcaccgtgtgctggttgctgatgctctctgttagtgtgtcagctcgtcgacttttgtagtcatgagttgcctgccgtctccgaagtgtgttcatttgtctgcagaggcactgcttcgtggctgtctggccagtgttctgtctgccctatgctctgtgaacgtagcgatgaccgcgggctgcctgacctgtcgtctccatagttagatattccttgtagcagagcatccatacgctacatgtctgccatggaacgcttccgctacatggacaatgagagccacaatctgaggaccgcgacatctggccttggagacgctgcacctagatatatgctatcactcaagtctctatgttatgaggtggacaagcaagattgtctgcaaatgtttgcatctactggcgatcgatggagccatgacaatttgggatttcaagacc

SEQ ID NO: 692576 - DNA, 2375 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctggtcgtgggggggggggccgaaacgatgataagggagcaaaggaggaaggtagaggactcaaaaacagaataaggggaggcgaaagacaaagaaaaaagagaaaaaccctaaacaaaataagaaaaaataggagaagaataaaaaaaacgcaacaaaaaagaagcaaagaaaagaggaacaaaaaaaaaacgaaaaaa

SEQ ID NO: 692577 - DNA, 336 bp, Homo sapiens
atcaccactataaggtctcgtgggatgtgattatatcactatctcctaaagacgaggctaccatggctcacgagatgccctctaggtgacacaagctcattcgtaccaactgcccccaacctcctggaaacatcgttagcacaggagctaatgctttcctttcttaaacatgttttgggcatgaccacactctggaagtggtgaactgttacacatttcgtgtgtgtgtacataacatcaaaaactactgtgtgaaacttgagaatgtctgattaacgatttcaatgtatatctaagaactaactcaaatcgttgaccagcactttcccagtatca

SEQ ID NO: 692578 - DNA, 2131 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 692579 - DNA, 1059 bp, Homo sapiens
cttgtgttttctgcaggtggctttgagtgacacatatactgtcccttttcccctaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 692580 - DNA, 2561 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgcccaccccgcctcggagcctctgggagcagcagtgccactgtgcatggcgtgggctgagccttggtgtgtggccgtcctggtggctgcacacctggcgtcgtcctgggcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggaaggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacaggttctggcttcctgacatgctgtggaggcagggagggtgggtggccacatgtgcttgagggttttcaccctggccctcagttgcctgctgtgcgggtccctggggcagctgcaggggctcacggacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgca

SEQ ID NO: 692581 - DNA, 362 bp, Homo sapiens
ggtatcggtctagcacataatcatatttttagttgtgtgctcgttgcgtgttgtttcctggtatgagtaacattgacttttgtctctagctcttttaaggaagaaaaagatataaagccgatcattaacagatgaagaaaggtatgatttatatttaatcgtggtcagggagccagagtatggttccctatattttgggcaggaggggcctggtagatatacacacttctggattcagataatttgtttgtgttatgtggttacctggaatcaaccacgctaatggtttcttgtagagactagtttttgatagttcgcaagcacctgcattttatgtttctcttgtggttgtcatctatggg

SEQ ID NO: 692582 - DNA, 445 bp, Homo sapiens
  misc_feature (24)..(24): n is a, c, g, or t
  misc_feature (67)..(67): n is a, c, g, or t
  misc_feature (211)..(211): n is a, c, g, or t
  misc_feature (214)..(214): n is a, c, g, or t
  misc_feature (330)..(330): n is a, c, g, or t
  misc_feature (362)..(363): n is a, c, g, or t
aacccaaacccgggctgaaccccnggaatttcaaccttgccatgatccctcagtatgagaatcctanctgttcctgtgctggacttcctaatatatagaacctgtgagataatgggtcacattggcctggatgtggtggcctcatacctgtaaatcccagcactttgggaggccgaggcaggcagatcacctgaggtcaggagttcaggancgncctggccgacatggtgaagccccgtctctactaaaaatacaaaaattagacgagcgtggtggtggacacctgtggtcccagctgcttgggaggctgaggcaggagactagctgganccagggaggtagaggttgcagtgagctgagannggccactgcactccagcctgggtgacagagtgagactccatcataaataaataaataaataaatgggtcacattaagcctat

SEQ ID NO: 692583 - DNA, 540 bp, Homo sapiens
agcggtgtcttagagaaagagcaagcactttctgaatcagtggggaaatatcaatatttgatcaaattaacactacctccttcccagtgatggtgttcactcagctatatgtctttaagaaaattaaaactatggaaaatatgtctagcatatcagaagttgtaaatgctatatctggtatccagaggctggctgtagaaaagttccttggggtcactctatctcacatttgacaggtctagcattattaaaaatgcaaagccacataattggcaaatactatgattccaaatattgagctcccattaccctcttggcacagtattctttaccgtcgcccttattgaagtcagactctaaccccaaattctagtatccaaaagatatcccaaatttcgtactaatgctatctgaacaatgtgtgtaatctgagtattctcagagcctgcgaagccgttatacgaccatttcaatacctagagatccgagagtcttgctatttgaagccagcacaccactgggtgtaatatgcttagtact

SEQ ID NO: 692584 - DNA, 670 bp, Homo sapiens
  misc_feature (442)..(442): n is a, c, g, or t
ttctcgcccacctcggtggtggtgtctgggggggcctcccaggaatgggttctcctgcccatgttgggagtgatggggcaaagtcatagctgtcacctcaaggggcccctcctagtccctcaggttgcagcacaagccctggtgtccaatggttgtcgtggttccatcatcaacatcagtagcctcgtaggaaaggtgggacacgtggggcaaacaaactatgcagcatccaaggctggagtgattgggcttacccagaccgcagcccgggagcttggacaacatgggatccgctgtaactctgtcctcccagggttcattgcaacccccatgacacagaaagggccccagaaagtggtggccaagattacttaaatgatcccgatgggccccttgggggaccctgaggatgtggcaaatgtggtcgcattcttggcatctnaagatagtggatcctcccaggggcctcagtggaaggcccggggggtcttttcatggaactgccccaaggaccctgggctttgctcccccccccccccctttgccgggcctcctgctgatgggggctttaagttcccaggatacaaaagggggggcagggtatggttcaggaatgctgaatatgggaagcaggggggcttgtggccctaataaattccaggtcctctta

SEQ ID NO: 692585 - DNA, 691 bp, Homo sapiens
  misc_feature (2)..(2): n is a, c, g, or t
  misc_feature (65)..(65): n is a, c, g, or t
  misc_feature (117)..(118): n is a, c, g, or t
  misc_feature (163)..(163): n is a, c, g, or t
  misc_feature (185)..(185): n is a, c, g, or t
  misc_feature (206)..(206): n is a, c, g, or t
  misc_feature (211)..(211): n is a, c, g, or t
  misc_feature (218)..(220): n is a, c, g, or t
  misc_feature (237)..(237): n is a, c, g, or t
  misc_feature (241)..(244): n is a, c, g, or t
  misc_feature (248)..(249): n is a, c, g, or t
  misc_feature (253)..(254): n is a, c, g, or t
  misc_feature (257)..(257): n is a, c, g, or t
  misc_feature (260)..(265): n is a, c, g, or t
  misc_feature (268)..(269): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (280)..(280): n is a, c, g, or t
  misc_feature (289)..(289): n is a, c, g, or t
  misc_feature (291)..(291): n is a, c, g, or t
  misc_feature (295)..(295): n is a, c, g, or t
  misc_feature (299)..(299): n is a, c, g, or t
  misc_feature (326)..(326): n is a, c, g, or t
  misc_feature (334)..(334): n is a, c, g, or t
  misc_feature (338)..(338): n is a, c, g, or t
  misc_feature (342)..(342): n is a, c, g, or t
  misc_feature (344)..(344): n is a, c, g, or t
  misc_feature (352)..(352): n is a, c, g, or t
  misc_feature (358)..(358): n is a, c, g, or t
  misc_feature (361)..(361): n is a, c, g, or t
  misc_feature (364)..(365): n is a, c, g, or t
  misc_feature (368)..(368): n is a, c, g, or t
  misc_feature (372)..(372): n is a, c, g, or t
  misc_feature (379)..(379): n is a, c, g, or t
  misc_feature (383)..(384): n is a, c, g, or t
  misc_feature (403)..(403): n is a, c, g, or t
  misc_feature (405)..(405): n is a, c, g, or t
  misc_feature (408)..(409): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (427)..(427): n is a, c, g, or t
  misc_feature (430)..(430): n is a, c, g, or t
  misc_feature (432)..(432): n is a, c, g, or t
  misc_feature (437)..(440): n is a, c, g, or t
  misc_feature (445)..(445): n is a, c, g, or t
  misc_feature (449)..(449): n is a, c, g, or t
  misc_feature (459)..(459): n is a, c, g, or t
  misc_feature (476)..(476): n is a, c, g, or t
  misc_feature (511)..(511): n is a, c, g, or t
  misc_feature (517)..(517): n is a, c, g, or t
  misc_feature (533)..(533): n is a, c, g, or t
  misc_feature (665)..(665): n is a, c, g, or t
anctcccattgcaatggttggggcaataaccctccctaatcctagctcagtgagtagagggagtnacctccctacccaggaagtccccattttggttgcaatggccaaggtcctgannatcccactctgtacttccctgctccatctccccacccatgtaaanagagttttgggctgagtttganaagctgcctctctgctttganaaggnagtaggnnntcccctaactgcaaggngaannnncttnnattnnaanttnnnnnnaannanaanaaananaaagaactnantttnaganctctggctagtaaatgccacacatatntgcaaggntgangaanantccccgcntttatnctnaannacnatanaaaaggnaaanngaaaaaaaaaagatgaggnanctnntnttngttttnttttctnatntngtttnnnnttgantcanccaatggtanatacacagatttttggnagttttgtgggaatggggaggagaaaaaccccagntccaanagaaaaaggaaggaantggggagtacaggggaggagaaggaggtgggaaacaggatcctccctccccgccgccacacacacacaagcacaggttttcgttgctaaggcactgagaacaaatccagagaactcagtgaagggtgggggntctgtatccttccagagttgtgacta

SEQ ID NO: 692586 - DNA, 273 bp, Homo sapiens
ccttaatcctaaatttattatgaaacatgcactatttatatgaaaatacatgcagtttcactgagcagatctaagatgtatctagctaagaagagctcaacatataaagatatgtgtcctccttaagattggttctctaaaagttattggcaagtcctaattcaaagattcacaactgaattttcgttgttttgggggcaggtagatcctggcttggggggacggtagagtcatggcttgctcaaggaacaaaggggtcttctaagacgtcgt

SEQ ID NO: 692587 - DNA, 220 bp, Homo sapiens
atccagttcagcacaatgtttaagtaaagaagagaagaaccttaagtggtccacagtccaagacagttatttggagaataaccttagaggggcttctggacattttttttttttttgggttaggagtgcttgcccctaatggactaagagttttaatgggtttaagggtgaaagagtttatccccggcttggaatgtttctgtgttggggataacatcag

SEQ ID NO: 692588 - DNA, 313 bp, Homo sapiens
gcagggtctctgtgtggcctcgagtgtataccggagcccgaatccgcagggatctgcacgtgaggcagccgcggagcgcaggcgcgagacgacgtatgtcgcggcgtgaagcacgagcgtgactactaggaggagggcagtccatcatgaatgagtgagccgagccagccagcgcactcgtcgccgttacgggccgctctccggcacggcgcacggcttcgctgctactgcgcggttgcctggtgccctgagcgtgcagccccgtgggtggcgatggggtcgcgcctgaggcagcggaggttctgcgtggcga

SEQ ID NO: 692589 - DNA, 737 bp, Homo sapiens
gcttgttcgcaagcgggtttgccgccagaacacaggtgtcgtgaaaactacccctaaaagccaaacatgggaaaggcaacgaagcactcatatcaacattgtcgtcattggacacgtagatttcgggcaagttccaccacttactggccatctgatctatccaatgcgggtgggccatcgaacaaaaaagaaccatttgaacacacacattttgaagcaaaggaagggctttggccttgagacatgggggacacacggggctccctttcaaagatattggccctgggggttctatgggattacaacctggaacaggcttggagcggttggaaacggttgggtaattcaaagcaatttggacattattcctaccctatggtgagcacacacttttggaagagaacccaagcaaaggctcaacttaatggttgaacttattccatctggaatgacacccccaagtggaccaacaaagtaagaacctttgtaattctcacacagaaaccgcattggaccttttatacagggagcacaccaatttcttccaagggcctggtaaccttggtggccctgagtcgccttggcaatttcgggtctgcgactggcgatgggcatgagtctatgcgggtgtgaacaactctgttggaaacagccctcggcgtatgtttcttgccaaatgcaaactgggggtcgccaagaagccccgaagacagccaatgtgccccgatttcctgagc

SEQ ID NO: 692590 - DNA, 505 bp, Homo sapiens
cgctcctggctaatgattcgaatctaggtactatcagaggactagaagcacaggcgctggatcaggatatctcagcttcaggcaagatatgacgtagtcttctaatatctgaatcatccttagcctatgtcaggataccgtgacagaatttaggaatgtgagctttacaggctgttcttaacatgtggttcaggcggtaatctgtgttcggggtgatctggcgctcggttatcatctgttagcctttgttatcccatcaattcagtgttcgtattaagcttccaagccggggacatggtaagagaatctgcttccgtacagaaccgtctttatcatctggttggagaacgctcatgagggtgtagtctagctctgggtccatcatctctgtctcctgcagcttaaatactttttggtggcagcgggtgcttagctgcttcttgttttctttcagacattcgataatctgagcgttgccatattgcacaggggaacagaaggtttt

SEQ ID NO: 692591 - DNA, 100 bp, Homo sapiens
gcggctttgcaagctgaatttggcctttccgaggcagagtcttgatacaatcatttacagccatttaggtaacagccatttagataacagccatttaggt

SEQ ID NO: 692592 - DNA, 276 bp, Homo sapiens
accttcagatacaacgcacgagcgatggctactgtacgacagtttcctgcaaggcgtgtgatcctggctcgggatggcgtcgacgctgacgccatcgacacggccatcggccaactgatgcagacctgggatttatcctgccgctacagcgccgcccattcggcgcgatgcgccagcagaaaatccacaaacgcccgcacccgatggggcacatagcggccgtggggatacagcaaggtaactggcctgcgcgaatgccacgctcgacgcattgca

SEQ ID NO: 692593 - DNA, 120 bp, Homo sapiens
catgtggtggtatagtcctagctacatgggaggctgagaccaggatggatcactttagccccggggtttacaggctgccagtgagctatcactgtgccacctcgattgcaacacggtctc

SEQ ID NO: 692594 - DNA, 214 bp, Homo sapiens
ggtcgacgggtcgatgaagtaataaatcagataggccacggcggcgtacgtaccgccatccaggtaccggtaggcgttttcttcatagtaaacgtcttgaaacttgtacaggcccaagcgtaaccaggcgatatccagcacgttaaatgccgtcatcgcgatcaatagcatcaacaccgtttgcagcttcagagttttcgcggcaaggtcgacg

SEQ ID NO: 692595 - DNA, 138 bp, Homo sapiens
cagagggtgacatcaccctgagcacagctgaggtcgggctttccaggtctgcacgggcagcgcgctgcatgatatcatctgccacaggcgaactttctgttccttccgcacctctgggctcatctgaagcgactttat

SEQ ID NO: 692596 - DNA, 309 bp, Homo sapiens
tgaccctagagaacttgataagtactctcaggctgggcctccaggaattacttaatagttaaaacgagtctcatatctacagatctctagacaattagtcaatcgccctataaagtgtacctaccagttgctaggctctagctacggctatctactcagtaatctgtgatactactgtatttatactagaactaggtaaatgggggcagtggtctgtacccgtgtcttcattctattgatggatctaaaaagagctgtagattttcagtaagtactaaacaaaaagatgataaatatagaaaagtgcac

SEQ ID NO: 692597 - DNA, 383 bp, Homo sapiens
ggtgggctacctggagatcaggcctgcggctgcaccgcttgctgcgctgacagcgaggtcttctgccaccgcaatgcagcgccgcgccgtaggcccgagcccgccgcggcttcgctaagttatcccgagctgccctcttcgggggctgctgcgccgggcgatgggctcaagctgctgcaagccagggccttgccagtctattcgcccagtcccagcccagccgagaggtgctggggggacttccagcggccggggagcccttacaattgttcctgcagttcgtttacttcagggcaattattctccccaaaaggcaattcgccgggtgctcacaccttttctaatgaaggcattccttgatgacggacttggttgaagaggac

SEQ ID NO: 692598 - DNA, 840 bp, Homo sapiens
tcctgtgtaacggggaattttaaaataagggactatttgctttctttggttattctcacacttctcagttataagggtgattaacaatgggttaacaccgggtgactcattctactcagacgtgacgtgaatgtgctttctcgtgattttcccagtgtgagtgtgactcatagttttcatacgtatattatacaccgagggtgttaactactcgtggtgagcgtgtaaattaccggggaacgtgtacaccgtggatttaacatgtgacagcttctctccttgtgggtggtccctatactcgtgatcacgggatattataatagccagtggtgggctactaaattattcctacaagttattacacacattttgccacttggttattccccacttattgtgtacccgtgaaaggaaggactagtgttatttccccttttttaaatcccgatacgggataattgggtgtcatttcaacaagtcccaaagatccgggctcctaatctaaagtgcgttacttaatacttgaaggaggcatacttgtgctgtgcccacaaattccccagaggtgcccttgagcaacctatgggttacagctttcccctaagagttaattaattttagacgtgctattctttgtgcttttccaacaactgggcgcacaagagttcaccctccgaataaaaccttcttggggggaaaaatccccccaaaaaaaaaaataaacaacaacccaacacaagaacaacacacctctatttgtggtcgccgcctcgcgtgccccctgcgagaagatgttgtttttgaacacacccatctcggtttgggtgaggccgcggggcc

SEQ ID NO: 692599 - DNA, 1006 bp, Homo sapiens
gagagccctaagaggcataggcacttgtccaaatgatgtcttttattattattcttaattctaaccaaattcttgcgtcattcagatcctattgcccaggttgaagcttgctacactttgcattgatattttagatcttcgcctatagaaactggagttcgcatccaaacattaggcgtgggggcaataaacattagcgtggtctacgccctagtcgtgcgcgggtgttgctagccttcagtggtaaccctatccacccatcacctggtgctaaagcatgcatcttgaacggtggtcaacagttgcttcgacaaggacctggacttccatgccagatgtttggttcactttcactatgagtgaacgtctgtactaatgcaatttactctttatcgaggaatgcccgtgaatgttgcacaggcttctccaaaagcttgcaagagcgcgagacattttgggacagaatccgaaatgacctttgttccgtgaaggcagccgttggtcaaggtttttttcagcccccatatcctaatttggatccgtcctgggcggggcaacagtgggttcctgtttacatagtcaccattttgtggttgaccccagtgtggtccgaaggctctccttctgcggtagagaacccattttagtctgatttatactggaagataatctccgtgaggtaatcccgtaaatggcttccgttataaatcctaagtgctctgaaggaatctcagagttttgccacaggcctcccacccggggaatccatatagcgagggaaattttaacgccaaggggttgtctctctgcggagagtaagtccggggggacactccgctttacgggggtgcgtttcaatgggctctgcccgaagctcaaggggcgtgtgaaataacttcttatgtcttacgcgccaagtgatcataaggctttttagttctacaaacatagtttacaacccaatctgtgcgggcgacaaacggctttatggggcgaggacgccaca

SEQ ID NO: 692600 - DNA, 1758 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctggcgccgtgaaggcgtggaccggctgttgtggggtggctgggtgtgtgtcagactcggctctgtggtcggcctctgtctggctccgggacatttgcagtggttgtaaacgaggtgtgttgggaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 692601 - DNA, 1032 bp, Homo sapiens
aacaaatctaactagagacttaatgatttgtgttaggattctgctgatccacacacaccaccttcttcatgtcctcaaagctggggtcattgggcaccacatcatagaaggggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 692602 - DNA, 256 bp, Homo sapiens
catacgcagggctatataatacataatcaggaaacccagtaaaactggtatcacacgaaggaattgcacctattgtattagtccattctcacacatctataacgaactacctgagagtgcgtaattactaaagaagagcggtttccttggctctgccagccagtccaagtcagccatggctggggcaagcctcacaaccaggccagcaaggtgcacaggggcacagccaggctactatcttcacgtggcatggcgc

SEQ ID NO: 692603 - DNA, 1101 bp, Homo sapiens
aaaaagacagagaacttaagattgtatactgtagaattcggggacatagacatgcaagtttttgtttcattctttgtgcaaatgcctttgccttttttaaagaaaaaacatcgcaccatttgcacagacttggagttctgggaaacagatgaatggggagaagtgaggcacagggacgtcctgcctgagtatgcggccctggcctgtcctcctgtctgtgggtgacactggacactgagccacacacgatccgtggggactgaaggctcggccccccgacccgctctggtgggtggcagtagatcgggacgcttctcactccaggctctttcccggtcctggggctctcagaggagtagctgactgtctctttctgctgctgctgctgctggcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 692604 - DNA, 255 bp, Homo sapiens
  misc_feature (50)..(50): n is a, c, g, or t
aagtcaaggagaggcaagtcacatcttacagggatggcagcaggcaaagngagagcttgagcagggaaactcctccttttaaaaccatcagatctcatgagacttattcactattaaaagattagcatgggaaatacctgcctccatgattcaactacttcccattgggtccctcccacaacacatgggaattcaagatgagatctgagtggggacacagccaaaccatatcaaaaggatatacaaaataaccag

SEQ ID NO: 692605 - DNA, 121 bp, Homo sapiens
ccattgttcgatcacgttgtggaacgactgcgagcgcgtaacgcagttattgtccgccaggttgcaggtcagctcggcgtatttgccggtttcccccatttatttctacaatactggttgg

SEQ ID NO: 692606 - DNA, 527 bp, Homo sapiens
  misc_feature (92)..(92): n is a, c, g, or t
  misc_feature (94)..(94): n is a, c, g, or t
  misc_feature (192)..(192): n is a, c, g, or t
  misc_feature (201)..(201): n is a, c, g, or t
gttgctatgtagccatacttaatcttttgggggcggttaacgggtatctttgcatcttctcttaatcaggaatgttagctaaataaggaaananttctggcggggcgttttttgtctgttcgtttgttctttgagaaaattacggacttttgatgattcattttgaagtttgctttggctaaatttgacaanccccattgnggatgagatgtcctgggagaatgcagtacttttgggaacgacaatagcacagctatgatgagatttacaagccttgctgttcctggccagttgcaggttaagccccagaaaagttcaccttggagaagctccgagaacacacagattgtgtctcattcatcttcagacacaggcacatagtgtggcactttgttcagttaacatttgtggagctgtcatcagctcagctttaacaacacaggtgactctttcccttgataaagtcataggtaattcaggggctgggtgcggcggctcacgcatgtaatcccagcactttgggaggc

SEQ ID NO: 692607 - DNA, 777 bp, Homo sapiens
aatggctatgtacgaggctggcgtggttacatgctgaggaggcctcccgtcgtttagtgctgttgtgtatcagttagcagagctactttgtttccctgcttgtgatgtgacctggagaagtgggagctcatgccacgtgctgcactgcctgtgatggctggagccttgcagcacctgcggctcgcctccctgcagttggtggtgtgggcacccatcatccatgcatctggacgtgagcacctgcatgcacatgcaacagtgaccatgctggtgacatcctatcttgtgctacatcactgcatccttgtgtaaccatgtggctgcaagttgtgcatgtctggtagcttggaatgaggaagtgcctgtgaaagcctgggaaatcttttggggccttaacttcagtgaggagagcctgcttgctaagtgcagattgacttctcgtagtatagcaaagctgtgcatgagatgcgctttatgatgattggccagccagttcccctcagtgtggattgatcaagggctgagctgtatcagtggactcatgtgctgactgctgcagacaatcaaccctgaagacctgggggcgtcatacattgctctgtgcttggagttgactggcacgctacaagcccgattggattcggacagcctgggaaaagctgtaacatagtggactccttatgaggaggtggatgacagactgtaatgtaccccagtataaaaagtacggcgaacgaaagggtgatcgacaacctgaagaagagcacttggaacagc

SEQ ID NO: 692608 - DNA, 203 bp, Homo sapiens
ttactggacttctggcatacctggatgcttctggcatacctgaccttctggcatacctgaccttctggcatacctgaccttctggcatacctggaccttctggcatacctctaccttctggcatacctggaccttctggcatacctggaccttctgcataagtgaattaactagaaataactttgcaaggagagccaggtatg

SEQ ID NO: 692609 - DNA, 920 bp, Homo sapiens
acgaagacatcaagatacacttgtaaatcaagctgatattggaatatattcatacctgttgtacacttgggtgaaaagtatggcagatgggagactaagagtgtattaacctacctgtgagatcatatgtgtaggaaaagctgtccccagtgtcgtaagcaggacgttgaattcgaaagcatgtcaagtggcttagtagatctgtggacgatatgagagggatgcagtgcctttccccattcattcctgatggaatggttatactaggttaacattgtaattttgtttctagttgtaaatgtgtatgtctggtaaataggtattatatctggccttacaagtaccgtaacaagtgttggtcattttgaaatagcttaatgccaagtaacgaatgcatgctttgggaaattggaagatggtttcattcttagagaagcaaatatgttgtgcattaaaggctttgattgtgtcatatcaagaaattgattgaacgttctcaaacccctgtttagggtactaggtaagagggagccggtagggagagaccattgcatcgtgatacaagtgtgaacttgtagttgcttttaaacatggagagggtaacctcaaaatatcagttttagcctggcattgctagtacttaaaaggggcacagacacggccccttacaggaaaaacacggaaccacacatcaccacacgcgatgaccaccaaaaaacaaacggcgcaccacatggacaaccccctacgggcgccacgcacaaaccacacaatgtttcacacggacacccatacacaacaagcaagacagcccggcgccatcaaccactcagtgtcccacgcaaccaatacggaagcaccacaacacggacaacaaaacaccagacgcggcaccacaacgagactatccgccactgcac

SEQ ID NO: 692610 - DNA, 1094 bp, Homo sapiens
  misc_feature (406)..(406): n is a, c, g, or t
  misc_feature (444)..(444): n is a, c, g, or t
gtggagctaggtacagtcacagctgtggggacagcatgctggccaatgggtcttcccccacgctcagtcctggtactaaaggctgccatacctttctgagtgcccccagggaggggctggagcgtctccatgggttgcccacttgtgccgcaagggaggctggcatcatcctaccacgacaagtcactcggccaccgttctaactgagatccccatctccatgtgatgacaaataggcatgagcttaaagccgtagtacctagttatctagcgagggagaccgggcatcatcaacaagagttccatcctttcaaccgagtgttccaagaaatttgcgcaccatagtaatggacccgtactttatcacgcggagcaaggctcgagcatatcgagtggaagtgtcggntgtgtacatgtcagtcgaggccctgagagtactgtggnctccttcatcgttttacagtccgcgggccctcgaactccaatgaactgattgcgctcattcgcacgggctcgcattggagtcggcgctttatcgacgctaggttattgacctaggagtacccgaatcagggaagttccttggtgtgcaaggaaggtcagagccacgaccatagggagacgaaaaggagccccgaggttgagcctcatgtataacgcaaaggtaggggtcgaattgtggctccaagatgggccatccatggaaaaccctttttggcccactcttgttgaggtattggcaaagttgttctactgagcgaacttttcgttcatgatgttccctgccacaggtgcggccattctacatgaacacggcggtggctcccggggtaaaaattacgtactggaggggacattcaagtgaattcgaccctatgtttcccgctttttgcgcctctatgaagattcccgaattccaacttgagatccgatcacttttttccgggggaggcaagcaggcccaaggggggaattgccatgcgacgcggaaatgttacggtggaaaacctcccgaagggtcccccaggcggaatttccactttgattggcccagtcgtaaccaagaactggtttcccacaacccagcggttccc

SEQ ID NO: 692611 - DNA, 286 bp, Homo sapiens
ggggcagtgtctctcacccagtctggaatgcaacagcgtggtctcggctcactgcaacttccacctcccgggttcaaaggattctcgtgcctcagcctcctgagtagctgggactacaggcatgtgactctatgcctggctaattttttttgttatttttaagtagagacggggttttgccatgttggcccaggcaggcggatcacttgaggccagaatttgagaccagcctggccaacatggtgaaaccctgtatcactcttttagacccttctgtcgtcttctc

SEQ ID NO: 692612 - DNA, 191 bp, Homo sapiens
gtgggctggttgggcttgagaagcttgtttggaggttctagcaggggagcgcagctactcgtatacccttgaccgaagaccggtcctcctctatcggggatggtcgtcctcttcgaccgagcgcgcagcttcgggagggacgcacatggagcggtgagggaggaaggggacacccgcctagccagctgcgg

SEQ ID NO: 692613 - DNA, 284 bp, Homo sapiens
  misc_feature (32)..(32): n is a, c, g, or t
  misc_feature (94)..(94): n is a, c, g, or t
  misc_feature (128)..(129): n is a, c, g, or t
  misc_feature (148)..(149): n is a, c, g, or t
  misc_feature (222)..(222): n is a, c, g, or t
  misc_feature (280)..(280): n is a, c, g, or t
ccgggaatatggttcgaacccaccggcggttnccaaacaaaagattctgggcaagtaaaattgtgggaaagagaaatttgttatgggcactgtnatattatgaaaataccttccaatacttaaccgtnnacatgttttccaacttttnntgatttttcttgtatagccacctaagagaatttctttcatagattaagaactaccaagttttcaccaccttancataaagtaaacaaaagtccttcataatttaaccattagcatctttggccaaaccaanaata

SEQ ID NO: 692614 - DNA, 285 bp, Homo sapiens
gactctgaggatccccatctatgaaaaagcaagatgaagacaagataaagagataaggaagaaaaagaaagcagcagagaaaaaagggagcggtctcgtagcccaagaagacgcagatccagatctccttccccgtagagagacgagtcttcccactgtcaggggaggagagaaagcgcagtcattctcgatctccccgtcgacagaaccaagagccggaggagctgaaaaagatgttgaaggaaaaagccaaagaacgaagagaggaaagaaatgcttgagaga

SEQ ID NO: 692615 - DNA, 124 bp, Homo sapiens
  misc_feature (87)..(87): n is a, c, g, or t
ctcgggtccgacaatcatgcatgtcagccaatttcattaagcacagtgggcttagtttggctatacttatgcagtctacaactctcnactgtcgcagcgacccgctgagatcacagcgctctgc

SEQ ID NO: 692616 - DNA, 994 bp, Homo sapiens
  misc_feature (541)..(541): n is a, c, g, or t
tggaactctgaatcttttttattgggcctggctgctccccaaggggtcccctggcttctggctgggcttaatggcctcacgaacttggtgtgtcattgtgtctcagacaccattttgccatccactatccggcgggtggtgggtctttgggatcgtgtttcgcatggaggttgctgctggtccaaggcttcaccaaggattaaaggtcctcgccattctttccagcagggcggcggtaggtggcagatctcagccctccagctttgaccttgattgttcagcggggcctcattactccggggcctggcgcgtgtacctcttgcccgggtctgtgccagctcgtgactcaggggtgcagcaggactcccgttgagctgcctccatcttgttagggcgtagggggcctccaccttccctcaggcgtgttcctccaagcgtggccttcagattttcctcagtggagctccaggtcgatctccagggaccgggactgtacgtctacagctctgtgagcgtcgtctacagaagtctccaacctcangagactgtgtggtgcccacgggggtgctctcctcaatctgttgagaccagtactggtctagctcctctgggttcttccagagccagctcgtcatatggcggccctggattgtctgccatgatctgtggcaaggtcctgagattgggggggcatctacctccaagggtcacccaagagctggccaatttgggcttgaaggcctttaacttcctctaaggggtacctctccttcattggaaagagagcaaggctccccttcctttgaagaagctctcagaaatcctcttgtctcccaagcttggcacagtcctgtggtgaaattgggggggtcacatccagagagccgcttggagagacccccttggaatgggtcggtcctcccaaagatgtgcgtgctgtggccaagttctgtcttcacaaatttgaactctaagggttcacagaggcacgatg

SEQ ID NO: 692617 - DNA, 408 bp, Homo sapiens
cgaactcgtggagcccacggactgcgccacctctgacctgccagctgaagcctgccagagtgcctgcgtggcgcacttgggctaatgccgctatctctgtgcactcgtacctcagtgcaactgatagctagaacccacgagtcactacccattcatggctaatacagatgtcacttctacatctatcattgctacatcctaccaggaggcctctcaagttgagtactagctagggcctgcagagttcaggccaagagcaaggtgtacctggatgtcccactgtggctgagaactcggcacatctgccactaccctgctacaataacggtccctctagcttagacagagctgatacagtcgtactgacacccgaggctacataccgcttggacgcacaggcattactcc

SEQ ID NO: 692618 - DNA, 376 bp, Homo sapiens
tagagttccaatatatcaggctatcccttccctacacatcaagcttgaagatttgcccccacccaggactggcaagattagcttaaactcaacatgccccgagtcagataactaaatatacctcttagtctaagtagacactttcactaggtaagtagaggcctttcctacagggtctgagaaggccaccgcagtcatttcttcccttcggtcagacacaattcctcagtttagccttcccacctctatacagtctaacagaccagcccttattagtcaaatcagccaagcagtttctcaggctcttagtattcagtgaaacctttatatcccttacggtcctccgtcttcaagaaaagtagaacggactacaggt

SEQ ID NO: 692619 - DNA, 152 bp, Homo sapiens
aaacgtgtctacctccaacagaaccctctatacacatgacaatcggggacgggatgacgccgtctgtagtacatgagtgccgcattcctatcacatggcactgccacatcttactgagacataagcagccccagaagcacagaaaacaaggc

SEQ ID NO: 692620 - DNA, 443 bp, Homo sapiens
ggaagataaagtgggagtgaagggcatccctacaactggtgactcatgatgctcgaaccatacgcataaccagatcctgatcatcaggtgaacgatactgtgacagatgataagaggactggcaagataatccaatttatcaaatatgatacaggcaatttgtgtatggtgattggtggagccaacctcggtcgtgtaggtgtgatcaccaacagggaaagcaatcaggttctttagatgtggtgcatgtgaaggatgccaatggcaacagctttgccacgaggctttccaacattttagtcattggcaatggcaataaaccttggatttccctgcccaggggaaagggcatacgacttacagttgctgaagagagagatacgaggatggccaccaaacaagagcagtggctacatagcagtcacagcatatctttatttctt

SEQ ID NO: 692621 - DNA, 564 bp, Homo sapiens
  misc_feature (563)..(563): n is a, c, g, or t
gaattatttgagcaggtggaccgacctatgcccattgcagccctggacatggggaatgtaatccgtgcccctaattgtactgccagacaccaccagctttactaatctgcgggcctggatgctaaaacatgtacgcaacagccgaggcctaacctttattttgaatttgggtatcaaaaagagaggggggccttccaaccccaccacaaaagtcaggttgggtttcctgtctcctgcacaaaaaacaccttgggtcgggaactaatttttcccacagcaaaagtgccggtggtagcagccgcaacaaaaaaatttctccaaagatgaagaatccccccttctttttttttaatggcggtcggccgggggggctgccgggcttgggttttaataaaaaaaagccccccggcggggtgctggcccccgtaagaggtaacccagtctgggcccccctccaaattttgttcgtttgtctgggcctttggggggggaaataagaccttaaaaatttttttttgccccaggaccagggggtgaataaataaaatttttttgtggcgggna

SEQ ID NO: 692622 - DNA, 300 bp, Homo sapiens
ccctgaaggtgctctgctccggagctgtggtgctgtgtcctgttgtctcctgtgagtcctcggaaaggttccttgtgttcctggtgctcctcgtctggaattctaggagatcagtagactcagctaggctcgtccagcatgtaccttgggtctccttcctgtccttgctgttcctcctcttcttcctcttttccattgttctcattgtcatcttcatctttctcgtctctctcctccctgttcctcccgtatatgatccttatgctgctttctctgtgtcctttcattgtcgtctgatcc

SEQ ID NO: 692623 - DNA, 227 bp, Homo sapiens
aaagacgaaatcaaacatcacccattgtaatctcaagcaacgacgacacactttaggctttgtctacaaattttctgacaaattaatgacaccagctgggaagaggagcagtttggatgagactgggataagaagtggttaataaaatctggttatctattctaggaaaaaataaacagcccgataccacacaaaaaaaaaaaatctggtctcagttggcctcagcg

SEQ ID NO: 692624 - DNA, 430 bp, Homo sapiens
  misc_feature (6)..(6): n is a, c, g, or t
ttggcnatcactgtctccagcctgggtgacagagcgagatccgtctcaaaaaaaaaaaaaaaaaagattaggcttgggggcacacgcctgtagtccctagctactcaggaggctgaggtgggaggatggcttgagcccaggtgtgggaggctgcagtgagccatgattataccactgtagtccagccgggacaacagaacgagaccctgtctctaaaagttatttttgtccacattaccataatacccagctactgaggaggctgaggcaaaaagagtgcttgagtccaggagtttgatgtcagcctgagcaatatagcaagaccctcacctcttaaaaaaaaaggtaaattaaaaaattaccacaatggctcaggtcaatggaaaaacaggcatatagtacagtgatcgaccaagggttaccgagctcg

SEQ ID NO: 692625 - DNA, 169 bp, Homo sapiens
ggcgtttgccccccccatttttaatatttgccaaaacctttttcaaggaaagggcttttttttggacacatttttaccccttttccattttaaaacagggaaagggggaaattactgttttttatgtccaaggaccaccaataaatcaaatggaaatttatttttttta

SEQ ID NO: 692626 - DNA, 771 bp, Homo sapiens
  misc_feature (51)..(51): n is a, c, g, or t
  misc_feature (66)..(66): n is a, c, g, or t
  misc_feature (72)..(72): n is a, c, g, or t
  misc_feature (90)..(90): n is a, c, g, or t
  misc_feature (96)..(96): n is a, c, g, or t
  misc_feature (100)..(100): n is a, c, g, or t
  misc_feature (116)..(116): n is a, c, g, or t
  misc_feature (118)..(118): n is a, c, g, or t
  misc_feature (121)..(121): n is a, c, g, or t
  misc_feature (134)..(134): n is a, c, g, or t
  misc_feature (137)..(137): n is a, c, g, or t
  misc_feature (142)..(142): n is a, c, g, or t
  misc_feature (146)..(146): n is a, c, g, or t
  misc_feature (153)..(153): n is a, c, g, or t
  misc_feature (166)..(167): n is a, c, g, or t
  misc_feature (179)..(179): n is a, c, g, or t
  misc_feature (200)..(200): n is a, c, g, or t
  misc_feature (223)..(224): n is a, c, g, or t
  misc_feature (242)..(242): n is a, c, g, or t
  misc_feature (256)..(257): n is a, c, g, or t
  misc_feature (271)..(272): n is a, c, g, or t
  misc_feature (279)..(279): n is a, c, g, or t
  misc_feature (281)..(281): n is a, c, g, or t
  misc_feature (288)..(288): n is a, c, g, or t
  misc_feature (295)..(295): n is a, c, g, or t
  misc_feature (297)..(298): n is a, c, g, or t
  misc_feature (300)..(300): n is a, c, g, or t
  misc_feature (304)..(304): n is a, c, g, or t
  misc_feature (317)..(317): n is a, c, g, or t
  misc_feature (320)..(322): n is a, c, g, or t
  misc_feature (325)..(325): n is a, c, g, or t
  misc_feature (342)..(342): n is a, c, g, or t
  misc_feature (346)..(346): n is a, c, g, or t
  misc_feature (349)..(349): n is a, c, g, or t
  misc_feature (352)..(352): n is a, c, g, or t
  misc_feature (357)..(358): n is a, c, g, or t
  misc_feature (368)..(369): n is a, c, g, or t
  misc_feature (373)..(373): n is a, c, g, or t
  misc_feature (381)..(381): n is a, c, g, or t
  misc_feature (383)..(383): n is a, c, g, or t
  misc_feature (388)..(390): n is a, c, g, or t
  misc_feature (393)..(393): n is a, c, g, or t
  misc_feature (406)..(407): n is a, c, g, or t
  misc_feature (454)..(455): n is a, c, g, or t
  misc_feature (459)..(459): n is a, c, g, or t
  misc_feature (496)..(496): n is a, c, g, or t
  misc_feature (512)..(512): n is a, c, g, or t
  misc_feature (530)..(530): n is a, c, g, or t
  misc_feature (535)..(535): n is a, c, g, or t
  misc_feature (560)..(560): n is a, c, g, or t
  misc_feature (584)..(584): n is a, c, g, or t
  misc_feature (591)..(591): n is a, c, g, or t
  misc_feature (603)..(603): n is a, c, g, or t
  misc_feature (606)..(606): n is a, c, g, or t
  misc_feature (618)..(618): n is a, c, g, or t
  misc_feature (621)..(621): n is a, c, g, or t
  misc_feature (634)..(634): n is a, c, g, or t
  misc_feature (636)..(636): n is a, c, g, or t
  misc_feature (638)..(638): n is a, c, g, or t
  misc_feature (646)..(646): n is a, c, g, or t
  misc_feature (662)..(662): n is a, c, g, or t
  misc_feature (675)..(675): n is a, c, g, or t
  misc_feature (688)..(688): n is a, c, g, or t
  misc_feature (701)..(701): n is a, c, g, or t
  misc_feature (750)..(750): n is a, c, g, or t
gacaaaaaaattttacagtatccctctgggaagggtgtggggtggggtgtnctcattgtacatttnctagcngggagtcctcgagacagnccgtcnggcntgagaaagcccccacnanaanaagggaaagaaancgncagtngaantaggccnggggggggggganntgagaaatccanaaagcaaacgccccgccgcanatgggtaaaagagatagggagcnngaagatgaaaaagggggngtggggggggtggnnaaaaataaaaacanngggccangncggactngggtttngnnangttnggtggggggtctngtnnnggntaaaggggggggtaatngctnggngcntgggnngaatgggggnngggngggggggntntgggnnnggngggaagaaagaanncgcgggctggggggtggggcggaatacgtgtggggagggactcgganngggnacaccggaacactcaggggtgaagggacagaaagggnacagtaaggcaggggntcagggagtggctcccgnaaggnggtggggtcaagggggggcggtggngaggggtgagtcgcgagatggggncgcgggnagataggcgtgnggngctgggcggggnacnggggcatggaatngngntgggcgantggggggcctcgcaanctcgcacgacgtnctcccgcccccancgaagcccatcancaaaacaggggcgcccaaagttgtggggcggggaaagcaaaagcgggtnccgcttccccaacgtggggca

SEQ ID NO: 692627 - DNA, 144 bp, Homo sapiens
aacagatactgccgaatctttcgtgctagaggagggccaaaacaactctaaagtacatcatcttggctgcacttttatatagaacctgcactctctgaagacctggtgctgtcataatggcaatccacactggacatagcaccg

SEQ ID NO: 692628 - DNA, 270 bp, Homo sapiens
tagggcgttccacgtacgtcgcgctccacgttcaccaccgacgcttcgagctgatccctaatcgcggactcagatgccagggtatcggaccatatagcgccgggttcctccggtggcgattacggccttggcgacaatatcgctggaatttcgtcatagctcattccctttttcgtacttctcgcgcatgcgcagggccgccgcctgcctcacgcgcgcggcgacgggattcaacgtgtggaagtacacgtcctgccccacccacaaggc

SEQ ID NO: 692629 - DNA, 156 bp, Homo sapiens
  misc_feature (121)..(121): n is a, c, g, or t
tttgttttgaatcatgcatatcattgaaattctcgtttcatttctagatgactctgtctgagacagaaatttctactacagcagtgcagtccagaggttaagatgtattagagttatacantatcagtttaaaaatctgtatgcataaggatgcac

SEQ ID NO: 692630 - DNA, 124 bp, Homo sapiens
cttcaaatgctaatcattccccccttgataattgggacccatatggcataggtaccgaagtaaactagtgcgaaagtagtggttcaggtaattgctgttagaaaatcccccgaagtcctccaat

SEQ ID NO: 692631 - DNA, 452 bp, Homo sapiens
  misc_feature (49)..(49): n is a, c, g, or t
  misc_feature (55)..(55): n is a, c, g, or t
caggaggtctcgtcctggataaatgtgtcgtagaggaggagctggatgnaatgtntccgtagaggagtagctggatgaaatgtatcctgtagaggaggagctggatggaatgtatcctgtagaggaggagctggatggaatgtgtctgcagaggaggagctggatggaatgtgtctgtagaggaggagctggatggaatgtgtctgtagaggaggagctggatggaatgtgtctgtagaggaggagctggatggaatgtgtctgtagaggaggagctggatggaatgtgtctgtagaggaggagctggatggaatgtgtctgtagaggaggagctggatggaatgtgcctgtagaggaggagctggatggaatgtgtctgtagaggaggagctggatggaatgtgtctgtagaggaggagctggatgaaatgtgtctgtagaggaggagtcg

SEQ ID NO: 692632 - DNA, 120 bp, Homo sapiens
agaagcagtcaaattgtccggatcatttgttttccttgtattcttttgattttgtacattactgaaatgttgactagagaatatctgtggttaccaacaaggagcagtttatgtattttt

SEQ ID NO: 692633 - DNA, 290 bp, Homo sapiens
agtgctacctccacaaacagtgtatagccagtggaatgtgtctgtagaggaggagctggatggaatgtgtctgtagaggaggagctggatggaatgtgtctgtagaggaggagctggatggaatgtgtctgtagaggaggagctggatggaatgtgtctgtagaggaggagctggatggaatgtgcctgtagaggaggagctggatggaatgtgtctgtagaggaggagctggatggaatgtgtctgtagaggaggagctggatgaaatgtgtctgtagaggaggagtcg

SEQ ID NO: 692634 - DNA, 512 bp, Homo sapiens
  misc_feature (61)..(61): n is a, c, g, or t
  misc_feature (72)..(72): n is a, c, g, or t
  misc_feature (128)..(128): n is a, c, g, or t
  misc_feature (130)..(130): n is a, c, g, or t
gttggtcccctgcaggcattgcgtcatttgatcacatcaccctcaggcccggccttaaggngtctgtcctgntcatccccttgctcatgggcaagaagtctgcagggcagagggaaatgctcacccanangttgcgctcttccttctctagaatcccctgcccagatggtttgtccatccagtgcactcgctcccaggcaggccatgccgcccaacgcaccctgagatgcgagatgcagcaaagcagtggctctgcagaacttcgggtagagtttggatgggtgcgtggaggtttccacacatgtgtgcagatcccttggaaagcaggatagagccagaaacagagaggagggtgcccgtaggccggtgggggctggctcccatggtcacatgcaagagtgaagcttcatggagaccatgattctaaactcacacctggcctcacaggtggtaatgtcactgttcttctgaaggaaggaggaaataaatattgacaagtttgctagattgta

SEQ ID NO: 692635 - DNA, 398 bp, Homo sapiens
agtgctacctccacaaacagtgtatagccagtggaatgtgtctgtagaggaggagctggatggaatgtgtctgtagaggaggagctggatggaatgtgtctgtagaggaggagctggatggaatgtgtctgtagaggaggagctggatggaatgtgtctgtagaggaggagctggatggaatgtgcctgtagaggaggagctggatggaatgtgtctgtagaggaggagctggcggacagtgaagtgccggccaggcctggtggtggtggtgaggtccggcggccagagggcaggtctgagaagctgatgctctggcgaaggcacaaggagggtggcccgtggccgccaggtctatcgctagggttgtggataaagtggcagcgaagaagcggtaggg

SEQ ID NO: 692636 - DNA, 121 bp, Homo sapiens
cctttcaggcttctgggagcctggtctgttggggtccatcttggtcatctatccttttcttccagtgaagtgttagacggttagcgacttgaaggactagtattgcctgatggagccagtc

SEQ ID NO: 692637 - DNA, 493 bp, Homo sapiens
  misc_feature (13)..(13): n is a, c, g, or t
  misc_feature (64)..(64): n is a, c, g, or t
  misc_feature (69)..(69): n is a, c, g, or t
  misc_feature (71)..(73): n is a, c, g, or t
  misc_feature (128)..(130): n is a, c, g, or t
  misc_feature (143)..(143): n is a, c, g, or t
  misc_feature (147)..(147): n is a, c, g, or t
  misc_feature (171)..(171): n is a, c, g, or t
  misc_feature (208)..(208): n is a, c, g, or t
  misc_feature (240)..(240): n is a, c, g, or t
  misc_feature (259)..(259): n is a, c, g, or t
  misc_feature (261)..(261): n is a, c, g, or t
  misc_feature (282)..(282): n is a, c, g, or t
  misc_feature (318)..(318): n is a, c, g, or t
  misc_feature (361)..(361): n is a, c, g, or t
  misc_feature (388)..(388): n is a, c, g, or t
  misc_feature (403)..(403): n is a, c, g, or t
  misc_feature (426)..(426): n is a, c, g, or t
  misc_feature (442)..(442): n is a, c, g, or t
actcttccttatntagaaaccagaatatcttgctaaagaagaaagcagaaatcacatgggtttnggggnannnagggggtaatagaaactgttccgctggctggggctctctctcttggggtgcagtnnnggagggggcagantctnttaagcctcatatactctgcaggntggggctggtggcaaaggcaggctgggggtgctggantaaaagcctgcggttctggaaggaagcgtctnccaccttttacggggcatngngggatcctaggagaccccaanatgatcgcagttcagataggcccaagctggatttancgcagctggaatgggtggtcacccaattagcctcgcagctganggacctctgccaccagggctaaaggtnaggctgcgggcagancctaacctgaggtgggggctganagggtctctgcggctnagcctggccgggcattgggggctcgctctctggacctagcgggcctgatgt

SEQ ID NO: 692638 - DNA, 536 bp, Homo sapiens
  misc_feature (276)..(276): n is a, c, g, or t
tgcagaaggcgttagcccttgatccagcagggtcaggcgttcgaagttcgaggcgcgatcttgtgcagctcctcgaccatctccggcacctggtgacctttgaccaccttctcttccaggcggtcgaacaggcggtagcgctgtgggtcacgcatgcggaaactcgaaagtaagcgcgggacagggcttccttgtctttgtcgacatccgccgagtgcagcaactcgttcaaatcaagctcgtagtcgagcatcaggcgcaggtagatttcggccnttggacttgaagtgtttgtagatcgtgcctttgccgatacccacggcatccgcaatcatctcgacggtgacgctgtcttcaccttgttcgaggaacaggcttgagcgcggtgtcgagaatttcctgctcacggcggcgaaattcacggaccttacgggggttctttgtgcatgaggaaaagtctgcaaaggtcggaaaatagggagggttgcgcagggccatggatacgtggggttacgatttacccctaaacgcctctg

SEQ ID NO: 692639 - DNA, 178 bp, Homo sapiens
attggggggggggggggggggaaattttttaaaaaaatggggccctttttccaaaaaaaattttttggccctttgggtttttttttttaaaaaaaggggaaacggggtttttttttaagaaaaaaggggcccaaagtttttttggccccaagggttaaaaaaaaagggggttccccca

SEQ ID NO: 692640 - DNA, 462 bp, Homo sapiens
  misc_feature (114)..(114): n is a, c, g, or t
  misc_feature (204)..(204): n is a, c, g, or t
  misc_feature (218)..(218): n is a, c, g, or t
  misc_feature (280)..(280): n is a, c, g, or t
  misc_feature (304)..(304): n is a, c, g, or t
  misc_feature (350)..(350): n is a, c, g, or t
  misc_feature (357)..(357): n is a, c, g, or t
  misc_feature (359)..(359): n is a, c, g, or t
  misc_feature (363)..(363): n is a, c, g, or t
  misc_feature (403)..(403): n is a, c, g, or t
  misc_feature (454)..(454): n is a, c, g, or t
ggctgccggaaaacagggcagacctgtatgattggtttattcctggggttgtcatatcatggctgataatgacacagacagaaaccagactgagaagctcctaaaaagagtacnagaactggagcaagaggtgcaaagacttaaaaaggaacaggccaaaaataaggaggactcaaacattagagaaaattcatcaggagctgnactaagcgtgcatntgatttcagtgctcatggccgaagacacgtagcccctaagaatagcctatatggctgggganccaggctttgctagcaggaaaccnagatataccattgaagagaaactgtttgaagctctaccaagactcnctagtangnagcnggcatccactataccatgtgggagaaccgataaggagtantgcctttggcaggtgactacttgacttccttcagttcaagggcggatcccnggcttttt

SEQ ID NO: 692641 - DNA, 184 bp, Homo sapiens
atgacaggtggacaggaggtcaggcgtacggggggaccaacaggaccagcatcaccagtgcgaccgcgaggaccaggcggcccaatggggccacggagaccgttgagtccatccttgccaggagcaccagcacgaattcccttagcaccagcacgaatcccttagcaccagcacgaattccctt

SEQ ID NO: 692642 - DNA, 237 bp, Homo sapiens
cggcctccccgaccaccctggtgatgactgtgccagctaccggcatctacttacactgcctatgaccaactgaaggccttcctgtgtgcgtcaaccctgactctgactcctacgcacccatggtggctggcgcgctggccgcctgggcaccgagacctgtcatcagccccctggagcttatgcggacaaacctcgagctcaccattctcgacccggaccgctcccctgtccaacgcc

SEQ ID NO: 692643 - DNA, 1074 bp, Homo sapiens
ggtgtgtagacacttcaagagtttgagaacgctactgtaaagagaccccccgcccttctgtccctgaaatattcgaccatattcaagatgtccaaactccaagtatttcttatctagcctatcagggtgctggctttgtgcataatcatttctcagattcagatgcaaaaatgttccagacctgtgtgccccagccatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgaaacaaacacaacaaaccacagaaaaacaacaacaaaacaaaaaagacaac

SEQ ID NO: 692644 - DNA, 112 bp, Homo sapiens
taccactagtcacggttggtatccaggcccaagacctcccaggacaggcgactgtgagctgggcagagaggagtgaagtcaggtgggggttctggcttgctgacaccagcgt

SEQ ID NO: 692645 - DNA, 848 bp, Homo sapiens
catggtggcttactcctgtaatcccagcactttgggaggccgaggcaggtggatcacttgaggtcaggagttcgagaccaacctggccaacatggtgaaaccccatctctactaaaaatacaaaaattagctgggcgtggtggtgtgtgcctgtaatctcacgctactcaggaggcggtaggcaggagaatcacttgaacccggtaggcggagagttgcacgtgagctgagactgtgccactgacgcgtccagcctgggccaacaaagtgagactccatcaaagaaagaaagacccgaccagagagagagacgcaaagagagacagagagaacgagagaaagcgagaaagcgagagagagcaacgagcagcgacgagagagacgagagctacgagacgacagagagcagagacgcagagacgcagacgagcgacgcagagagcagcagagagcagcgagcagacgagacacgagagagagaggagagagcgaccgagcgaccgaccgacgagcaccgaacgaggacgcgcaagtcgaataccgctgagttgtcctcttcaggtgctctttgtcagatgcctcagcatgatgatcgcagcatcacggtggcgcggagaaaagaaatggaagataaagggaagggacgacagagagagaaggacaaaacaatacagcaaaatgattaagtaaagatgagagcgcaacacaaatcaaacatacgactacagttatcttctattagtttcaccaacttcacccccacacaaactccatatcatcttcctcttcctttcatactcttaatctttagttgcatagtatcgataaaatataacacagagacagac

SEQ ID NO: 692646 - DNA, 382 bp, Homo sapiens
cgaccaaacccatgaggaaaaaaagcttaatcttgacttgatggggaatgcctgtaatctcagctctcagaaattgaaggcaggaggattagacggtcaaggtacatcgttagtttgaggccagcctgggagagacctatctcaaaaaccaaaccatacaaacaaacaaacaaacaaaaccaatgaaagtcccagagccctgttgtaggacgtgattgtcttctcccatcaattgtagcaacaattcataccacacattagtcagcttgttcttgtcttccatctaacggtgtggttcctcaattttttgagctattatagagatcaaaacaaatggtgacacagtcaagctctgtaagcataatgtgacaaccgtcgacgc

SEQ ID NO: 692647 - DNA, 477 bp, Homo sapiens
ccgtcgccgggggcagtccgccgtagggattcggctaactagagcccgaggtcggcacccctgagctggggccgaacgggggtccagggctgatgcggggtgggggagagcgttgcattaaatgcgatgagtgggtttggggggaggctgcggagacaaaagcagcaggtggggtagccggggagcaggggctcccttaccacccaggtgccaagggggaatcctggaagtgtcccgaagccttctttaatgaaaatctaggggactggaggctggttttactttccctttacttttggggggcgaggttgcaactgtgatgctttgtgggcaaacctaacttacggataggccgggggtctcaattctccctccaggggattgcctctggggctcccggctgccctgcgggattccccgaaggagccgcgccggggccagggaggggcgcgatttcctctcccaactcgccccctc

SEQ ID NO: 692648 - DNA, 421 bp, Homo sapiens
  misc_feature (12)..(12): n is a, c, g, or t
  misc_feature (70)..(70): n is a, c, g, or t
ggaacaaacccngatgtgaaggggttccaaccccacccacaccctcacctggggtgtgtaaagtgggtgnagtggaaaagcaataagccctgttgtccttgagaaagggatggggttgcacccacctaccccattaaggtatcaggttaccctctagggaatgggagtgagttcttgtaatattcttgccccatttgtaagattgttttgaaagctattacagagctgcaattctgtaagaatatgaagtagcattaaaacttaagtttcttgagtcttatgtaagaatttaaagatgtacatatgttttattagaggggcctctctttagtttttctcaaccttcaggtttttggtaaaattttcctctcctcccctccccaccagaatacaggggacacatctaaaaatggattgattg

SEQ ID NO: 692649 - DNA, 521 bp, Homo sapiens
ccggatctgatcactggcatttatatgtccagagagaccatgcttatttagcatagggcaaggcatgtcattcagagactatatcacatgtatctaacctcctctgaaatttgcctcttggtcattttactgaccctttgagattagaccatttgttatgaatgaagagataaaggtcagcgcttcagtcaaatttggcatccttgtgaaaaggtcgggcatccatgggattcatgtggacaagcgttggagccatttggccacaaattttatcttctgaataatcttgtgaatatctggttacaataaactcttgttgtttgctccagttggagaggagccacagctcaaaagaagatatctcaaaggaattagtaatcaattcctctcttcctttagggcaggaatctgcttccagcaaacgcaaaataagccatgctagaatcctgctgttctccccaactggctaggttgaggtcatggagttgactggggagtcgctctaaactgatgagtagaga

SEQ ID NO: 692650 - DNA, 108 bp, Homo sapiens
  misc_feature (15)..(15): n is a, c, g, or t
caggcgtgcgacttncatctggccctgtacgcacatttttaaaaataaactctaaaaaagagacagttgaaactaatgttaataacattttatttaaccacatatatc

SEQ ID NO: 692651 - DNA, 319 bp, Homo sapiens
tcgagtctgtaggaggccttgtgtgcgtgcgtgtgtgtgtcccttctcgtttccctgaagccttgagtgcgtgtgtgagagtccctcttcgcctactctgacgccttgcgtgcgcgcgcgtgtacaacttttgtactcctaaaaccttgagagcgtgcgcgtgtgtgtacattctcgtgtccctaagacttgcgtgcgcgcgcgtgtcccttattgctttcctgaagcctagacagcgcgtgagtgtgtcccttttcatctgcctgaaaccttgcgcgcgcgtgcgtgtgaggccctatatcgactctatgatacacag

SEQ ID NO: 692652 - DNA, 117 bp, Homo sapiens
actttacgcaggcataggttggtcctagcctttctattagctcttcagtaagattacacatagcagcatccccgtgtccagtgagttcacccttctaaatcacccacgatccacaag

SEQ ID NO: 692653 - DNA, 920 bp, Homo sapiens
ggagttctctcgagctgcccggatacggtgaggaggacggctctgcatactcgcggacagacgcggtcgctccctcggcgattccctgtgaacgtgggctcgaggaaaactggatctacagggagatgctagagctagtgtgttattgatagctatggtggctagttgtgtttaatgatcgagtgaaaacggttcggtaaaatgtgtgccatgatgcagcaagaatagtcaattaaagagaaatcaaggcgtggtaatgtaatagtcatcaagtggagaaaaaataaggtggaatttgttgtcgtacagaaggcgaagagagatctgggtctggagatgttggatgtgacaccaataatgcgtgagtcgctgttccagaagacgaatcttagtgggggaaatttgacgtatctcttgacaatacatgaattgtgtcagtgtatgcttcaggttactttgattgtcaaagaccttattgtacaaactattataatgtacaatccaatatggtaagaacagacgtttgacagattggggaaccaggttggggtcacatggatggaaacttaagggcacctttctgtaggaaaggtaagaaaatgaatgcctattgggaatgcatgctattgggatggccacatgttaacaagagagagaacattccagagggagtaaaagagcatgatctgtttagaagacaaattggaccaaggaaagatcgtacaatggcggggcttcggttgttggcttgaagagttgtggtgggatcctggagatttgtaaagtgctatgtgaggtggattgcccgtgtggttggaggaattcaaggtgggcaaaacaatttgttgtgcttcacaatgttccaaatgtaaattactactggcggatgtagatgaggcaaatattatttagagaccagg

SEQ ID NO: 692654 - DNA, 113 bp, Homo sapiens
tcacaccacggcactccagcctgggtgacagagcaagaccccatctctaagaaaaacaaaataaaacaaaaaacttaactcttcttgctcctgagttagagcaaaaagcaaaa

SEQ ID NO: 692655 - DNA, 314 bp, Homo sapiens
ctaatagtagtaagctgactcctacccctcacaatcatggcaagccaacgccacttatccagtgaagcactatcacgaggaaaaagctctacctctctatagctaatcggcctacaagtctccttaattatgacatttcgcaggcacagaactaatcatattttatatcttcttcgaaaccacacttatccccaccgttggcttattcatcacccgtatgatggcagacgcagccaggaatcgtcctgaatcgcagggcgcattagcttcgctagttctagcactccgtagatgaggcgtcccttttcccccta

SEQ ID NO: 692656 - DNA, 610 bp, Homo sapiens
ccgcccgctctgcaactctgagcctcctattgagcaaagataagctcataggcaaccaaagagcactttgacctggaagaggttctgggcccactgggctcggacggcacgacgcgggcctgaccagcgccccaggccccagagctgatgacgtgggatccccaaggaggtcgtaggctgtactctagccagcactctattacctcataactgctgttctcacgagaggctactgccagagaccaggcaggagctccctggagccacaggtcatccgcttccatctcttatctcttcattaattgagatggaatgtaccctattctagcccaaggctgaagtgcaagtggcatgacctcaactagcatcctcttggactcacgagagtccaacgacaacaattcctccacccctcagaactcctgagctacccgcgatccccaggccgtatgccaccatcatctacggctaaatcttgtaagagaccacgatatcgaccaagttggccagaggtggctctcggactcttggactctcgtgctcccacgcagcccagctcccaaacgtgtcgggattcacagcgccatcccaccggcacttggacaggtac

SEQ ID NO: 692657 - DNA, 609 bp, Homo sapiens
ggcggtggagctctacaagaaaaaaaaaaaaaaaaattccggggtgtagtagcaggtgcctacagccccagctactcgggaggctggaggggacagaatcgttccagccagggaggccagtcaagggctgcagggagctatactggaactccagccggggactctatctcaaaaaaataaacaaaaaccacggcactctagccggggattacaccactgcactccagattacaccactgcactctagccggggactctatctcaaaaagataaacaaagacaaaacagattagagcaggcttggacaaactacaacccacaggccaaatccaactctctgtctgcttctataagtaaagtcctatgggaagacagccaccttcattggtttacagatgggctatggctgctttcacactacaaaagcagagatgagtcctggcagagaccatttagcctccaatgcctaaaatatttactaactggtcctttacagaaaaaatctgcaaaccctcaatagagctgtcgggttataatgcagaatttgtaaagaaattaggtgcaaattcaaaaggatccaatcatctgttaacatttatggatccttca

SEQ ID NO: 692658 - DNA, 362 bp, Homo sapiens
ggggtcagggaaattttgggtggtttgggtggttttcttaaaaaacaagttaaaccctgccgttttttccaggctgggtaagcatgtttccctgtgggcttgctttgggggtttgttaaataaatgtcatatgtaaatgttaaaataaatcgccagtgtttcagaattgaataactccagtgacttgatgttttaaaccagggtaggatttaaaaatagagggtttttaatcctggaaattgtgattgtgccccatgaggggaggaactttcagttttaaagttaataaagtgtgtacccaaaagagttcttttttttttgtaccccctgttttgagggcaaaataattagggtaaaaacca

SEQ ID NO: 692659 - DNA, 355 bp, Homo sapiens
cccagaagacagaaaagaccacagatgagaaagcagttcacgcagagaacaaaacattcccggaccaaacccagggtcgggttgctcattcccgaggcccgatagcgagatgcagatgaactggggaagaagagggattttatttctgtaactggttacagggagaaggcctggaaatgattgccagaccaactccagattacagtttttccagagcttacacaccttctaagctctgtgtctccgtgtcagtgtgcattcgtctaaagacgtacgtgattcaattcttctcatctctaactgaggtctggtcctgaagatcttcctctgaagactcagtaaatttacttaatct

SEQ ID NO: 692660 - DNA, 966 bp, Homo sapiens
  misc_feature (940)..(940): n is a, c, g, or t
tgactctcctatgaaggtaaaggctagccctctgcagtgccagtgactgtgatacatggttccagtcctgggggtgaatacggcacacagtgagttctctttcttcgcacttttgaatagttggcagcgtggctgcatccaagtgagcacaagaggccataattgtcgggaagagtaatgtgacatgattatccccatgactggcagatggaagaaatcctctttgcgcagggattcctgttaccggtgcgttcattatctgactggcgcgtgccgggatggggaggtctgaagtgcatagcgactgatgatctcatcctctgctacgtgctgtttgacagaccgcggtgcaggacggatgtcacaaatgattggcgctgttcgccagtacgtagctggttcagtggtgcacaagatgccaccgctcgttcagtgccaaaagaacgagtgtgtgtgtacacctagttcattgaactggtacatgttgaggccatggcgtttgccgccgggaatgaatgtgaagcccagaacgccgtaaacacggtgtacctacacggggtgctatgtagtgtggggattagtgccgcaacacgctggacatctcagggacatggtgttcataaggcactagagatgacagggattgcggctaagcggcccgcgatctgagttcgtggtacccaggtcatgtgccgggcgacggcagacccatggtgaacgagactggttcatgtaatcgcggacgagcaggtcgagcctgaggtgcaactgcgaaagggaactggggacggatgaggccccaggcgcggcaaccgggcacggaggactcactaggccggcgaccagcgaaggcaacgggcgcaacaagagaggggaggcaccgaagaaggacaaaccgagggaagaagaaaagagacgaacgcgggcaaagacacacagncagaacacgtgaatcgacatgagacc

SEQ ID NO: 692661 - DNA, 1051 bp, Homo sapiens
ggggaagtcaccgtcaggcctgagaactgagtagctgtactgtgtggcgccttattctatgcacttgttgggcagaatgtcacacctgccgatgaaactcctgcgtaagaagatcgagaagcggaactcaaattgcggcagcggaacctccagtttcagcgggtgctcaaatctgaccctatcggaaactcaaaatggacgatgctcatctgacagaaacaactgggaacgtcgacacggttcaacaaatcaacaacacaagcccatgtactgtgggcttatcagaaactcacacctggaggcatgtctcaagaaagcagtgggacaatactaacagagttaccaaagtctccccaggacaatccacgtgtattaaagcaaagtggagaacagcagcacatgcacgcacttcccacattccagacactccacaacacagacacacagacagacaaacaggacggaacaaacatggtgacactgacttgctgaagccctgcatacagcaacaagacaaggccaaaacacacctgggaaaagcaccacaagggagtaaccacctccctggcacggcacagcaacactgtggcccggcaggacctaccgtaactacgcacaacacggacaaacctcacagcggtgggaggcaagcaccccgcactcaactgtgcactgcacaccgcatcgacaacgcttcaccgttgtcccccctgcgtgccaccccggcggaaccagcccaaacgcgccacttaatcttagctagcaattaccataaccgactattgggtactacacccgtaaagagcaaacatccctggcgcaaacgcgcacgcaaacacctcctggcaaagggcaaataatacaaggaacactgtgcggtttcaacacacaccacactggaaccaggcaaaaaccacacgcaacaacaacatttatcaatcacccgacacctccagggcaaccaacacggacacctgcagaatccagacctgacgcagaaaccgcggaccaaggggtacagcaacgctcaaagattatcaagcacaagcca

SEQ ID NO: 692662 - DNA, 109 bp, Homo sapiens
ctggcttgtcctgctctggatggcaggagggcgccggggtcctctcgacgccagagataaatctcatcatctgtgcagctcttcttaaacgcaagactacagaccagag

SEQ ID NO: 692663 - DNA, 474 bp, Homo sapiens
  misc_feature (1)..(1): n is a, c, g, or t
ntgatattcatcgactgcacgcatatgtgtatacaatagtatggcaattagcgccgtaatcatggcattgtaactagcatgctaacacatgtttagtcagcatcgaatatctatgtcaaacgttaatcagtctcagtcataaccgctgtattcaatgacagcgtagtctagtaatctgtaacatttctgcatataatgcgtattaagtctgttactttgtatcatttgagtatcagaagcgtctaattcgaaatcctgtccagcaatcgacagtatagtgcatccgttgcaaacgtatgtcgagcatcgcacatgataatggctcccgtctctgtgtagttccataatcgagtctgtgacagcagcccaattctgggctgtacagtacaacattgtatgccagcacctgcgtatatgactctagatgtctaccctggtggcgaattcggcagctcgtaacgaattcggcacgag

SEQ ID NO: 692664 - DNA, 221 bp, Homo sapiens
attcattttatggtgctttttcaatctattttatacagaaataaaatatgtactagaaaaattcgcatacaactacatgggcttacaagccctctatatgtattatgtcagttatctgtagtgtgccattaggtccgaaatatgcttcatttagatcctacattcttttcctgtatttaatgagttattagccactttgctgcacatacacttataacata

SEQ ID NO: 692665 - DNA, 460 bp, Homo sapiens
agcagtagtagcaaatgaccaatcgaagtactactatctatggtaaaaaggacactggtcaagtcatctgagtgtagagaatgtcccttacactgctggacaaataccactggctcccaagaaaagaaaatggtctagaagcctctgttgtaggctctcacaactcatctttccctaagtcatcaagctccacatcactgaggtcaatgtcatcctccacgggaagctcgccatccctgccgtcccaaggctctctactacaccgatggtagggaaagccccgcctacctacaggtgccgtggagccacgcccaaaagagagctccctgagaaactcgttgatgccttgctcactgaaggagcctatatcgcagagcaaatatcatcttgcgtgcattgatggcggacatggcggagtacccaaaccctccactccccaacgcggtctcaagtacagact

SEQ ID NO: 692666 - DNA, 124 bp, Homo sapiens
  misc_feature (14)..(15): n is a, c, g, or t
  misc_feature (40)..(40): n is a, c, g, or t
  misc_feature (70)..(70): n is a, c, g, or t
ttagaggagcttanngatcctaacaggcagtgttgtcctnagccatcttcttaaccaccacaccgggggncaccatagaggatctggagctcagcctgtcggctggcagggtgcagaggtggag

SEQ ID NO: 692667 - DNA, 929 bp, Homo sapiens
atttctttggctgggccagccggttgtttattgtatgatctttgctgggagacctgataagatgtgctagagactcgagagctgattggattgaatgcttgaagtggggacttataatgtgagaacaattggtaaggatgtttgattgtcggagttcatcaagggagaaattaaattgagaccggttgcagtgggtcgactgggaacgttggccttcgaagtaatatactctcgacgcatgcaatcggcatctcaataatcgcgttgcgtaatgagttatattcattctaacgagtgtcattgtccggaatgtgacaacataaacaatacttacagatttcggtattttatcttttggtaatcagtgctgggcggtagcaaataaacacatagggaattatggcctccattttctacgtgtcatagagctcgccggaggattcactcctaaggttgggcacctctgtacaagtcatgggccctgtctatcagtggtgcaacaattgtttcaaagagaacgtagtccctcctatgttccaaatgctatatggcatattctcatacctcaatgaatcgtagggccttctaatgcaaattctctctatgctatagtccaataaatagcaagggtagtgacgaagggtggattatgacaatgggcgaagatgaccaaatagatcttaggcagtactccgtcaattgtagaccagaataatgggtggaattaatatgggcgggatgagactgtacaatggacttaatgattaacattgcttcaattttagcggatcatttggatccttaaatgaaaagcagatttcttaggtatcaagataaaaggcgcagaggcaaagagacatgttattttgttggacttgtaaaatgtgtggttgataaagaggaaattaatgggaccctttctaaaggga

SEQ ID NO: 692668 - DNA, 342 bp, Homo sapiens
  misc_feature (1)..(1): n is a, c, g, or t
nccacctcactgtaccagtccaatttgggcccatgtaccatacacaaggctcggtctaccttctcatggggccaaggaagctctgtccacgtggcttgggttcctgacttcaggtccagccaccacagccgcggtcttgccatgatatgaacccgagaagccccaggccatataaagccggcatccacagagtccggaatattccctataaggggtcccgccttccttctccaggcgcttggaatacgcgcttatatagggtatagcctccctttgtcagggacacatatacgtgggtgctgtgccccagatagagtttctcttcacaggaagagacagcct

SEQ ID NO: 692669 - DNA, 108 bp, Homo sapiens
aaacatatacctcccctactatgcaaatacccaacacctagagtaaggagcgtactgctatattagatacccatgggctatgcctaccctacatatagacatagtagc

SEQ ID NO: 692670 - DNA, 340 bp, Homo sapiens
  misc_feature (242)..(242): n is a, c, g, or t
  misc_feature (252)..(252): n is a, c, g, or t
  misc_feature (285)..(285): n is a, c, g, or t
  misc_feature (312)..(312): n is a, c, g, or t
  misc_feature (330)..(330): n is a, c, g, or t
tgttctttccatgttcttccttctttatatgccaaaatgccttcttttatcgtttcctttctgcctagagaacttcctttagccatttctttaaggtaggcttgctaggaacaaaatctccttgcttattactgaagaatatttttgctagctttaaaattctgggctgacagttattttctttcaggcacttaaaaaatattatcttgggctggggcgtgggtgggctccatgcctgttanttccaggcantttggaggagggccaacgcagggcaggattcanttggagggttcagggagtttcggagantagcccggggcccaacangggtaaaaac

SEQ ID NO: 692671 - DNA, 849 bp, Homo sapiens
taactcactctgacccttagtgctgtattcacagtagaccctggtttcacttttcatggttatagttatctatagacaaccaccacctgaaaataggaaaaaaaattatgtatatggatttggtactacctgaggtttcaggcatccactggtgggtcttggaatgtatcccctatggttaatgtgtgatgaatgactacaaaccaactgaacttgctactatagcaatgatggaatggcatcaggtgcagtagctcctctgggaatagtaaagcacttctttctcctgctgccctgtgaacaaggacgtgtttgcatccccttccaccatgattgtgagtttcctgaggccttcccagccatgtggaactgccagctgccctttcccttcagccatgagtggcagcagcccgcaggccctcaccagatgcctaatcttgaagactccagccagccagaacttggcacactgcacgactagaacgagtcacaatacgaaaccctacctgcataaacggacccggcaacacctgaaacggcagcccatcaccccagccaaagacatgccccgaaccgaggcgcccctgctcacatcacaccaacagccccacatcccaccaaacatgtaccaacctaacacaaggaaccacacacgcaacaaccacacggcccacgacacgaccgcacaacaacaaacccagcatgacccaaacaacaccctgcaaccctgcgcacacaacgcagcacaccaacgcgcaaaaaacacccgacagcaccagagcccacacaccacccccgccacacacacaccacaccccgcacccacgcaccacctggtgcccacacaca

SEQ ID NO: 692672 - DNA, 127 bp, Homo sapiens
ttaacgtgactgcggggtggctgggagctcagctgcccccccattgagaagatctgtcccgctggccacatgcagcgcagggtgctatattaccatgctgaaggcccgggaagtatgtacacggggt

SEQ ID NO: 692673 - DNA, 707 bp, Homo sapiens
gcagctcctgaccgcgagtgatccgccagcctcggcctccggaggtgccgggattgcagacggagtctcgttcactcagtgctcaatgttgcccaggctggagtgcagtgtcctgatctcggctggctgcaacctccacctcccagccgcccgccttggcctcccaaagtgccgagattacagcctctgcccggccgccaccccctctgggaagtgcggagtgtctctgcctggccgcccattgtctgggatgtgaggagcccctctgcaccggctgcccagtctgggaacgtgaggagcgcctcttcctggacgacatcccatctaggaagtgaggagtgtctctgacccggtccgcccatcatctgagatgctggggagcacctcagcgcccgaccgccccgtctgggatgtgaggagcgcctctgcccggccgagacccagtctgggaggtgaggagcgtctctgacccagccgacccagtctgagaagtgaggagcccctccgcactggcagccagaccacgactgacaagtgaggaagcccacgtccgaccgagcagccagaacacgatcacgacacaggagaggcaggaagagagatacagaacgccccgaacccgaaaacagaaccacggacctaaacccacaaaagagcagagaacaagacgaaacagaacaccccaccaggagcacaaaacgaaccag

SEQ ID NO: 692674 - DNA, 173 bp, Homo sapiens
tagaggatccccgtcactgacacactatgcacgatctgaaggattatgtggatatcggttcaagggaagtagagtagagagtatggagatgtcccatatatggctaactgtgtactatattcaaagtgaaagacactccgcatcagacgatgaatgaacaggaacgtagtttc

SEQ ID NO: 692675 - DNA, 381 bp, Homo sapiens
ataattgcccaatttttggccaattactgagtaacagcagttgtggtggtgggttaaatcagggaataaatatttgcaaagataaaactgtaaggagcccctcgtcgcaccatacagctcaaaacaatcacaaatatggtgggctcattgagcactttcctacgacatcatttattgttgtacatttgtatgattattggatgctttattacaatcatttgtatccattcattttctaaggcacttcttccagttcagggtcatcaagggtggctggaggctatcctggaagctcggggtgcaaggcggcaacccaccctggacaagacaccgtcccatcacagcacactcacccacacccacccaagaacagggtttgta

SEQ ID NO: 692676 - DNA, 226 bp, Homo sapiens
  misc_feature (68)..(68): n is a, c, g, or t
  misc_feature (82)..(82): n is a, c, g, or t
  misc_feature (100)..(100): n is a, c, g, or t
  misc_feature (177)..(177): n is a, c, g, or t
  misc_feature (219)..(219): n is a, c, g, or t
tttcaaacaatcacacctgcctgagaagggagtgggctgtcactgggatttttatccccagtccgtcnggatttttgtagangggcttcatgtgctggtnccaataggacaggaagattttaatcagcttttacttatcttatgtttttttatggaaactgtgtgtatgtaatacantacatttccaaaaagaaaaattaaactgattatagagattanaaaaaaa

SEQ ID NO: 692677 - DNA, 766 bp, Homo sapiens
tgagcctggagaagcacaagccccattcccatgagaattgtatggcagccgaggcctccatcggaggcagacgacctgatgaagagagtgggtttccaggtatgaggggcacctacaagtgtggtagaaccccctcacaagctcctgaggccgctgggcaccgtacttctccacaccctctcgtcacagcgggccatccactcctgtgacacagccgcctcgtacctccgagtcgtggaggagctctcgcggaccattgacctcaagctgaacattcacttggcccccgggtctcctggtcaccagggccagcccctcgatgcatgctagctacccgagcccaggcgtaccattcgtcagttgtcaagcactcgagaccatcttggcctctccagaccctgctctgagcacccaggaggcttgagtcacctcctccacgtcactaccagtccccaacatgaaggaaggagagagggacgccacattcggtctgtccctagagcttattggccaatggctctcactcactgagtgggtccaggtttgggagggagggactagggggaggaaaggggcgagcacccacgtgagagaatctgcctgtggccttgcccgccagcctcagtgccacttgacattccttgtcaccagcaacatctcgagcccctggatgtcccctgtcccaccaacttctgcactccatggccacctcagtgccacccgtaggcagccttctctgctaataagacaaggagacgcagcaagc

SEQ ID NO: 692678 - DNA, 1684 bp, Homo sapiens
  misc_feature (655)..(655): n is a, c, g, or t
  misc_feature (922)..(922): n is a, c, g, or t
  misc_feature (1683)..(1683): n is a, c, g, or t
agggaggctaagaggcgggaggatagcttgagcccaggagttcgagacctgcctggtgcaagtatagcgagaccccgttctccagaaaaaggaaaaaaaaaaaacaagaagacaaaaaaaaaaaattaagcgttaactttcccttcaaagcaacaacccccccccaccggttttagagagctaggcctcagccagtctttgccactcccattctcaggtgctttcctgaaagagcgcgtgttttgaggtgttgattgaacaacgcacattgcaatttattgccaaagcagttatttgacgcagaattaattatattctcttttcttttctcttattggcgttaacaattcattgaattcccggccagggatcacgggggcgctccacaccctttgttcattccacaggcaccttttggcgagaggcgccaaggagcggcgcggcgattatacctttagattacctctaaggggtcaggagacgtctcagaagaccacagccttggtgcccacattacttggtagaacaccttcggtcactctataacccgaaaaaataacacaacacaaccaaacaccacaacaacagaggggcgacgagagcgcgcgctctctaatagagaagtatcatctcccctctagggagggggcgcgcncccacagaggctattaccgcgcggtacacccccacaggcttatcttcgctgcgggtcccacaaacgctggggacccccaaaataaggacagcagccgcggctatataaaaagcccgcctaagaagcgcaccagtagcgcgcccgcacgctggttgatatacacaacaccaccacgcctacgatacgaactcggtgggggccaacaacaccagcgctgaccacaccgacttgcgagggccacacccactgtcggagcggaacacgagngcgagagacaccacctatacacacctccccgcaacgggagggcgagggacagacaccaactataattagtgtgcagccacaaacgatcatacccactatcaacacgagagactattcaacacaagcgccctctcaataagggcgacacacctactttatactacaacctatgtcataccacgcggtggtctatacacgagcgtggtgtctcacaaaccacaaacgcgcgtcgcaaaatttcctgctgtgcccgcagcgttctaacaaacaaacattttgcggcccaacgaggcaacgcacattcgcactctcctgacaccaccacatttttattcccgacggagtcactcaccacactaagattcactcagcaccagcatacgcaacaacatcactcattacaggactcaccactcactcatactatcacaccacccatcatcagtcaagccgcactacgcacagcgaggtcaacaacagactaacaacacagagagcaagtagacagcagagagcacgacagcaagcaaacagagaaccagacagacaaatcaacccccaacaccaacaaccacgacacacaccaccaccccaccaacacaccacacacgcacacacacacagagcgagacaccacagaccacagacacacaagtaacgaagactacagaccgcacgaaacacagagacagcacacacgcaaacaacgtagcggcagtccacacagcacgaacccaaaccatcgagcccagacgcagccnc

SEQ ID NO: 692679 - DNA, 115 bp, Homo sapiens
atgctacgcggcatggcacgtgagctccggaatagatgtcttcatcacttcttccacagtggtgtgacacggttggccgttacctatttcctcagatccacagtcttcgcctgat

SEQ ID NO: 692680 - DNA, 183 bp, Homo sapiens
tcaaatttgacaaaaaaaaaaaaaaatgggtgtgtttggcccaaagggcttggtggtaatggacctccccgttccctcaagttttggagggctgaagtgttgaacaaaactttgttcaggctgttttaatctcagaatggccccttcctttcactttcacatttaatttaattccggttgtca

SEQ ID NO: 692681 - DNA, 170 bp, Homo sapiens
caatctactataatcactgcgcccgctcataaggggatggccatggctagtgtttatagatgttgggtggttggtgtacatgagtgagcgcaggagtccgaggaggttagttgtggcaataaaaatgattacggatactagtataagagatcaggttcgtccaaccaata

SEQ ID NO: 692682 - DNA, 262 bp, Homo sapiens
cccactattgcgttgtcgaagatttacaaaaattttgcattacataatttacactaaagcaagtgctatcacctcccctggtttggacttggaagagcgcctgcggcattctccttagagagaagtggggtggcttttaggatggcaagggacttcctgtaacaacgcatctcatatttggaatgactattaaaaaacaacaatgtgcaatcaaagtcctcggccacattgtgaactttgggggatgctcgctccaaccgac

SEQ ID NO: 692683 - DNA, 3351 bp, Homo sapiens
ctcatatttcataaaatatgaacttttcccggcccacatccctaggccttcctgatgcgcttgcctgctccctggtctctctgcatggggaaggagtgttcccagcttgcaaactccagctttgcctgtgagaggaacaagcgtccctgatccagaaggtgttcagatggagatggcgagttctgctggctcctggctctctggctgcctcatccctctcgtcttcctccggctgtctgtgcatgtgtcaggccacgcaggggatgccggcaagttccacgtggccctactagggggcacagccgagctgctctgccctctctccctctggcccgggacggtacccaaggaggtgaggtggctgcggtccccattcccgcagcgttcccaggctgttcacatattccgggatgggaaggaccaggatgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcagccccatctgtggggagtctctccccctcagcagtggctctggctgtgatcctgcctgtcctggtacttctcatcatggtgtgcctttgccttatctggaagcaaagaagagcaaaagaaaagcttctctatgaacatgtgacggaggtggacaatcttctttcagaccatgctaaagaaaaaggaaaactccataaagctgtcaagaaactccggagtgaactgaagttgaaaagagctgcagcaaactcaggctggagaagagcccggttgcattttgtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatgataactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgactatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaagtttggtatttgtgtttt

SEQ ID NO: 692684 - DNA, 746 bp, Homo sapiens
  misc_feature (746)..(746): n is a, c, g, or t
aggcaagatggcggcaaccaagaggaaacggcgtggaggcttgcagtcaggcgaagaagccaaaaagaaacgaaatagatgcggagccgcagctaagcggcacgccacagcagaggaggtgaaggaagaagagagggacggatcccaggccccgtttgcaagggaatgtggcaaatttaaggaacggattctcatcttttcttccagaggaataaattttagaacaagacatttaatgcaggactttgagaatgtgatgcctcattctaaagcagatactaaaatggatcgtaggataagctatggtgataacgaggtgggtgaaatgaagaacgtgtaataaatgcatctatttggaagctaagaaaaaaaggatctctatatgtggtttcaaattcacctcagcggaccattgtgtaaattcctgtgttcaaaatattcataccctcgctgaactgaagatgactgaaactgttctgaaaggttctccggccctttgagtctttggaccctgctttgtgatgaattaccacattatgcttgtgttaaaaagaactcttaaattccaggatcttttaggtacacccacggtatcatcccaaaaaaggcaaccattgtgtggacctccggtgtttaactttcacccatttgtggtctatcgcgatatggctcgggagcttttcagatccttagaaagaaaatgctgggtctgtagaaaataggaccccggtttgtcttaaaatttn

SEQ ID NO: 692685 - DNA, 602 bp, Homo sapiens
  misc_feature (25)..(25): n is a, c, g, or t
  misc_feature (69)..(69): n is a, c, g, or t
  misc_feature (97)..(97): n is a, c, g, or t
  misc_feature (101)..(101): n is a, c, g, or t
  misc_feature (155)..(155): n is a, c, g, or t
  misc_feature (159)..(159): n is a, c, g, or t
  misc_feature (168)..(168): n is a, c, g, or t
  misc_feature (173)..(173): n is a, c, g, or t
  misc_feature (175)..(175): n is a, c, g, or t
  misc_feature (184)..(184): n is a, c, g, or t
  misc_feature (213)..(213): n is a, c, g, or t
  misc_feature (256)..(256): n is a, c, g, or t
  misc_feature (284)..(284): n is a, c, g, or t
  misc_feature (317)..(317): n is a, c, g, or t
  misc_feature (321)..(321): n is a, c, g, or t
  misc_feature (323)..(323): n is a, c, g, or t
  misc_feature (327)..(327): n is a, c, g, or t
  misc_feature (353)..(353): n is a, c, g, or t
  misc_feature (475)..(475): n is a, c, g, or t
  misc_feature (490)..(490): n is a, c, g, or t
  misc_feature (493)..(493): n is a, c, g, or t
  misc_feature (498)..(498): n is a, c, g, or t
  misc_feature (531)..(531): n is a, c, g, or t
  misc_feature (602)..(602): n is a, c, g, or t
gacaggcccggagcgagccccggangcctggctgatccgcggccgggcccgcacccggagcggcgggangggcggggagccgcggtcgcgccgggcncctnccaccccgccctcggcgcccccgcccctccaggaaggggaggaggcgaggggancccnccgcggagnccgancnaccccccancccaacctggcgactggggaccccggcanataaggtggacgcccccggggaaaacttgggtgcacagccaancgagaaggtcttgagtcaaacaaagcancaaccttggggaccctggaccactatcatgganactnanagcnagcaaaactccaattccaccaatggnaattctagctcagggggcagctctcggccccaaatagctcaaatgtcactatatgaacgacaagcagtgcaggctcttcaaacacttcaacggcacccaatgcagctcagtatttccaccanttcattctccaccancanctcantaattcccagctgcatacctggctgccgtccancaggccacaatttctgccaatcggcaggccagctccccaaacaccagcactacacagcagcagactaccan

SEQ ID NO: 692686 - DNA, 507 bp, Homo sapiens
  misc_feature (60)..(60): n is a, c, g, or t
  misc_feature (201)..(201): n is a, c, g, or t
  misc_feature (260)..(260): n is a, c, g, or t
  misc_feature (267)..(267): n is a, c, g, or t
  misc_feature (278)..(278): n is a, c, g, or t
  misc_feature (284)..(284): n is a, c, g, or t
  misc_feature (325)..(325): n is a, c, g, or t
  misc_feature (333)..(334): n is a, c, g, or t
ccgcaagctgcagaaggagcagcagcgctccaaagacctggagagccggcagcgatcccntaggagccaggccaaccgcagcctgcagctccgaaattcaaggaactagaactgcaggcccagatccatggcctgccagtgcctcccactccaggctgctttccttggccacgacttcggcttctgacagcctcaagccangagcagctggacattgaggaggagggcaggccaggcgcagcaacgttccatgtaggggnggggacnctgcccagaantgctcncccatcatgcaagcccgcctggcagcgcgccctcagatgcnccttcgtnnggacctgcactttcccgagcgaccacctgggggacctgggagaccccttccacctggggctggaggaccatctcgtggaatttggcaggaggaggagggggtggtgggaggactgtcggggggtgccctgtccccactgcgcggcttgcccatcccgaaaaatcccctgctct

SEQ ID NO: 692687 - DNA, 186 bp, Homo sapiens
tcaacgaagtccctgagtccagcagcatgctagcaacattccggagcaccagagtgtaagtgccgtcaaggagatcacccagccgtcgacgcttacactgctgtaccagtcacagaatggtgcccacctcctgaactttgatggagttggagaggttacttggaatcgtacccgcaatccgacggc

SEQ ID NO: 692688 - DNA, 5301 bp, Homo sapiens
  misc_feature (1691)..(1691): n is a, c, g, or t
taaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgctaacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttatacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaaatacttgtccaggcactcaagtgacttcatatttctctctgcccatgggaaaagagataggctttatatttccacagantgaaaaatcctctgtcatggagcctgtcctgccaagtggcaagaatgtggggactgtctggtgatgatgtctttcatggcatctgagtgaagaatgacaggttggctcaacttttttcttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgctgtctaattaggggccaagtctgtaaagttttgtcaaagtgagttagaagttgttttttcttactatttgtgtttaccagagttgggagataagatagtttccatgaaggtgtgtatgttttatacgatgtttgttatagggccatgcattggtaacttgaaaatagacagacagcttaatgtcttcaggatgtaatcagacagcttaatgtcttcagggatgtaaaactctgactacacggcgtctctttttcatacattgcatgtaagttgttagtacctcacaagctacagaagttcagccatgagattttgtttggcaacatgaacagatttgtgtataactgcaatggccttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagctttttttttttgctattgtaaatattagtggtttacaatgcgctttaaacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgatgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattttttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgttttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccacggtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttc

SEQ ID NO: 692689 - DNA, 5339 bp, Homo sapiens
  misc_feature (535)..(535): n is a, c, g, or t
  misc_feature (1729)..(1729): n is a, c, g, or t
taaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagggccaggaaaagctgcttataanactcacgggcacagaagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgctaacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttatacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaaatacttgtccaggcactcaagtgacttcatatttctctctgcccatgggaaaagagataggctttatatttccacagantgaaaaatcctctgtcatggagcctgtcctgccaagtggcaagaatgtggggactgtctggtgatgatgtctttcatggcatctgagtgaagaatgacaggttggctcaacttttttcttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgctgtctaattaggggccaagtctgtaaagttttgtcaaagtgagttagaagttgttttttcttactatttgtgtttaccagagttgggagataagatagtttccatgaaggtgtgtatgttttatacgatgtttgttatagggccatgcattggtaacttgaaaatagacagacagcttaatgtcttcaggatgtaatcagacagcttaatgtcttcagggatgtaaaactctgactacacggcgtctctttttcatacattgcatgtaagttgttagtacctcacaagctacagaagttcagccatgagattttgtttggcaacatgaacagatttgtgtataactgcaatggccttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagctttttttttttgctattgtaaatattagtggtttacaatgcgctttaaacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgatgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattttttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgttttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccacggtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttc

SEQ ID NO: 692690 - DNA, 203 bp, Homo sapiens
  misc_feature (125)..(125): n is a, c, g, or t
  misc_feature (151)..(151): n is a, c, g, or t
  misc_feature (162)..(162): n is a, c, g, or t
  misc_feature (181)..(181): n is a, c, g, or t
ggagagggcacgcgggacgaggagccctggggtcccatcggaagctcagagccttagtggctcccttcgagacgaatggccaggtacttcaacgcatgcactttgtgttgaccgtcatccctggncttcacctttggtttttcccatcctnagttctccccncttatgcctgaatatcctngtcgttttctgttgtttaatta

SEQ ID NO: 692691 - DNA, 706 bp, Homo sapiens
attctttctataaagaggccccctcatatgggcaaatttttttaaaaatggaaaatttccaccccctttaaaaaagtgatattttaaaaaccccatttttcttttttccccaaaatttaaaatatttttttaagggggccccttttaacccaaacccaacctggggaggtaaaatgtttttccacctgaaaggtaaagggtttcccttattttcccccaaaattttaacttaaaaaagggggggggtttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccacggtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttc

SEQ ID NO: 692692 - DNA, 273 bp, Homo sapiens
caggcgagcgccagctgcgcctccgcctctgagtactcaacgagatcttgctcaccgagagggactacgcgggcaccttgcgcttcttgcagtcggcattcctgcatcgcatccggcagaacgaggccgactcagtggagaagggcctcacggaggagaatgtcagggtcctgttctcgaacatccaacacatactggaagttcataaggattgcttggtcgccttggagtattgattacacccggagccgcagtctcagcatgaacttgggt

SEQ ID NO: 692693 - DNA, 5269 bp, Homo sapiens
  misc_feature (1691)..(1691): n is a, c, g, or t
taaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgctaacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttatacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaaatacttgtccaggcactcaagtgacttcatatttctctctgcccatgggaaaagagataggctttatatttccacagantgaaaaatcctctgtcatggagcctgtcctgccaagtggcaagaatgtggggactgtctggtgatgatgtctttcatggcatctgagtgaagaatgacaggttggctcaacttttttcttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgctgtctaattaggggccaagtctgtaaagttttgtcaaagtgagttagaagttgttttttcttactatttgtgtttaccagagttgggagataagatagtttccatgaaggtgtgtatgttttatacgatgtttgttatagggccatgcattggtaacttgaaaatagaccagcttaatgtcttcagggatgtaaaactctgactacacggcgtctctttttcatacattgcatgtaagttgttagtacctcacaagctacagaagttcagccatgagattttgtttggcaacatgaacagatttgtgtataactgcaatggccttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagctttttttttttgctattgtaaatattagtggtttacaatgcgctttaaacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgatgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattttttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgttttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccacggtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttc

SEQ ID NO: 692694 - DNA, 810 bp, Homo sapiens
ctttccagccctccccctacggtcagccaggtaccccatggcccagccctacccccaagggggctacccacagtgtccctacccccaatggggctacccacaggcccctaccccacaagagggctacccacagtgacccatacaccccaagggagcatacccacaggggccatatccaacagagcacatacacacacaaaaacgcaaattgggacaagcaacacgaggagaaacaccacgacaaggacccaagcaccacgcccaggcaatgaaaaaacaacaccaaggcagggagcagtcacccaatcctagccagtgaataacacaacgagcgaccattccacgtagcaagccccaaccctgagcacttagcaccataagggagcattccgaacacgagcccatacacttacccgcgcagagaggctgatcccacacgttgcgtagaacattgcgtacgctgtccgagatagacacctctctacaccagactagctcatggatcgacacaccggatggtgcgcacgcgagagtcaagagcccttttgtccccgccacaacactgtactgggactcgaacaaactgaatcacagcaccaccgactgagctaccacaacccctcgctcttcaatcagtccacacccactagtcgacggagtcacatacccgccgcgcatgcaccaccgatggaaaccctttgtctcaccattggcgaagccccttgacgcgcacacgcacagacaggaagattacgcaggaggattcccagcaagcgtcatagcaaaagcccccccccccacactgccccg

SEQ ID NO: 692695 - DNA, 346 bp, Homo sapiens
ttgttacccggcaatgacacaatgaataccacagaccagctctcagctgtgctgccaaagtattcataaccaaccagaccgatattacaaattaaatcataatatcgaatgacataccgttaagatatgacaatctgagcctctgagacagggggaacctatagtggtatcgagagcatgtttacatcaaaatgacctatcatactacaaggtttcactgccaaaaagtgtaacagagtttaaggcactggtaactttgtccactgttagagattaaaacttccaaagcaaatgaaagaaccaatgttcacctttaacgtggggaaagttggcaaaaagaacccca

SEQ ID NO: 692696 - DNA, 234 bp, Homo sapiens
  misc_feature (181)..(181): n is a, c, g, or t
  misc_feature (199)..(199): n is a, c, g, or t
taattctgttatattaacatgtttattctctctgttgcccgatttaacattctgtttttgcttttatgtgtgtttacatgaccttctaatttattttttgatggtttcttaactgtattttaattatatattaaaatattatctatatgttcagatatttaactgtattctaacattcttntttcttgatattttgagntgtttcagctagcttgtcagtactgtactgctact

SEQ ID NO: 692697 - DNA, 130 bp, Homo sapiens
tgtaccatgatgagagaacctgtctgtgtatagtgcacaggcccaatatgtgttgagggccaaggtgtacacatttgtgcttgagctgagcaaatgaattctttattcttaccgcctttgaccttttggg

SEQ ID NO: 692698 - DNA, 247 bp, Homo sapiens
ggtcgactttttatttggcttatccgtgatctaaatgctgtaatggaaaaataatagatcacttaagtttttgctgtgggtttcccgattggctgacccttattttttaatcaagcaccacctttatagccgtaacagcatagaaaactgagttcctgtgataagggaactttgcacaacgggatgaggatcatccggttaaaacaacaaagtgaggaaaaaaaaaaaagaagttttgcccgtcgac

SEQ ID NO: 692699 - DNA, 169 bp, Homo sapiens
aatacgccaatccttcaaccacaatgctgatcatcatacggtggtcagcatggacacggaaagtaagtagtaggataagtagtaagttctgttatcaagacacagctaatacaacttctcacttttctatacgttaaattttctggatttaaaaatatccaaaccatca

SEQ ID NO: 692700 - DNA, 186 bp, Homo sapiens
cgatctaaggatcccccacagtgccggggcttccaaaggcactcgcattctgttggagctgtcagcccagcacaggacgacatcttgtttgatgcggatgacgtgaaggggtggagcgcacccggatatggaagcatctttgcacaacttttaccatgtacttattgggacaaattcgggcagcct

SEQ ID NO: 692701 - DNA, 262 bp, Homo sapiens
ctcgaggccaatcgcgctgatggtgttctcggtgctgctggtgctgatcgtcgaactgctcaattccgcggtcgaagccaccgtcgatcgcatttcgctggagaaccacgcgctggccaagcgcgccaaggacatcggctcggccgccgtcatggtttctctgctcaacctgctcctggtgtgggcgctggtgctgatcgcccgattcctggatcggctgaaaggcgccgctccggctcctgtcgcgggcgcccccccccgg

SEQ ID NO: 692702 - DNA, 338 bp, Homo sapiens
tccagcatatgcacacatgcattctagtactttcacattacacctgtctcacacaccaagtcgcctctagtatacataccccactgccatgttaaatgtctgcaccattctttctcatctgtcacttacaaatacactctcttcatcacactgtattcttaaacacacctgtcgctttttaactactgcacctagctgtcttcgctccttgttacctctactctcccatcacgcagactctgcaaaggaaaccaaatacacttggactggcttctggggaaaagaactccaaagccagcttaccagggtgtcctgctgcaggtgctgcccaacccctg

SEQ ID NO: 692703 - DNA, 922 bp, Homo sapiens
  misc_feature (922)..(922): n is a, c, g, or t
ttttgcttcagccaatccaaaccatatactagagtgttctgtagtcacaattcttatttcaaatgtaattcagcaccttacataatttttgagaggttgtcattcatcacatatttactgagtttctatgtgccaggctctgtgactggatactggagctatcaaaatgaaaaaaatagtgttaagaactcactcgctggtgttagagcaggtagatgagtggcaatccatttaaatccatttgccttggctattatttggaatgccttcttgtttaaagctctatctacggtaggcgaagaattatctctggaggggctaccgggtataggcgggccttaattatctctctttctcttttcgctcgctaaagagggagtctcgcatcggtcctccaggcgggaggacgtgccggggcacgatctcagcttcatgggaacctcgcctcccagttcaagcgattcttctggctaagccctcctgagtagctgggactgcggtgcatgcaccaaaccagctaatctaacactcagagagacggaatttgccacgttgcccagcctgtttcgagctccggctcaagtgatcaggcctgcttcagcccccagagggcggcaattacgggcagagtcactgggcccagacggggggggttgggggacaaaggcgaggaaacagtcgccccgcgtcctgaaacgcggctgtgtggagaaaacacactcccccacaggcggtaacccggggagcggtataaagggctcacgagcaaacggtgggggcccaacacttaccgggtggagggtcacaagtttgaagaccccctcacgaacgcggcggtcggaaaaaaacggcacatgtcgcgacacacaaaagacggggacgagcgccacacaattctccccagaagatgcgaagcgcaacn

SEQ ID NO: 692704 - DNA, 995 bp, Homo sapiens
agcggcccggctaatttttgtatttttagtagagacggggtttcaccgtgttagccaagatggtctcgatctcctgaccttgtgatccgcccgcctcggcctaccaaagtgctgggattacaggcgtgagccaccgcgcccagccttctccgtgtatttttaacagctttagtttttgtgctgtctctgagtgcgtatttagtttatttagcgattcacagcgatttacattttccctctatggggttttcacttttaactcccgtgggaagggtgggttctcttaccatttactggtgttacccctataattctaactttggggtgggtagaaactattggtgaatcccctatttccctttttgggccctgtgtgtgctatcacactggtgtctcttacacaatgagcgtgatacttctccagggtgtccccggggaattcccttaggtgtgttctgagtccccctaaagactacttctctgtgtttctagtgcgtactaaaaagttttccttatttttggctttcttcaggtccattattcacctctgtgatcctttaccttgtgttttattatatagatcttcacttccataattctaaactataatatcttaattctatttttctagattttcttccacctattactggccttacaccctacagtcttatttcctggtgctcattataactaagcataaatttacaattctctaactggggacaaaacctggatactttaagtaatacaagcactgtataccacgggaagaccactgttcccattattaaccacatgaatagtgatattgccaagtgattaaaatttactcatgagaagtacacatgagagtagtaggccaaaacttaagcgatattacattaggaatacttatttattgcccttgggatctactggagagacacagatgaggcaggttatttcctcccgtattccctatttatgggccgccgagtaattttaataaagca

SEQ ID NO: 692705 - DNA, 320 bp, Homo sapiens
ctgggtagacaataaggaagggtccccaggattggggagagccccaagtcgagaacaataatgaacaattactgtatgaacaatcgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattgtcacaatttctctaataaatctgcccttctttacctacaactatcttggtaaatggctttaccacctgcaaaactgaccctagg

SEQ ID NO: 692706 - DNA, 299 bp, Homo sapiens
gttgctatgctgtctcatcatggaggtttacatcatatttttccacctctgattctgcttgatcgtagccaaagaaacttagcagcttgaggagcagttactcctcaataagcacatgtgaatctctgcagtagtgatcatccagatgcttgtagatgataggtcagtgcactctatactggggatacttcactgcgcttgactatgcacagctgggcccggtctcgatgaccatcattctcattgctcaggggagtcacatagagcatgaagggctgcgctgttaccaatatagctgc

SEQ ID NO: 692707 - DNA, 119 bp, Homo sapiens
  misc_feature (9)..(9): n is a, c, g, or t
  misc_feature (32)..(32): n is a, c, g, or t
  misc_feature (104)..(104): n is a, c, g, or t
cagtagcgnttggcccccagctcggcaagccngccgtccaaggacttggcgtacgcatgaaattctcgtacgcacggtcaccgatccccagcacggagtaccgnaccccgctcaggtcc

SEQ ID NO: 692708 - DNA, 112 bp, Homo sapiens
agagatatcgagctcggcacccctatctttaaaaaggaatttggaaggttgaattctagcttcaaaatattcaaatttttttgcatggatttagctacgcttttcaaaattt

SEQ ID NO: 692709 - DNA, 634 bp, Homo sapiens
ccgtgaaaatgcggcgcagcagacacacacgatcgcaaaaagccaacagtactccacaatctactcgttctcacaaccagcagcatcacaaccaacaagcgtcactacacccacgctactcccccttttcactcacctcacactcccattccctccacacctacggcgaatcggcaatgagagcgaaagtagcacggacacgcatatgagacgatgagtgatcatgacagtttgtgaaatacgctgacagacaggtcgagatacggtgcagacactagacgcgggtgatgatctcggcattagtagtgatgggttggcaattgagacttaacagcgagagcaagaactatagagaacggaacatatcacacacgacggccacatcctacatataccactcaataccatcacgccaccccgacattcaaatacacacacaacatacacctacaccatacatcccgacatcactaatcttcaaacacattcacactaccaccacctctcttatctacctcccctctcaccccatcctcctccaaccccacccaaccatcacaaccaccgataccatacactccaaccgcgccatcttcctctccgtcccgccacagctagcccacccacactacaa

SEQ ID NO: 692710 - DNA, 986 bp, Homo sapiens
  misc_feature (513)..(513): n is a, c, g, or t
  misc_feature (874)..(874): n is a, c, g, or t
  misc_feature (904)..(904): n is a, c, g, or t
  misc_feature (945)..(945): n is a, c, g, or t
agcgggcagtgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccacagctcaggcatgtcccatcccccaactgccgcagagaggacaagagcccatcagaggaatccagcnccacaagacgtccccagagtctgtgtcaggctctgttccctcttcaggtagcagcgggcgagaggaagacgcggcctccacgctagtgacgggctctgagtatgagacgatgctgaacaggagatcaatgtccatgggctatgagcgagacgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaacccctggagttcctgcgggaccagcccagttccagaacatgcggcaggtgattcanagaacctgcgctgctgccgccctgctccanagctgggccaggagaccctcagctttacagcaatcagcggnacaggagagtcatcagatgtgacgagccctgggagctggcg

SEQ ID NO: 692711 - DNA, 594 bp, Homo sapiens
  misc_feature (593)..(593): n is a, c, g, or t
aaatagagaaaaatgaacagtgggataaaaattcctttcccagtccctacttatcaacatgaaacatctgcttcagctacagtggttcccagtggcagtcagaattattgatatggcaaaatcgctgcttatatgcagcacaatggcatgtccccccacccctactggctgcattgtaataattcattactgtaccagtgcgaccaaagacaccatggatgtgaaaggggagttagtgccagggcaattgtgcaaatggtgagggtggtggaagaaagttttcaccacgagcaataaatttctgcctgctgttctattttattgtggctcgacacagtgattatactggttggaaaataagcaataagcgtctgtctgtctccagttgtttttaatattcttgtttaatgggagaacatagcttttatttaaactaaacataacggatgcattttaagatttggatcggtttttgaaaaaaaagtatcttgctatctcgtatgttaggtaagcatatgctgctataaataggaaaaccaatatgcctagttcagccttttggtagataaatttgattagggatgtgcaaagcng

SEQ ID NO: 692712 - DNA, 123 bp, Homo sapiens
tgggcgtgctcgacccatgcggtcccgggcgtgctgttgacgatgcaggcgagcacggcgagccccgttttatcgcgaaggtcgagcggtatggcgacgaaaccggatttgcgcttgcggccg

SEQ ID NO: 692713 - DNA, 174 bp, Homo sapiens
cggatctgccctgggtgcatgcatgtgtgtgatgccagcgtgccaaatgaagaaactgcatcagttatcaattaaaaggattttattataggagctgtttataatatccacagaggtgcggacagtgcttccccagaaattctagtcaatatttgtgttacagaagaactccca

SEQ ID NO: 692714 - DNA, 363 bp, Homo sapiens
gactaaaattagatcatgaaactagagtaaggacacccttctcacctcacccggatgtcatgccaccaattacaaataaataaaatgtgaccaattacttagcttcaagattctatacaaatatctctgaaatctgtaagccatcattacagctattctggattaatataatacattctaccctaaattacaccaaaggactataatattcagtgtattccaatgtttcagcacataaggaaagtttgtgcctgatatggaaggaaaaagaacactctggtaattacatagttacttcaggtctctttcaatctgacaaactgggttgtctggagaattgaacatagacaagcaatattatca

SEQ ID NO: 692715 - DNA, 408 bp, Homo sapiens
gcctatcatatagccaaacccagaccatgacccctaacaggggccctctgagccctactaaggacctgcggcctagccatgtgattgcacttacacttcataacgctgctcatactacgcctactaaccaacacactatccatataccaatgatggcgcgatgtcacacgagaaagcacataccaaggccaccacacaccacctgtccaaagaggccttcgacactggataatcctatttagtacctcagaagagtttgtcttcgcaggatattgctgagccttttaccactccaggctaacccctaccacgcaactagggggagcactggcccacaacaggcatcaccccgctagatgcactagaagtcccactgctcacattcgcattactagcatcaggagttct

SEQ ID NO: 692716 - DNA, 523 bp, Homo sapiens
gtctagagtatcccgagtgcacgtccactaacaggcagcggacatgcccgcagcatgggtgccaaaacggtcatcgccaatcactctgagatatgaaagatctgtcgcgcctcagcacctacagagacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagcccctactgcgagtacctgcgcccgcccatcgactgcttcaagaccatggactttgggaagttcgaacagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttctgtttgtggaggtagcacttgggtaccga

SEQ ID NO: 692717 - DNA, 212 bp, Homo sapiens
atcggccaacacactaattctctttcaaaataatgtaataaatataccattcatacacacacacttaggctaggatggtggctcatgcgtgtgatcccagcactttgggaggcgaggcaggcagaccacaaggtcaggagttcaagaccaacctggccactatggtaaaaccccgtctctattaaaaatacaaaattagccacgcatggtgt

SEQ ID NO: 692718 - DNA, 361 bp, Homo sapiens
ttagggtggtcagcggcgtcctgtacgactggttcggcgcgggtctctgatcatgcagcgtcacaatagtggcatgccagttcaggacgttctgcaggtgcaaaatgtagtcgatgccgtgttctagggtttctctcttgctcacattctgtgttctcctgaaagctgggcccatgctccttgagcttgaagtacgcagtcgttcatgttgtatagcaggctcatcggctggctccatacgtctctcacaggcctgatgcttttcatcctgatcgtgaggtacggctataccgagagtgatctgatcgccctggagctcagtctcactctcacgccatctgatcgagctgcgcttggcgcc

SEQ ID NO: 692719 - DNA, 119 bp, Homo sapiens
gattccaagtcccagggggtttattttttccttttaaatcctgttctgggttcctggtctttttgcccatgccaagagccgggcgttggcagggccatagggatagcgaaggtttgaaa

SEQ ID NO: 692720 - DNA, 921 bp, Homo sapiens
gcggaggcataagcagagaggatctggaaaggtctcttgttttcttatccacagagaaagaaagaaaaaaaatgtaactaatttgtaaacctctgtggtcaaaaaaaaaaaacacaaaaaaaggctgacggcagctgcggaggaaaacccttttttccctaaccatctgggttgcggggctttggttatgctgtaatccaaaaggctccggttaatcagagcattctggtagccaggaacataatctgagagccaagcccacattcagggtttgggaacagggcatgacgaatcccgtgtcagggatttcatagtagaaggggcctatacggggaaaggagccaaagaaatctcttctagggatatggtaagaaactaaagtgagatactccaccagaggggcacccgtggagcctttcccggcaaaagagggtggcgtgtgactatctagggaaactccgtagtgcaagaaagctaccgcgtaatcaacgggttgcgggcagtgaacaagagggcccgaggcccggtgggtaacccccaggaccttgaaagctcccgccttttatcactagaagaaatctctggcggctatcgcaaaaacgtgctgcagcaagagaacgccagaaagcccaaaagggaaccaagactaagttgattgtagtgcagaccaaagccaaaagccaaattaggtggactgtggacaggcgggaaaaacaaaccctccccagtttaaatcttagtgcgacacactttcctccaagagtagtggtgttcagaatccctgtgaagggacccttgttttccctagctattatccattaagaaaaccgtttgagatggtaattgcataaggggaacagccatctcccgagtcagtggccctcggccacggcatttaactccataaaccctgtgaaaaac

SEQ ID NO: 692721 - DNA, 515 bp, Homo sapiens
caagtttcccaactctgaagtgttggtcaagtccatcgtggactttgtgacgagccacgggaacatcaaggccttcatctccatccacagctactcccagctccttctctacccctatggctacacatcagaaccagctcctgacaaggaggagctggatcagctagcaaaatctgctgtgacagccttgacatctctacacgggaccaagttcaagtatggcagtatcattgatacgatctatcaagccagtgggagcactattgactggacctacagccagggcatcaagtattccttcacttttgagctgagggacactgggctcagaggtttcctgctgcctgcctcccagatcatccccacagcggaggagacatggctggcccttttgaccatcatggaccacactgtcaaacacccctactgaagaagcttttattcccttcccctttcttctccttagccccatttaggcaacccaataaagtctgattgtaaactaaaaaaaaaaa

SEQ ID NO: 692722 - DNA, 271 bp, Homo sapiens
tgaggagaccacgattaataaagaaagacagggaagtgtctcatgcgggagcctccatgtcatctgcttcatcagacactggaatgagtccctcatcatcgtctcccccagaaaaggtacttgcttgtaagaatgtaggtgatacacatttgctcgtaccttcccagaaggtgtgctgccatggacataaatccccaaaccctgaattacaaccacagaaagcactcaactggattgacattgctcagtatatcctgtatacttttccagg

SEQ ID NO: 692723 - DNA, 143 bp, Homo sapiens
tctagaggatcccttttcggctccattcaggacaaatgggaacagactgaacgagaaagacagatagacacacacacacacacacacacacacacacacacacacacacagacacacacaaagacacacacacagagagagag

SEQ ID NO: 692724 - DNA, 518 bp, Homo sapiens
ccgcgcgctcagcggcaaatcaacaggggggttttggagatcgggcacactgcggaccgctggggggtgtccctggatgtcaacccttcgccccggacgaacttacggtcaaaaccaaggatggggtggtggagatccccggcaagcacaaggagcggcaggacgagcatggttacatctcccggtgcttcacccggaaatacacgctgccccccggtgtggacccacccaagtttcctctcccctgtcccctaagggcacactgaccgggggggccccccttgcccaagttagccacgcagtccaaagagatccccatcccagtcccctttgagttgcgggcccagcttgggggcccaaaaactgcaaaatccgatgagactgcccccaagtaaagccttagcccggatgcccccccctgctgccgcccctgggtgggcctccccccccccctgggggttttttttaaacatttattttttgtttttttcaaaaaaagttcaaagcccccccctgta

SEQ ID NO: 692725 - DNA, 287 bp, Homo sapiens
tgtaatagctgcatctatctacaacaagtattttcagttatataagcagttaataatacccttgactcatagaccattatgatgtatcatgatattatatgcgaaaatgataatcaaaactgttgcctatacattcgtaagagttgtgtgccacctttgctgagggtattaaaattaatttccatttaccatgattatatactagtatcatagacagtgtggtcagcatctcagcatgtatctttataatcaggaatacgttttatgcttgtaatcgtttatgctgt

SEQ ID NO: 692726 - DNA, 90 bp, Homo sapiens
  misc_feature (34)..(34): n is a, c, g, or t
ctatcaactgaggcgattccgggtcaacttggtnattaacgagtccccactgctctaaaaaggcatggaccctcatccgcttatgcaatg

SEQ ID NO: 692727 - DNA, 646 bp, Homo sapiens
  misc_feature (613)..(613): n is a, c, g, or t
atactgcagctctctctgatgtcaggtaatgcggcaggcatatcgtgtgtgctgacctgagagctatggatgctgtgagcaggggctggtaggccaggatagacaaacttctgacctcgcccctcattctaaagtgtaattcccatgattttgcagtaacttacgtaccaacctctaagcccctttatggttgattcattcctaggtatattaaaaataattcaggttgacataatctatctctaattgcaagagttagagaggaaatttaaactactgctttagttgttgggcatatgggtctctagagacagggtgttaagcatcactgcatcaccactttgcatataggaagcactcaataaatgttagtaaggccgggcacggtggttcacggcctgtaaccccagcacttggggagagcgaggcagggtggatcacctgaggtcaggagttcgagaccagcctggccaaagtggtgaaagcctgtttttactaaaaatacagaaattagccaggcatggtggcgtgcacgtcatcccatctactcaggaaactgaggcaggagaatcacttgaccccaggaggctgaggtcgcagttgagccaggatncgtgcactgcactccaggctgggcaacaggacg

SEQ ID NO: 692728 - DNA, 244 bp, Homo sapiens
ttaaaggttttacccccttatcccaaaacgcccgaagaaaagggctccggacacccccttttttataggaaaggggcaggaaaaaggggtttataagacaggggggcttttttgggaaatgcgccccccccttttttgttttttataaaacctaaaattttgcccgtgagaaaaacccctaagaggcctaatattgaaagggagagttggttttcacttgggggcccttattttttggggggtt

SEQ ID NO: 692729 - DNA, 101 bp, Homo sapiens
ttagaattattgtttcaagttaaccatcttcataacagctgcatccacagacttcaactactatgattacttctttgcccattcttctctttcttttcttt

SEQ ID NO: 692730 - DNA, 239 bp, Homo sapiens
tggggatcaccaggtcccgtctttttcagtctcttgctaaagagccacagcgctagctctggctggccctcatgtgacttgggcggcagcctcctttcaaattcccacttaccccccaaatggctccattcctacccccagtgcctggaaaacctcctactgtcttttctgtcgcagcccccgaaggttttttttgtgtctctggttttcatcctcctgtaaatataaacacgtcagga

SEQ ID NO: 692731 - DNA, 337 bp, Homo sapiens
cccccgggcttttgcctggggcggggggggggttaccttttccccccgggaaccgctttggccctttggccttttttgggggcccttttgacccagtttggtccaaaaaggcgggcggggcccgggccggtattcccgggattttggcgccccccggggccccccccggggcccaggaatttttttggccgggtttttgggaatttggttttatggatggccccttttggccttttaggttccttttttccttttttcccttttgttgaggggggggggggtgggggttttttgggttttttttggtcccccggttttatttttccttaaactttga

SEQ ID NO: 692732 - DNA, 894 bp, Homo sapiens
  misc_feature (1)..(1): n is a, c, g, or t
  misc_feature (112)..(112): n is a, c, g, or t
  misc_feature (160)..(160): n is a, c, g, or t
  misc_feature (245)..(245): n is a, c, g, or t
  misc_feature (247)..(247): n is a, c, g, or t
  misc_feature (271)..(271): n is a, c, g, or t
  misc_feature (274)..(274): n is a, c, g, or t
  misc_feature (279)..(280): n is a, c, g, or t
  misc_feature (291)..(291): n is a, c, g, or t
  misc_feature (305)..(305): n is a, c, g, or t
  misc_feature (308)..(308): n is a, c, g, or t
  misc_feature (322)..(322): n is a, c, g, or t
  misc_feature (324)..(324): n is a, c, g, or t
  misc_feature (327)..(327): n is a, c, g, or t
  misc_feature (354)..(354): n is a, c, g, or t
  misc_feature (373)..(373): n is a, c, g, or t
  misc_feature (379)..(379): n is a, c, g, or t
  misc_feature (385)..(385): n is a, c, g, or t
  misc_feature (388)..(389): n is a, c, g, or t
  misc_feature (418)..(418): n is a, c, g, or t
  misc_feature (432)..(432): n is a, c, g, or t
  misc_feature (445)..(445): n is a, c, g, or t
  misc_feature (457)..(457): n is a, c, g, or t
  misc_feature (469)..(469): n is a, c, g, or t
  misc_feature (483)..(483): n is a, c, g, or t
  misc_feature (496)..(496): n is a, c, g, or t
  misc_feature (520)..(520): n is a, c, g, or t
  misc_feature (538)..(538): n is a, c, g, or t
  misc_feature (550)..(550): n is a, c, g, or t
  misc_feature (552)..(552): n is a, c, g, or t
  misc_feature (578)..(578): n is a, c, g, or t
  misc_feature (601)..(601): n is a, c, g, or t
  misc_feature (605)..(605): n is a, c, g, or t
  misc_feature (612)..(612): n is a, c, g, or t
  misc_feature (616)..(616): n is a, c, g, or t
  misc_feature (633)..(633): n is a, c, g, or t
  misc_feature (638)..(638): n is a, c, g, or t
  misc_feature (652)..(652): n is a, c, g, or t
  misc_feature (663)..(663): n is a, c, g, or t
  misc_feature (674)..(674): n is a, c, g, or t
  misc_feature (697)..(697): n is a, c, g, or t
  misc_feature (702)..(702): n is a, c, g, or t
  misc_feature (705)..(705): n is a, c, g, or t
  misc_feature (711)..(711): n is a, c, g, or t
  misc_feature (725)..(725): n is a, c, g, or t
  misc_feature (730)..(730): n is a, c, g, or t
  misc_feature (741)..(741): n is a, c, g, or t
  misc_feature (799)..(799): n is a, c, g, or t
  misc_feature (811)..(811): n is a, c, g, or t
  misc_feature (829)..(829): n is a, c, g, or t
  misc_feature (831)..(831): n is a, c, g, or t
  misc_feature (880)..(880): n is a, c, g, or t
naaattcaggcaggttcaatcacagaaaccatgcagtggacaaaagagagaaaaagttcaccatgaggagattctaaaaacctgccttttgacttgtctatttttatctctnatttctcactttgcttctcctcccgcttggaccctttgtctgactgtntgaaattaagtggcaggtgaaccctccattacccatgtccagaacaaatagacataagcacagaacctcactaactccccaaatntnaatttttccaatttgatcaccacnaantgtcnngggatcaatgnagaatttaattttntanttaaaacaataacncnccncgaggtggattcggatgatagaagganaacaccaagagaatgggcncaaacnacaaanaannccaaacgaacgggaaggagcagccttccngaaatttctcttanaaagcagaaaagnagaaccaatgcngccacctagagnccagccaaacaaantagggagcatacnggagaaaaaggtcagtatggcccnacaagcggggggcccggncgagaagcaatncnctcgaactccggatgttgccacaaanaaacacaaccacagagcgtgaancaancgcgccnccanagggagaagccaaagangtgtngacagcaaccaaangcgggtgggtngaaacacacgncggcgcaggaaacgggccgcggncgagnttnaggganggaggcccgggccnagggnccaggagagangacacaggagaacacggaaacatccaaaatgtacactggatcagagtgtgtacacaanaattttgatgtntgtcgcctcaaatacctncncgatcatcgcagatacattttcccattgcagatgatcaagaacacatanaatcctgggcatgg

SEQ ID NO: 692733 - DNA, 287 bp, Homo sapiens
  misc_feature (22)..(22): n is a, c, g, or t
gtacaatcagctcggtaccagnaggctgggcccagattaagatgtcatcccaccggggtatgcgagggtcactaggcgaggaggtgcggggcgctgtctgtgttcgagagagttggcctgggaggcgctaggggagagggcaggacttgcgtgatctgtagcgtggggcggtgattcggttgagaccgacggcgaggtgcaaggggtagggggggaggtcggatcttcgggtgcaagggggagacttgacatcttaatctgcgcccaagcctgctggtaccggctga

SEQ ID NO: 692734 - DNA, 1355 bp, Homo sapiens
tcctcattaacctttttaaaggggtctcaaaatcctgtgacaaatttgtgggctcaaggtgggttcccattaaaaagttacgatgatttaaaaaacgtaataactctaaaacgtgccacacgcaacaaacagaaagaccaagaggtggctccacaaaaacatttctccttgtctccttctcgtgagaggttctcacgaagtgcagtgtgctatactcgatttacaccgagtctctgtattatacatcactatagacactttaaaactgtggcctacagtgtgcacacaccacagacgagaattcgttgagacacctgtgttctattcccaaccgaacggtgaattttacaacagtgtggggtgtggcaggtgtttattagagcgcaactaaactagtcgcagttgaagccttctcgcaggagcccgtatacgtgggaacacaaactatgagggagagaacactaggacgcgaagggacatacacgaagcacgagacgcctctcagtgtgtctacacacgcgggcacttatgcgaaagtagacaacccgcgagcgcgcacaacaagtgacacaaggggctatcaagatatatacaccgagacaacaggcaagaaagggcgacacacacaaagaggcggtgaggcaccaacgccttcgtagcaagtgaacaggagctctatcacaacgcaacaccgaggatggggccttgaggtccccgagcggaacaccccagctaagtcgcacacacaaaagtggggacaaaggcagaactcaagcgacgaaggaaacgactctacgaagcgacacacactgggacgggggggcgcacaatagcttatacgcgcagggcagtattacaacagcgcaagagaacagccgatgacccaaagctacagcacgagtcgttcacgccccgatcatacaggagcagacgaggctgaacaaacgttagtgcaccagcaggaccaagaaagtgggttagaacggccgctgcgatgtgttgcggaacacaaacgtacgccaaaatattaccgacgggggaggcccaatacaagcaccgcgaggccggcgcatacaatatgtgtggagacccaccggagaaagcggtgaccccacggggacacaaaagcaccacccccatagtacagcacagggtgaacagacaccccacgcgatggaccaacccaccaatgagggtgagtagggcaccacacactaaagggaagttgcagcagcccacacgcagacaagcgagttaggaccccacagaaaaagaacaaccacacgctcgccccagtagacaagccaggcaaaccaaacgatcattcgttgtgacaaaccagttttaaaccaagc

SEQ ID NO: 692735 - DNA, 83 bp, Homo sapiens
gtcgtttcttaagagacagtatctcactctatttttcaggctacagtgcagtagtgtggtggtcacccttctgtcgtcttctc

SEQ ID NO: 692736 - DNA, 289 bp, Homo sapiens
atacatcccactggctgctgttctgaaaccatctgattggctttctgagcgatttggctgggtggagtgactgctctatttggccacttctgtcaaattggccttgtcccgcgttcctgaagcgctctctagctgttctgtaaatacctgtggcatatttctcttccagatccctcctcacgatgcacccaccgccctgagggcccgtcctaggaatggatgtggggatggtcgctttgtaatgtgctggttctctttttttttctttcccctttggcccttatccgag

SEQ ID NO: 692737 - DNA, 346 bp, Homo sapiens
tttttttggtggagtgtcctgggtctcttcttattaacggataagaatgtcaaaattaccttgcactcttcagaaaagtaagagtggaagtctgcatttggtccggggcttaggcaaagaagctaacagaattcctggggttgccatatactgtttatcagccctccagtcgtcaatactgggatttgggatctagaaagacctaatacaggtggtgctgaaaaagacttacccacctgcataattttttttaaatctctgctggcaggaaccgcctgcatatcataatttacaaactagaagaccacatcagcctcgtgtgggtaaaacagatgtgactagcagc

SEQ ID NO: 692738 - DNA, 143 bp, Homo sapiens
gattgcagccacaactcatggtccctagtcggattcgtttccactgtgccacgacgggaactccacaatttttaaatgtattattttataaacaattcactaatacacagtaatttaaaccaggaggttattagaggtcagag

SEQ ID NO: 692739 - DNA, 332 bp, Homo sapiens
cctgtcaacaagcgacgagagtcttctggagcgagagagggaaaagagaactagtaggggaaaagcagagcagagtgatcagacccctgctggagaaagggccaagtgagccaggtagagagcctcagagaggggcattggatgatctcaaggctgcagtctgcagatgactgagccgacatgaccatgatgaaacccgcggctcccagcatgggtctctgcgctctggcgtcctcaaagatcaggtctccgtgtagtctacagatgaattggcctgacaattgtgaccacaggcaggtggtctccattcatgttgactgggcgaagtcgtt

SEQ ID NO: 692740 - DNA, 218 bp, Homo sapiens
cctagaggatcctcataggtcgcagggttgctgcccgacagctgatgtggttgctctcagcgatcctctgggcctccttgttggatggccaggatggcctcgcgctccctatcggcgtcggcagggtggactcgaactggtcatgggctgagatcaggccctcaatctcctcgatggtatggacgatgaacatgtcctggaggcctgcgaacctatga

SEQ ID NO: 692741 - DNA, 617 bp, Homo sapiens
tgtatgctggactggagggcatgatgtttaatctaatttaaggagccactgattgtaaaacatgccattattttatgttgcactaagaaggtggggtcgaggagttgccaataaacttgggacagactcttgatggccaagccccactgaatttaagttttttgggtgtgggaaaaatacatcttggggtccatgaaataccatactcctgttccattcctcatggtcctctttgtgctattaacccaggtcttaattttgggtcttcacagcgaatctttgccttgttttgccccgtcttttccctgcctccggggtcctcttttacatttttctggtcttctcttgttgctttccttccgtcaatctgccctgcccttttttgtcatacacctcgggcgccttgtgacttttgctctttttttgttttgttggtttcctttccccctccccgcgcggcacgtccgggttggttttcttctcctcccctcttctctccgctctctttctttcctgtgggctattttgtcctccccctgctcccttccgctccccgccccttcccgccccgccgcccccgcgctccgctaccgctcccgcgtgaggagtgtgagaca

SEQ ID NO: 692742 - DNA, 1472 bp, Homo sapiens
aggagctcaactgatctgttttctttcgcccagccaaaatcacagaatgaaggcggtgaagagcgaacgggagcgatggtgagccggtgaagacaccgggactggggacgtggtgctgcccggcttgggggtgtgtagtgaatgcagtgagcgtctcagcccagaagtcagcacctccctgcccacctgacgtcctggaccactcctggtggtagccctgtctccgccgaacagctgagcctggcacctgtcgggccactgcggggaaccgagcccgaggagttagacggtcccaccaaccaaaaatgaacaacaaggccgtcagtggacgaaggaacagcaaagtcatcctcggccacgcttcatgagaaagcgagagtcctcaccacctacaacaagtcacaagtgcagaggccaggagcgtggagtgatcatccccgtgaagaggacagggaggatcgaggaggccaaacaggggaacccatcagacagacagggaaccacagcgcagagcgataaaggaaccaggagaaccggggaccagagccacacgggggaccaatgagaccgcaaaccaaagggaaggaaacggtctacaccgagaagcgcgcaaggggcagctggggcacacgggcatccaggcgaccccggcaatcgcgagcacacacacatgcaacaacggcgggcaagggccattccacgagacaacagaacaaaagcgagacacgcatccaccatacactgcccagggacggaacggagggacggcccaatacgacaacagcaagggcaacacgcaacggcagagccagcgcggagcgagaaagacggaagcatcacgagagaacggaaggagaacaacgtccgagagccctgggaggcacgacgcgacgccacacgcacacaagagaatgcaggacaccacgacggaaaaggaacacacaggccaaagggcgacgggagacggacataacacgaggcaggcaccacacgtactacggagggagcaggccacaacgaacgcatacaccggcagcgctatgacaggacgaaaaaaaaaagagtagggtggagagcgcgagcggagacaggccaggagaacacagcagaaaagaggaagggagaggggacgcgaacagagcgaaagcaaagaaacgtgacaaagagggcgaccacaaggggacggcgagacgaacgagcgagcacggagagacgggagacaagacgaagggggaacagaaaagcagcagaagcacagtgacaagcatgagacacgcaaagagaacaaagggaagaggggcgcgaaaagccagcaagaggggggaggaagaccaagaacgggcaagagcgcggaaggacccaagaagaaagagccagaaaagaacgacagaggaaagaagcaagccaagaagagacaggacggaagaaaagagcaagagacaaaaaggacacgaacagcagcagaagacgcc

SEQ ID NO: 692743 - DNA, 809 bp, Homo sapiens
ggcggcgtccaggcggcggcggcggcggcggctcctcagagtccggctcaggctccggctgcggctccagcccgcgatgccccattccgtgaccctgcgcgggccttcgcccttggggcttccgcctggtgggcggccgggacttcagcgcgccctcaccatctcacgggtccaatgctggcagcaaaggctgctattgggttgccctgtgcccaggagacctgatccaggccatcaatggtgagagcacagagctcatgacacaccttggaggcacaggaacccgccatcaaggggctgcacgattcaacctcacaacgtgtctgtggagcaaggcctgaggggcaggagctggcccagtgcccctgattgacaggcaggttccagggcacacaggatcccaccatcgatcctgagatccaggacgggagcccaaaaaaccagcgggctggcccttcaggcacgcgggacgtgggccaagaaggagtggcaagaccaaaggcgtgggatctccattatggacaacccccctccgtttccagtccctcacaagtgcagcaggaggcaccctgccagccaggatgaagcaccctgcagttgtgtctccacccccaaggtgaccagcagaggcctcacggggagccggactgaaagtcgcctggctcccgaggggggacagatgctggggaccagcgagccgggcggggagccaagaagaggtcctcgaattgggggatgaacagcgcgagcggagatgccggctggggccacgaaactaaaccacggaaaatgggcccctgagacatgcg

SEQ ID NO: 692744 - DNA, 841 bp, Homo sapiens
tggggtaccaaattccttaattggaaggatgggtccaaatcaaaaaccttaagtggatgtttgggtacaacttataaaaaaggtaaaggaaaccccaaaatgcttgccctgcctgtggtaaccagggaagtcaccccagggctagggggaaataagcccgaggctaacgcttcatatatcactggtctcccagggtgtgctggtcacaagagatattccgccaagccagattcggggcgctcccatctggcgcaatgtgggccacgtggtcacccaatatcttgagattggcttccacctgctacatccaggtaaaggtgtctcaatgaatgtcaccacaaatggggggctaattttgggtcaagtgggccagttggtggcactgtcccagtcagtgactggatccacattttttcccaacttggtaatggcaacactccatggcatttcaagcccgctcctcccagtcaatcaacagtcggggtttctgagatacccttgaagggaaaaattggggccacctcgtgggtactctggccagattccatccagcttcactcccgagaccagttgtctcccccttcttcctctaagtagaaaattgtgcggcgaacagaacgcggtcttgggcacaagtctctttacagagagccaacaattcatatcagggagacacaggtttagtaacacgaacactgggcccggggataacacggtacagaagagcggaaagacacctcccagggttggaccctgggacgggagtaaatagcgaggggcccatcgagaagcccccgaggggggaaagtacctgcgcggccccctcggcgaagggtgggag

SEQ ID NO: 692745 - DNA, 916 bp, Homo sapiens
agcgggtcttacccactgggtgggccacgcccacagcccccagctaggtgcctccgctgtccgggctctagtcccgccccgccctccccgccaccggctcgcagtcaccgggacgccaatcttgtgcatggagtcgcatttgctcctaagaggcgtcaggagaccgggctttcttccttctgcagctgaggctgcggcaggggccggggcatggggtcggggacaggaggaatttcgttgtcagagaataaaaggaggttgtccataattgactttaagcagcaatcagtaaaacatagagctcgattcagctcccgcacatttcttgctctgaaaattggaaaaacaagaaggtttacgatgtttgtgtgacgccacctgaattagaaaccaagatgaacataaacaaaggtggtctggtgtcgtcttcagcaaactcgacctccatcatgtactggagctatcaaagacaacttgcagagcggctaggcgtggacgatcgcgcaaagcgcccgctcacccaacgaacctaaccaaaagacaacaagagtacacatccaacgacatccgacgacgggacacacgacgttacatcatccacactgctcgacacgacggtaaacaacagaccagccaatggaagctcctgatatgggctataccctgtaccaacctcatgtcgccacgcagcatcatgggctaaacccctacttcacatacagaaagagtgcaaacggcgcaaaacacgtcacaggcacataaacagcgacatacctcattccaaccggcctaagcaactcatccatcgattcacacagaaagacatcgctcacacacacccacgataccccacacccacccccacacaccacgacaacaccaaccagacatcccaacctataccaagcacctcccg

SEQ ID NO: 692746 - DNA, 492 bp, Homo sapiens
aagagcatgtagtgcaagtggcgaggtacatagctcattgcagctttcaaactcctaagactctaagacgatcctcccgcctctgcctcctgagatagctgagaacacaggtgcaagacaccacgcccagctaattatatattgtagagacggggtatatgtcatgttgcccgggctggtctcgaactcctgggttcaagcgatcttcctgccttagcctcccagagtgctgggattacaggcatgagccactgcaatctggcctcattttcttgacagtggctttaacagagtagaaaattttaattttaatgaagtctagcttatcagttatttcatggatcatgtcttaaggagttgtaatctcaaaagtcatcaaactcaagatcatctaggattattcttttttgtgaatcctctaagagttttaaatacagttttgagtagtacatttaggtctgtgatccatttagagttaatatatgtgaagac

SEQ ID NO: 692747 - DNA, 277 bp, Homo sapiens
gcagattgcctgagctcaggagttcgagaccagcctgggtaacacagtgaagccctgtctgtactaaaatacaaacaattagccgggtgtggtggtgtgcgcctgtagtcccagccactcaggaggctgaggtaggagaattgcttgaacccgggaggtggaggttgtagagagccaagattgcacaattgcactccagcctgggcaagagtgagactcgtctccaaaaaaaaaaagactttgcctgaacaaatgtgccctaagtttcaaattaatt

SEQ ID NO: 692748 - DNA, 479 bp, Homo sapiens
  misc_feature (169)..(169): n is a, c, g, or t
  misc_feature (174)..(175): n is a, c, g, or t
cattagctattaagacacgcacataaatgagctgcattgaatccacacatgccattccatgaagacatcaaagaggatcatgtggatctttggtgccttccggttggcccctccctaggtctgtgagggtcagacatatcctgacacaacaaaaaaaaaaaacaaaacnaaaanncaaaaaacaacaaaaaaatagacggctgttattagagactgaatgtttgtgtcccccccaaattcctgtgttgaaaggctcacccccactatggtagtgttaggacgtggggcctttgggaggtgatggggttatgagggtggagccccagagagctctcacgccctttccaccatgtgaggttatggtgagaagatggtctctgaggaagctgcccttgccacacaccacatttgccagcgccttcatcttggatgtctatagcctccagaactgtgagaaataaacacttgttgtttaagcc

SEQ ID NO: 692749 - DNA, 126 bp, Homo sapiens
aacactatatacttgggatgctgggtttcgtaaattctaaaattctcccaaacagtatctttcagtcgtctagttgccctgtgaaggatgatcatgaagaaacaaagttcttcgcctcataaattt

SEQ ID NO: 692750 - DNA, 178 bp, Homo sapiens
taaaacgaagggcgtctagcatcttgtccaagtctttgagcgccactcactcagagggtctgtcactcattcctgaacttgaatctgctggtttaatcaggtcaggcagtgtgattgacagcgtagaattcttgagatgttcccaagcccttttggtaaccctagggcggcttgaaaa

SEQ ID NO: 692751 - DNA, 264 bp, Homo sapiens
tgagagcagtatcgatacaataaatgtacgaatagagtcagataactgcattctgaagatggactacatctcttcgcacttggaggatccacatactgtgggatccctatttcctttcatcgtagcttcccagtcaacaatttatgtgtcgattctgttgcctttcttcagagaagctcaaggtcccctatgttacaaagatattcttggtcatgtgaagctgttggttgtgcaacctcatactgttcatttccagggtcttgg

SEQ ID NO: 692752 - DNA, 734 bp, Homo sapiens
gaacaacagccctttcctgaccatcaccagcatgacccgagtcatggaagtctctcactggggtaatatggctgtggatagaaatatgtggacttaaagcacacaggagctgtgcttaaggggcctttcgcacgctatgattaccagagacagccagatagtggaatatcctccatccgttctttgaagaccatccttcctgcgtgctgcccagggatgtttagttacacgggatgagattgggcagatgtggactaccagccagcctccttatggtggagtgatcgtctgtatgagatggaaagtccggcctcgctatccctctcttaggcgggtggagagacccattacatcagtgggctacaacctcccaaggctatgagtacctctataatttgggtgaccagtgatgcactgataagatgaggtctggtggaccactgtgtgtggagttgaacaagtgatcagattctctgactgtgaagatcatgcctgcctgaaggagccaagaacattgaaatcgatagtcgcctatgaaatcagccgtgccccgagatgagctggactacgacctatctggacacatttggccgtcctgtgatagttgcctacaagaaaaatctggtagaacagcacattcaggaccattgtggtccactacagcgttcaacaaggtgctcatgctggagggagccctgctggtggtggcggcctttctacatcctggtctttac

SEQ ID NO: 692753 - DNA, 755 bp, Homo sapiens
ctgagctggggaggctgtcttgagtgcgtgcacctgtcaccgacaccgatggcggactggcagccctgagcgtcgcagtcatgccggacggacccgtgcaggcggtgcccccgccgccgacccgtgcccatggagcccaaacagcccacagaagaagaagcatcttcacacggaggattcctgcaccttctaagccagtagtggggattatataccctcctccagaggtcagaaatatgtagacaagactgacagctttgtggccagaaacgggcctgaatttgaagctaggatccgacagaacgagatcaacaaacccaagttcaactttctgaaccccaaaatgacccttaccatgcctactaccgcacaaggtcaagcgagttcaaggaagggcacggctcaggagccgtccgcgccataccccaaggtcatgcaagcagcagcgagacagacacaccagaaggagctgccccagaagggtcaagcccaagtaatccaagagaccatcgtgccaaaagagcctcctcctgagcattgagttcattgctgatcctcgcatctatctcagtccttcgcacgggaatgtggtgaagctgaccggctcagtattgtggaccaggattgggcgccagttcatgacccagctgcatgcagtacagagcagcgcaataccaggttgactttctacggccaagcacagcactcttcaacaaattcaggaagctagttggacaggcacaccagggatcttg

SEQ ID NO: 692754 - DNA, 770 bp, Homo sapiens
gctgagatgaccctgtcgctcgacttctgctgttcctgccaccggctgctgctgctgctggaccgtccccacggacggcggtgcgaggcgtccctctgcaagcgttagacttcttcagggaatggggcaccagttaactacaaggacaggcaatctatacctgcgggggcccctgaagaagtccaatgcaccgcttgtcaatgtgaccctctactatgaaggcactgtgcggtggcttgacgataccttacctgatccggagagcatcttccgccaacatggctgtgtggtcatggacgatcctcaatgtcacgctggatgccctacggaagacgcagcaggaacaaaatgtcagatgtgcaggtgggagttcaagtgccagcatggacaagaggagtgcgatatgcaagcaaggtggaggcctgcgctgtcgtgatgaacttgacatggtagctagctcttcctgaccattgtctgcatggaagtagtttgagtgacatggagagaagtctgccacgtatgtcctgtcagtctctacagctccccaggccgtgtcgccgagacactatcactggagtgtgcgaattggcgggaccgccggacagtgcgaggcatcagtgacaacgcacaacgcccatgccggacagatgctctccagagcaccgacgacgagtatgtgcccttgaggtctagccgtcatagtgggaaagcccttggaagatcagactccagctccttagccttgtctgccagttgtaccagggcaagaa

SEQ ID NO: 692755 - DNA, 293 bp, Homo sapiens
  misc_feature (6)..(6): n is a, c, g, or t
gtgggngtgaacggtcggagcgggacggatttcgattcaacggggttcggaccgcgactgcgcctatggagcagtgtcaatgagctgaaaggagaaaggcaacaaggccctgaagccggtgggtacattgatgatgccttacaggtgctactccgaagctattaagctgggatcccgcacaaaccactgtgctgtacagcaaccgtatctgctgcctatgccaagaaaaaagggggagactaccagaaggcttatgaggatggctgcaagactgtcgaaccttaaagccctga

SEQ ID NO: 692756 - DNA, 936 bp, Homo sapiens
acgaggcgcttgagatcactagccaggttgttgaagatgatgaactcatttccgaagtaaaacagagaattacttgctttcagatagccagttgttcagggcgggggtaacattttttaaacattaccatatatggggatgattatgataccatcctatcctgtagatagtactcagctactcatagagtgaatgggggctatataatgacttggtaccaatgttggtaatcaagtgtcctgatagggtagatcattggtcctacttcacaccggctgtggtacctaagggaagtcgttaactggatacttgcgtccacgaaaggatgaagctacgtggatctgtacacactggatgctatcccaaggatcaacttgggaagtagaccgtattaggggaacgaacaaattgttccatgtcttgtaggggtccctcttggggcagagttaccgcccagtatgcattgtgcatttctccttgaatgctactggtcatcccgtaagcacatggttttctttgcgttttacattttgaataagttgcgggcctcaattggatacatcgtttacaggaattcttttgttacaggagatcctagtggatcttgttgtttagtccgtacgaagctccattttatatacattacgaagatgaattcgaggattttctacatctccagatcaacataggaacttgagaggaggacattgcagactagattcgttgctccatgtccacgataatgcatcacctggtgggcttcccccgaggggtctcagggggtggcatcaacgtgagacatgagcaatcgctcaatgtaggggtcatgtttcccctggtaacctaaagtgatccggcggtagtttcgcgcttcccagtggtagtctgggcactggacggtaaaggtacaaacaatggggggttagatttaagact

SEQ ID NO: 692757 - DNA, 410 bp, Homo sapiens
gatgcacgatgtagggaggcaacagtcgcctcaattacattacatggctagtctagatatcggttaccagattccgaaggtgacccttatcgactctcagtgccatatactttgcagagacacggagcgtatccgtgtgataactgagaaagacagctgagacgatgccgattgagaagctgcgcagatcggcctacactatatttagcctatgatagctaacgctgtgtcaattagcctactgtgaggatcaatatgtctgccttatggtaaacctgtggaactcactacactagctgctggtctctatgacgagtctatctggctatatatgatgtggatgcttctatgtcctactgcgctgcactatagacctgcgagatgccatgggtatcatctgggcgctcgct

SEQ ID NO: 692758 - DNA, 115 bp, Homo sapiens
gagcagcacttgcacaataaatgggcagcagtatcactgtctctgctgatagcactggtctgaaactcccttaggattagactgaaacacaccattctagggccccacttaaata

SEQ ID NO: 692759 - DNA, 722 bp, Homo sapiens
  misc_feature (27)..(27): n is a, c, g, or t
  misc_feature (30)..(30): n is a, c, g, or t
  misc_feature (34)..(34): n is a, c, g, or t
  misc_feature (40)..(40): n is a, c, g, or t
  misc_feature (42)..(42): n is a, c, g, or t
  misc_feature (53)..(53): n is a, c, g, or t
aacaccgcccacccccatgacaccatnganaagnccgagngncatgagtaganacccgggaagacggtcgaaaccgtcgggagcgcaggctcacgcctgtaatcccagcactttgggaggccgaggcggacggatcacgaggttaggagatcgagaccatcccggctaaaacggcgaaaccccgtctctactaaaaatacaaaaaattagccgggcgtagtggcgggcgcctgtagtcccagctacttgggaggctgaggcaggagaatggcgagaacccgggaggcggagcttgcagagagccgagatcccgccactgcactccagcctgggcgacagagcgagactccgcctcaaaaaaaaaacaaaggaccacacttaagccacatccaacacaggcaccattcattctactcacgcattcattcattcaacaaaagtttcaaagctcttactctaccaattctccctattgatgaaatattatctgcaagaattcaaagaatagttcccatgagacggagatatggaaaatacatctacttagcgccattctagcatgaagactggtcaacaactactccatgaaccagaatccaattgctaaaacgggcaaaggagccttaggcaagaggggaaatctgtaccgcaatggcgctaaaatcaagggcatctcttcagccggaaacgcacacccagggggccaaacctctggaagcctg

SEQ ID NO: 692760 - DNA, 231 bp, Homo sapiens
atagtgacccagactcacgtctatcatcctgtgctactgtgcggtaccggcttgttgaagggctgagaagcgatcaaagaacaagtagctgggcaagcagttctgatgctgcgtctgagggcttggcacctaagctaccgctgctgcccttcccccagctcagtcgccctccaggtgcccagagctggttgatagagtcgatggagccaagcttggtcgatcttgatgcgt

SEQ ID NO: 692761 - DNA, 301 bp, Homo sapiens
ccgggacaccctggctgtcatccgccacttccgcgagcccatccgtctcaagactgtgaaaccaggcaaagtcattaataaagatttgcggcattacctaaggcttcagtttcaaaaaggatcaattgacccacaacttcaggcaggtgattcaagagatattctctactttgagacccatccatgcactacagggcccccaagggtatggagatgtcccaggtgttgattataatctcattcccgttgcacagtcacacgcactgggagagagtagaagcattgttagaaagttggacat

SEQ ID NO: 692762 - DNA, 428 bp, Homo sapiens
  misc_feature (28)..(28): n is a, c, g, or t
tacagggtggtcacaggataacaaattntaggcagcagatttacatgacttgaggctgtgggctgttaagacgttgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactctttggttaaagaaacccatcaagatgaaaccccagaacccattattctctcttgggtatgcccaagctcccctttcttgagagtgtactttttgctttgcaataaatctcttctttcactatcaaaaa

SEQ ID NO: 692763 - DNA, 164 bp, Homo sapiens
tggagcgccttctctctgcttttggagaaagggaatacacgataaagaaggagacggaaagaagagaaaaagtgaggcgggagacagagggaaaagggcgtgaacagaaagggccggagcgtgcaggggagcacagggcgcgggggcggcactgccgagccggg
